United States Patent 7,745,391 (HUMAN THROMBOSPONDIN POLYPEPTIDE) - sequence listing, part 205

SEQ ID NO: 490577 - DNA, 924 bp, Homo sapiens
atttacgttggaagcttggatctcattaaacttcatgtctctattccatttgtgccacacacttaacaagcttagtgtactgacatgggaagcatgagcatttctagttctacacttcttcttttaccgccctcatgtgtaaaatgaaaaaactaaactatgccctaataccaaggcgctaccgtctattgcctcgtctatattcactgacctaacgtaatgatacacagtgaatatctttctgacacaagagaaactgcagtgtagtatgcagagctgctgttttcaactgcctatgcatttactctttcctgatttaggcacgaggtggcccattccttatattgcactatctcctacttctcttctaactgtacccataccttcagtactactccttggtaacgatcagcgcagacctatccattctgtgtggccttgacatattcctcatctatcaccatagttggtcattacaccagtataccacacttctatacagtaactttacttcctctctgctgtaattccctggaaccacacatctgtccgtgaccatcagaccttccctaaaatagccatgggcacatcacccgaggttgcattgcccatcctaccatctacagatatcaccatacctcgcgactatacccacgtcaaaaggaacatgggctctctatccacccccaattgatataacaccacagtgcattgggattactatcaaaataactattccctgtaaccctacacatgaacttaaaattaccgggcacactggacaccttagttatagcaattatcgccaataccgtattagatcggccgaacttttaaagatagacattcaggagagaaacacacaaactaaatatgacccggaaacacacaaacgtacaccattatactaacaacaatagtaaa

SEQ ID NO: 490578 - DNA, 193 bp, Homo sapiens
cacgcgagacgaggtcaacgattcctcccttaccatcaaatcatttggcctccagtggtactgaaacctacgagatacaccgactacggtggactaatcttcaactcctacatacttcccccattattccaagaaccaggcgacctgcgactccttgtacgttgacaatcgagtagtactcccgattgaaacc

SEQ ID NO: 490579 - DNA, 320 bp, Homo sapiens
ataggggaaggcaccagggtggggaccccggttttggccgcctcctcaatccgtgcctcggtttatcctttggtgaagcagacgccacagtttgtgagcagctttgtgggggtttgtgtgcccctccgcactggctactgttttcctcgggggccggtgggcttttgggtccccacattcagtcccaactggggttcccggggttcccgccctggccgcagaggagccacggggcacagctggctgtgtttagggccctgcacagccccccagccagtggctccccccccagttccgaaagaatatggccccccagagga

SEQ ID NO: 490580 - DNA, 2774 bp, Homo sapiens
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaatttcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaacgtgttgtctgtagcttgacaagatatttcaaatgagaactttttgtagcgtctgttgttagcaaagaatagattcacacagtctaaggtttccttcctacct

SEQ ID NO: 490581 - DNA, 160 bp, Homo sapiens
  misc_feature (122)..(122): n is a, c, g, or t
gtcccggagagctgagcagtcaagatgtgtgacttcaccggaggccagaccgccagagttcaaggggggcttccagctgtttggaccgaacaggtggatggcaagatcctgtacagccagtntggggatgttatggagggcctgggcaggaaccctacca

SEQ ID NO: 490582 - DNA, 2677 bp, Homo sapiens
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaacgtgttgtctgtagcttgacaagatatttcaaatgagaactttttgtagcgtctgttgttagcaaagaatagattcacacagtctaaggtttccttcctacct

SEQ ID NO: 490583 - DNA, 2686 bp, Homo sapiens
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggcttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaacgtgttgtctgtagcttgacaagatatttcaaatgagaactttttgtagcgtctgttgttagcaaagaatagattcacacagtctaaggtttccttcctacct

SEQ ID NO: 490584 - DNA, 1781 bp, Homo sapiens
ccgcctcccgggttcaagtgatcctcttgcctcagcctcccgagtagctggaactacagattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaacgtgttgtctgtagcttgacaagatatttcaaatgagaactttttgtagcgtctgttgttagcaaagaatagattcacacagtctaaggtttccttcctacct

SEQ ID NO: 490585 - DNA, 2687 bp, Homo sapiens
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcagtgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaacgtgttgtctgtagcttgacaagatatttcaaatgagaactttttgtagcgtctgttgttagcaaagaatagattcacacagtctaaggtttccttcctacct

SEQ ID NO: 490586 - DNA, 802 bp, Homo sapiens
tggggaaccggggcccaacccaagaggcaatcgcgacccttgccatggcccaaaaaagcgcttgcccgcaggtagggcccagttctgtgtcaggcgaaacagcggggtcctcgtgaaccgccagtgccaccccctgtattgaaattctccacctcgagcgggatccgtaagttccagaaggcgtctttcttgaaaaagtggagaggccctagttgctccaaattggttgcaggaaggtggctttcgattgggctgtgtccacacccggacacgagtggggccataaaacatccggggcgaatgggtctgctcagaggggaagcacttgagcccgaaccagtccaataggagttgatagtggcggtcatgctcctgtaccctgtttaggccgtacggctcctggtatgtcaccccgcggtctcggacaagctggggactgtcagatgggacatgcacttgtcgagcatgctattgagcgcccatttagcaaagctagtcctcaaccagctcgtatggaatcaaagcagcatacggacaatggagcttaaatgtcatatccaaacaataagacgagtgccatccatcataatgagcctgtcacaaatgttcatttcattgacaggaaccccgggttatttggtacaccttttgcaggctatcatgtctcggcagaaatcatatccggcccccatgctgctcgagggcatgtctggtgtggccgcgttgaaccagcctccagggtaagatatccctgctgggtgcaggtgtgtctgattgtgagcaaagcagtgtgtgtcataaa

SEQ ID NO: 490587 - DNA, 252 bp, Homo sapiens
acggcatcttggacttctgggatcagcgactctcctgtctcagctccctagtctcggctcactgcagcctttgcctcctgggttcaagcgattcttatgcctcagccttatataatacagtttcataaactattttgatgtactattttaagatcccactggtttggaatcagtgtcatcaggattctgcagagtcctttctactgggatgagagttattcgtggcttccacatacgaggtatgccggaggc

SEQ ID NO: 490588 - DNA, 1131 bp, Homo sapiens
tgcttggttttttgtctgtcttgtgtctccttgctttcagttgtcttttgtcccgcgtgttttgcgctgttctgcgctttctttctagtcgtggtgtttgtttttgttccttttcgtgtcttgtggtttttcgttcttgtttgtcttgtggtgcgttcgttgctgtctgctgcctgttcttgatctctccgtctttttctttgcttctctgttggtggttggtgttgtctcctgtttctcgtttggtctctggtttgtgtattgggctcttatgtgtgtggggatcgtatgcttactttgatgtgggtgggctgttttgcagcgtttgttctgtggacagcgagacttggttaggctggggcgcgctattgttttttcatgtttcttgggagcgagggctttgtggtctagtcggatgcagggtcgttgtaggcctgtgcgtactgcggatgcgcttacggtcgatgtggggctctgtccttgccgtgccgcagcgccggtcgctgtgccgtcaagtcctgccctgtttctgtgtgccgtccccatcctccgagtttgctgtttgcctggagtgtggcttgtcctctcttccttgggatccccgctcgccaggcttggtctcgatgtttgccatgatgtattaggcttatccctaatgggagccgtgccccacctccccagcacacaggcctgtctgtgggtgctggtgtcatccgtgtcctgcctctgaggaagcagttggggcccgtcttgccatgcctccttggctgatctctccatggtcagtccctgtgttctgtcacaggctgggtcaaaagaagtccctggctctgtccctctcatgggggtccatgctggggagatgggggcttcttcctcacactgctgtcctctcccccttcagctcctgagtagctgggcctgtgcactgggcaggttcctggggaccgcctgccctgccttgccgctccccttggacctccaggggctcctgggcttggatgggaaccaccagcgttcccttctcccccttgtcttcccccctctcctcccagctgcttaacataaagctgatttgaacttttgattgagggagaaacacctgatacaatctataataaagggtcgttg

SEQ ID NO: 490589 - DNA, 274 bp, Homo sapiens
  misc_feature (157)..(157): n is a, c, g, or t
tacaggatccgtgaatatccagagagtcttggacaagagtgacgcagtgaatatctttgtcactgggtctttggtagagtgttgaattcgcccaagttcacgttttgacgggcttcggaccaattttgactgtgaatttccagtcgggagggctctnaccctcggcgtagggccgggccgacaggaacagggaaaatcctccaccaagatgctgactctcgggatatcggatcgggactggtcgcctgaaccgcgaccggtgaaaacttctggt

SEQ ID NO: 490590 - DNA, 440 bp, Homo sapiens
  misc_feature (185)..(185): n is a, c, g, or t
  misc_feature (190)..(190): n is a, c, g, or t
gtccatagagtaaagtgaaagcaagtttattaagaaagtagaggaataggccgggcacggtggctcatgcctgtcatcccagcactttgggaggccgaggcgggtggatcatgaggtcaggagttcgagaccagcctggccaacatggtgaaaccctgcctctcataaaaatacaaaaattagcntggcngcataagtggggcggcccaatggttcttggtttaaggtcccccaaaggccttggcctttggggggggaaagggggccctttgggaaaaggcaggagaattgcttgaacccaggaggcagaggttgcagtgagccaagatcgcgccactgtactccagcactccagcctaggtgacagagcaagactcagtctcaaaaaagaaacaaaaaaagtaagggaataaagaatgggctactccataggcagagca

SEQ ID NO: 490591 - DNA, 239 bp, Homo sapiens
gtggccccgtttatttggtggaacaaggcgtgtaaagttgctctgcagtgctccaccgtatcactccttctcgaatcctacagaacatcaaggtgtttgagtacacctcttagcccagaagagatgaagcagactaaatgccctgaacaaaaattggagatatatagtgcctatgcttacggtggatgggaagagagtcccaagggatgcaggacatcctctgtacccctttaatgacc

SEQ ID NO: 490592 - DNA, 546 bp, Homo sapiens
ggtccgtcctggcagctatcggttcaattcttactatgcacttactcacaaagtaaccttgagcaaattattggccaggtgcaaaggctcatgcctataagcccagtggctttggtgaggccaagatgggagatcacttgaatgccaggagtttacaaccatgcctgggcaacatggtaagtccccgtctctacaaaaaaaaaaaaaatggttgaaaaaaaaatacacagggccaagatacagtaagtatccaataaaggtgagctatcattatcaagaagacagagtatggaaccgggatagttggcctctccttaagggaaggaagcgtgatgaatgattgatgtgtagacttgagggatgactataaaagggggacgtaggatagaagagaaagaacctacagatgacaatgattgtaaactaatttttcttcatgtgtaagcggggtgctcgctgggtgatatccagatcctaacaagattactgggtaagagggttaggcccagtaacgggatggcgaccagtatgataatatttggaccc

SEQ ID NO: 490593 - DNA, 416 bp, Homo sapiens
ttaaaatggctatcctcagtatgttcagaggactgaaggaaccccagctagagattgcatggaaggtctgaagacactgtctcctcactggagaatgtcaatgaagagatataaattatttaaaaaaaaaagtcggccgggcgtggtggctcacgcctgtaatcctagcactttgggaggccgaggtgggcagatcacgaggtcaggagaacgagaccatcctggctaccatggtgaaaccccgtctctactaaaaatacaaaaaactagccaggcttggtggcgggcgcctgtggtcccagctactcgggaggttgaggcaggagaatggcatgaacccgcgaggcggagcttgcagtgagcccagattgtgccactgcgctccagcctgggcaacagagcgagactctgtctca

SEQ ID NO: 490594 - DNA, 1304 bp, Homo sapiens
gtcaacatggtgaaaccttgtctctactaaaaatacaaaaattagctgggtgtggtggcatgcgcctgtaatcccagctactcgggaggctgaggcagcagaatcacttgaacaccggaaggcagaggttgcagtgagccaagatcgtgcaactgcactccagcctgggcaaaaagagcaaaactttgtctcaaaaaaagactcttttcaagttttctaccctctgagtaagaaaatttggggatatccagtgccatctccaagggactttcagggggatcactagatggctttttccttggggctaatttggtttggccctgtgtaaaaacaagtgtgaatatctcgcgatctgctcttgtgtgatacaacagaggcttgtgcaacacacactactgagagtagatcacgaattacgacacagagggcctagtttatagacacacatgcagtggtacgcttagcgtgggtgaaattgagcatgttccactgtggttacataagtgcacgcaacagaagattgtaactccaggataaaggcgttctccctcatctataaacagttagatttgcacttaatttcttttgtaaataatgcaggaagcccaaaaaataggtaagaggcgaggggggaagaggaggcgcagcatgtgaaacgttcttggatggtggaccttgaaagagggaaaaaagaccatgagcgacacagaacaggaattcgatgcttattaaggataatgtatagaacaaggacgaagggccgtactagaaagtcgccagaagtaccagggcagccgccaagggtgggcgtggggacacaccagggcgaaacgggaaaaaaacagggatggggggtacccaaacgctggagcttgggacaatccgtggacaaggccacttcgacagggaagaaaagaaaagcggaagtgagcagtagtccacaggcataggacaaggcgcagcgaaggcaggagcacgaggggtacacatagcagagagccaacgccatgatagagacagcaccagcggagcaccatacgacactgggatacccgaagagggccgccacaaactacaagcaccgtgggcggcgtgtgaacacaaacgggaagaaaaacgagcaacaagtaaaggacaggggagaggggagcagagaaacaataacacgtataagaggcacgacataaagacgagaagggcataaagtctcagaacaaaagacgccagagggagtagcccaagcagagaccacagagctagaaaacgaacgcgacggagcagactagagaaagcggggcaagcga

SEQ ID NO: 490595 - DNA, 709 bp, Homo sapiens
tactggtgtcatggcagccccgaagacagtagctgtggggccgttggtgggagcggtggtgcacgacaccaactccactcgcttgctggtttcaattcaaaaagcagcggagactacttagtcatcacaaagtggaattaacacaagagtacccaaaagaaggatgggtggaacaaggacccgtaatacgaaattcttcagctctgtctacgagctgtatagcgagaacgtgtgagagaacttgaggagactgagatattgatatatccaacataaaagctgtgggagtcagcaatcagagggaaaccactgtaatctgggacaagttaacaggagagcctctctacaatgctgtggtgtggcttgtatctaagaacccagactactgtggaggagtcttagtaagaaaaattccaggaaatagtagcttcgtcaagtctatcgacaggccttccactcagcacttacttcagctgcagtaaagacttcggttggatgcttgacaatgtgagaaacgtccaaaaggctgtggaagaaggtagagctctggttggtaccatgtgattcatggctgtatctggagtttgaccggaggagttaatggaggcgtgcatcgtacagatgtaacaaatgcaagtaggacaatgcttatcaatatccattcttttggaatgggcataaagagctctgtgactttcgtgaaattcca

SEQ ID NO: 490596 - DNA, 369 bp, Homo sapiens
  misc_feature (91)..(91): n is a, c, g, or t
tccacgcgaggtgtgacacgagaccacaggagcgcagcctgtggccccacaccctcttctcaaaacacactctacgaggccaatctgtccncatatggccgacaccatgtggtctctcctttccccctttccaagtcacagggaagtggacacaggtcaagtgtgttggttttataagcgcaagcctttgggaaaggcacacacatttgggaattacatgtgaattccccgggagtgtggctttggcctctttctcttttgaaggccaagggccattaaccagaacttcacactataggcccaaggcacaacccccttcctttacacagagggaaccttattggctgggtggcctttcttttggtgttg

SEQ ID NO: 490597 - DNA, 234 bp, Homo sapiens
gacaaaggagttctgctagctgtgctgcatgggccagactgaggtcttgctgggagcaagggcagtactgttatacctgggttgctgcattgtgggaggggaccaaggagggtaggggaacatcgaccgtggcttaggactctcctgtctgcagggacggccccacacacacacgctcatactcacagtcatgctcaccatacatggacagatgctcacatgcatgcacccagg

SEQ ID NO: 490598 - DNA, 202 bp, Homo sapiens
actaatattagagatcaggctcgtcctattatctgttcgtgtatagttatcatttgttctgaggttcgttattgcttagtcatagcttgttttccttgtattaaacggttgttgatgagatatttggaggtggggatcaatagagggggaaatagaatgatcagtactgcggcgggtaggcctaatttctctcggaccaatg

SEQ ID NO: 490599 - DNA, 173 bp, Homo sapiens
gatgtaatctatgcttcaccatggtcttatgaggcaggctgagagatgttcgaatttttctcttcctttcagtattcttagttgtcagcttgccacggatccctgatcccattctcctctgcacgctcacctcctaccccataggacgtacgacagtacgggttcacggcctc

SEQ ID NO: 490600 - DNA, 538 bp, Homo sapiens
gttgtgctgtcccctgcctctagaagctatggggaatttggaatcttgtgtaagtgcccaaataagtctgagtgctttcctcttcttcaacactcaaccctctaatcccgttagcactgattagagaggtcccccaaagaataccagctggttttgacccatgatagcattagaaactgcattgttcagttcaggagccactagtcacatatgactatttaaatttacaagtaatacttgtagtgaatacaattcagtttcgttcaagttgcatttcagctcagcattttgagctatattcatgtaggcggtggctagatttactggtatttaagcacataatgtatatggaatcatttccatcaccacagaaagttgctgattggacagcactgcattagaatattttgcatactgctcttcctcaattaatttgttgttgttaatgttgatgtcttcattggatgggtcataatgttccagtgaaacctctcaagtacacaattgtatgttcttataatccctagccacacatatc

SEQ ID NO: 490601 - DNA, 124 bp, Homo sapiens
tcatccacatcagcatcacaaccttcattcctcagactcccatcgagaggctgctcatgcgactctagcccgtccgctagcgttcggccgcgtcaaccgtgcgagaacacgatcagcgcggccg

SEQ ID NO: 490602 - DNA, 785 bp, Homo sapiens
  misc_feature (2)..(2): n is a, c, g, or t
  misc_feature (45)..(45): n is a, c, g, or t
  misc_feature (68)..(68): n is a, c, g, or t
  misc_feature (81)..(81): n is a, c, g, or t
  misc_feature (120)..(120): n is a, c, g, or t
  misc_feature (138)..(138): n is a, c, g, or t
  misc_feature (189)..(189): n is a, c, g, or t
  misc_feature (249)..(249): n is a, c, g, or t
  misc_feature (252)..(252): n is a, c, g, or t
  misc_feature (254)..(254): n is a, c, g, or t
  misc_feature (267)..(268): n is a, c, g, or t
  misc_feature (318)..(318): n is a, c, g, or t
  misc_feature (329)..(329): n is a, c, g, or t
  misc_feature (355)..(355): n is a, c, g, or t
  misc_feature (365)..(365): n is a, c, g, or t
  misc_feature (407)..(407): n is a, c, g, or t
  misc_feature (498)..(498): n is a, c, g, or t
  misc_feature (534)..(534): n is a, c, g, or t
  misc_feature (667)..(667): n is a, c, g, or t
  misc_feature (706)..(706): n is a, c, g, or t
  misc_feature (769)..(769): n is a, c, g, or t
cntctagattcagctatacaactggatagtgtagtacggtagcanggcactatcataggcaatacaanaatgtgcatctantgtcattgtccagttgaatgatctgtgtatagggtcacncaagagtgcaaaagcccnaaagaagctgattcagcatgctgttacttagactgaagacaactgctgaanagcatctatagggcactcactaggcatctcagcacactcagctgcagagcagacccatgncancnacgctgaccatanncctgacatttcttggctatcacctccaaggtagacttcgttcagagctanactactggcanaccactaagaatgaatgtgaattctntgttcacctntgctagacagatccaagagtgctgactgaaaagaacccaccnaagtgtcagtaagactctcttctacagacatctgatctagcacctgagattacactggacaatgccagtaagtctgttgactgaacaaaanatagtctccatggaaaggataaatggaaagaccttntgtgcaccagatcctcatggctgcctcaaagccagtttttccgagtaaggtgagcctaatgttctttctgtagcctctgtacttccactggattgtgctgatggtggtaagagatatagttatagacactgtntgctgaatacaaagaaatatagcccagagaagtcaaacncaagtgctgtccactgagaaggaacaccagctacctgctggccaaaagagtcccagactaatntcttgtagaagtcagt

SEQ ID NO: 490603 - DNA, 370 bp, Homo sapiens
cccaaagaggtttagcccaagatccccaggggtttcacccgcaagctcgattgacttgcctccattgcccaccccaagcttgggaagcgtgcttgtgcccgtatttccaaggggctcaggctgttccggccaaaggccaaggcccaggccaaggccaagggtcaaaccaaggcccagggtgcagccccagcttcagtttcaggtcaggcttcccaacgtaccccggccccttcaaagggttcagagttgatatttttgcccacattagggcagaagggctggttcgaccccccccccccgcccctggggttccctttgcatggggctggggtcctcctgtgctatttgttcaaattaaccttaggccgga

SEQ ID NO: 490604 - DNA, 1438 bp, Homo sapiens
gcgagcgaggagcgctgggacctagctagacacgctagactgcctatacagagctgtggccctggggccctggagtcgtgccggagccagccctgggtacctagacccctggccctggctacccgctaccgggctactagccggcgggcgtagcgagctgcggcgtcggtaccgtggccggggggatagtactacggcggcacgcgctagcgaggatactaggatagagctagcactaaccagtgacacagatatacagatagtagccggagcacgcgcggataacgcaagtagcaaggtacaacataggacccatagaggaggacagagcaggctagagggccctaggtagcaggcagttaggcacagcagggacctaggaagtaccctaggccaggccacttaaccctaaaaccgccactagcaccaggcaatagccaggtaacagggtaggctagagcaggttatttagacatacccagaaccctaagtacacagggggcccataggacccaacagacaggacggaccacacaacagtacatacgacgctagagtaaacagaagtaatagtgcaccaacagccagtagtgaccactagctaagcccaatgccacctagcacaggggctcgggctaggcggacagccagtagccggcagaaaccgcttaggcacacagccagcctaacacaccctaagaagtgttagcccaggaaagtaatatagctagggacccgcagcgcagggaagggcaccgccataacatactagcagaagcggcccccaccaaaggggtggcctaggggggcacaccggactagggggccccgcaaggaataccggcccacgactagtaggcccaaggggcaggcacacggacccaattaggctagcataaacgaaaattacacttagggaactcaacaaacgcaatacctaagagcggcacgggtagggccccacactgcgagagggctaactatatgaggcacgacattaaccaacaagaatatggcaacagccccccagatgagtaactaaagactcagcactacggcggctaccgacggcgccgaggggaacgggcttcaccacacattaggcccaagcccccccgcgcacagggtccaggggccacgctcttactgacgacgcacttgttggaccccaacggtctccatacaatccctcacagggaggcgggccaaatcgcgccccggcagcagacatccgatcgcaacacaagactacatgaggagcctggaacccccaactgacgcgctatgacgcactgtacacgacacaagactcgtgcacgaccccgcgcaggatcccgggacgatcccctcaatgactgcctcaaggtggcgtgggcgcactactacgctttgctaatcatctacgcaatcaaatatcgcagcgtctacactagactga

SEQ ID NO: 490605 - DNA, 213 bp, Homo sapiens
catatttaagtgtctgttcccttccacgcttcttttcatttagataaaaatacagtatttcgtattctagtttagtaaatgttcagtatttattcaacaaacagcgagtgttgtatttcatggcactgtgccatgtgcttgagttaaccacataagggcaggctcgttaacaccgtgcctgaagggggcttggcggatccttctagaagtcga

SEQ ID NO: 490606 - DNA, 250 bp, Homo sapiens
  misc_feature (227)..(227): n is a, c, g, or t
cagcgctatctggcactagctaagcactccatgattgtttaagattatcttattccggcaggctcggtggctcatgcctgtaatcccaccactttgggaggcgaaggcaggtggactacctgaggtcagggagtttgagaccagctctggccaatgacggtgaagaccccgatctctcctacaaaatacaaaaatgtagccacggtgtgtgtggcagtgcgcctgcnaatcctcagatacttgggagtct

SEQ ID NO: 490607 - DNA, 159 bp, Homo sapiens
agaaggcagacgcatcccgaacttgctggaggacaaggctcagctcttgccaggccaaattgagacatgtctgacacagcgagagtggtgcaggtctaactcgcttcacggctgagcttcagaaaggcagtagctcgtgatgcagactctgttgacagt

SEQ ID NO: 490608 - DNA, 353 bp, Homo sapiens
agatccccgaaatcagaggctaagcacatttgcattagccaggaaaaatcaggaacaaggtatatcttgcaaacacaagtaaaaatacaaaggtaagatggaatagcaaacagaactaatgaaacatattcttgaccatataccaagaaaaggttgtgcaggggaggggagaggcaaaaagtctcagaagcagacaaagttctgcaagtgctgcattcatgacatccagtcagcatggacttactgcacccctgggtcaggcagtgcgtcatgacagtgcacaggaagctgagtccctgcgcttggggagctgtccctctttggccaggttgccgcgcacacgggcctgcgtg

SEQ ID NO: 490609 - DNA, 134 bp, Homo sapiens
tgtccacgtggttatgatagacacccaccgcaactgtcggtctcatatcacgaacagcaaagcgacccaataggtggactacgtctgagaagctctcagcacaaacccgccggtggatcctctagtcgtcgacc

SEQ ID NO: 490610 - DNA, 118 bp, Homo sapiens
gagacagcggatataggaaatattaagtgtaggataagacagaaactaatatgtactagggagctggcaggacctaggctaggctgctaggggtaccggagctacgaatatcgtaata

SEQ ID NO: 490611 - DNA, 179 bp, Homo sapiens
  misc_feature (15)..(15): n is a, c, g, or t
tctagaggatcccgntgaagatcggcgattatggcctgctcagtgtggaccttcggcgtgtgcagtatgggttttcggcgtgtgcagtttggatcttcggcgtgtgcacacgccgagagaccaaactgagcagaccatagtcgccgatcttcacgagtgcaaaatcgccgatcttcacg

SEQ ID NO: 490612 - DNA, 888 bp, Homo sapiens
agcgggttcgcgccagcccgggacgcgcttggccttgcccgcgcccgctcgcctcgtctcgcccggcctccccggcgtcgcctcgtcgcctgttccgtgccaggcatgggccaccccaagcactgtgtgctcgtgtgaggcatgctcagctcccaaagagacaaaagccgacgctaaagtaccatactacgcccggtgcgctgtccccgcggtcatccggtcctcgaggggtccctgtcgcctgtagccgggccaagcctagactacactcactcttcccgcagctgcggaagccggctggtgagacgaagatgctccgctgatccgaatcaacagcgagcatctgagtcatgcttgaagcttgactgctaggagcaaggaggttccgccgcggcatccagcccaactccaagctggaagaagtgccgacatcctgcgagataggcaagtcagactacctgaacgcacaggcacaaggtgatgccgcgcaccagagggcacgagaagcggcaagcaaggtggcagggactgtacatgccagaagggcaatgtgcatgaggaagacaggaaggggaaccaaaagaaatccgtaaagtgacacacgaaagtgacttacacaagaagagcgcgaaggaaaagataaagggaatgtgacccaaacatgtgaaaacactgcacacacgaggcaagaataacaacaaaaggaggaaagtacaaagacaagaaaaaagaatgagagaagccaaggaaagaaacaaacacaagaacaagaaaacacaactagagaataaaaaaaacaccacacaagcacaaagacaatagaacacagagatacaagcaaagaagaagagataaagataagaaaaacgcaaaacagaacgacaaaac

SEQ ID NO: 490613 - DNA, 420 bp, Homo sapiens
agtcgagacggaagggtttcgcagtgagcttgtggcgtcgtttcagtgcttctgcaagggtttccaattgctcatccggatccatagattttgtgggatgctataaacttagggtcaggcatccatatcgtactgagtggccttggcaaatccctgtaagtacagtttaagtgcaccagtgataatgttgatatcttcataccatgttcacaagaaatatctgcctactcaccatctctgtcgaaagccatgttgacatcttcgaattaggtcactaaatcctgatcatcggtatagtccttcagcaattacagcacctctagcatcaatctccctgaagcacatgtctaaccaccataggccgcttcagtgatatgtgctttcacgagcgtcgtaaggtcacagctgatacactttttg

SEQ ID NO: 490614 - DNA, 879 bp, Homo sapiens
gccctctaagaggtttttcctttcccccgggcttcgcgttataaggccacagacaatggggttcctacacccaaaatggtgtaacactgtgtgggtatgggaaaggcgtccttcttatcgggggagtatctccccccctggggcattatcctaccggggccacatatggtcagtgcgcccaccacaaactggcgacttgtcaacggggcaggcacctttgtgtgcccgcgaccacattatttcccaccgggcagtctcatcaagagcgagtaattaaatatggatgcttcattcccccgtggtcccccatcgttattgaagaccagaaattattggcgcgcctcacgttggcgcccccgagccgatcttctgtcgcgcactacccggattgacagaccgccccccaccatctcgccgcgacacgggtgggaacaaaacccaacggggtcaccccctggacaagaccccgccacacgggcggcggcggaccacactgaaaccaacagtagcggttctgtggagtgcccccctcccatgaagagagccattcgccattttgtctggagaaaggcatattatcttcccctactgccaatataatcagtggatagttctcatcagggggccattatactatatgtgtggcgtcgtcgccccttggtgagcacccccggacccccacctccccgcgccccgcaaggggggccccagggtcgaaacagaatttcttctgagccgagaggttcaaaaaatcttttatctttgttcaggccatgcttctgggtccccccaccggcgccttggcgtagcggataggttgttagacggcagaaaaatcccagcaaaaaaagggtttaaaaaaaacagccccacaaaaca

SEQ ID NO: 490615 - DNA, 323 bp, Homo sapiens
tttgtttcttggcaatgaacgagcaaagagggttatttacaggaattcacatccatcacacaaagtaactcttggcttttaccaccactgctactctcactgatgcagtcatgacgctgtccaagatatctgaatatgttgcatagttagagcacccaacatgacacaactggaggcatggctaccagttagaccaataaatataatttattctagactatgctacctgaccctaggctatcacaagctggaaacataaacgatccacttatatattgtggatgaggacaacatggactattttagtatttttcctatgatgc

SEQ ID NO: 490616 - DNA, 258 bp, Homo sapiens
  misc_feature (130)..(130): n is a, c, g, or t
acttgataagggacctttatttgatcccaagttggataaaaccaattaaatttgtgttacagcaggagtaaatcttataggaaacggtgatttaatgttatatatgggaagtgaggcaactgttttcttngttaaagaagtttccagcttcacttttgggcagtaggaaaaaaaagtaggccaaagtctgggccatgttgagggacagtttctcgaaatatagttttaaaacactttgataataaaacccttaaactt

SEQ ID NO: 490617 - DNA, 243 bp, Homo sapiens
cttccctttagggactaactcctaatgcagataggccaggttctagaggagcaactattgtctaccatctccagacagtattattccaccaacatctgattctccttagactgtgacagactgtatccctctgcctctgttgctgcaactgagtcccgccttctaggcttcttctgaattgtccagaccctgctgactgttctgatccttctctgagcatcaactgacggtcgcgaatggcgc

SEQ ID NO: 490618 - DNA, 293 bp, Homo sapiens
tgtgggagaaagtctcctggtttcaagaagaggatttaaattggcttaaagcagggttgccctgaggcccaggaggagagagagctacagggttcacaaaccctgacagacccagtttcttcctacactgaaaggaaagggggttccaggtctccaggcctggcctgaggaggggtcaggtggtatggatggagaggtctggccaggcatggtgatgttcatgcctttaatcccagcacttagggaggcagagacaggagaatagctccagcccaggagtttgagaccagcct

SEQ ID NO: 490619 - DNA, 1211 bp, Homo sapiens
cccacgcgtccgaacaagctaaaagttaacaatggtgtacatgtatcgacaatctaacactcaagatagtttctaaaagcgaacatcagatagtctaaggtataccgtgatctctcaacaactactttaaaggcagtaaccgtacactggactggctaggactcgagttgatatcattgatatactgataggtagggtccacactcctacttgttacgtgaatacatccttgactattatatcccatacttagtgtagtacaagtggccttgacactcacaggcagcaagcaggcctttattgacttgcatttctgtcggagatatcaacatgctattctgcctagcttcgagtttcaacaatacatgtcgtggcaggcaaaaacgagtacgatattagactgtgtagtcaaggacgacactatttggtacatccctgatccacggtcatgcacggaccctttccttcgtagatgctttggcactacatttgtactatgacaccacatccttctggactccctttactattgtaacttaaggacagctactactgtagcacacatcgtcgattagtcttaaaagctcacgaagtctcggtcacaattattatccaaagagggtcgtcatggagatcgaataagcttgttggattatggcaatacttgaacatactgatagtgtggactcacggagataatcgcaatctggttataggctctatcgatggcgtctgctgaggaagaatgtggacggatatctggtttaggcggttaaggtcaagctaaaatctcacgaaaattgggaacaggatacagcactgggataacatacagcgatccaccggtacagacaaacaatacccagacttgtcctaagaagccactggaggcaggagtcagtagggggaaacaaacgagggatatgctaaaaaaggacgaacaaaacggtcatccgggaggtaaaatccaacagggaggtcacaaacatcaacaaggacagatgctacatggcgataccctgtggccataactggtagcaaagcccccgaaagcaggaaaaatcaaatcctattgagagcgatacaaaatgagcaacgggacacaaaaagttaacacgaaaagttaagccaaaaatacacaaaacacgtaacagccaaaaaaaaagcgaggagataaaacaaaaaacacaagtaaaaagcaatagtaaaaa

SEQ ID NO: 490620 - DNA, 262 bp, Homo sapiens
tcagccggtacctgccatagcgtagtacccaaaaaaaaaaaatttgaaaaaagatagttgagatgtgagagtttgttttagattaggctagaggggacagcaggagttcatgagcacacataggctctcttaacccatgttaaagagtttagactatatcctaagagaacagggaagccattgaagggcctcagtcaagagaaatcaatggctaacatcctctacatgttaaaataagcagattgggtactacgctttggca

SEQ ID NO: 490621 - DNA, 640 bp, Homo sapiens
taggtggccctcttactcaagtgtctgatgttagggaaacagtatatagttcgagtggctgcgtatcaagtatcacctgtgactaggttacagagtaagccatcactcacaaaaatggatcatggaccaagaaaaactcaatacttgcaggtccagtatcacacagatgtgactattgacggcttgcggtccagcaggggagtatgtggttagtgtctatgctcagaatccaagctgagagagtcagcctcatggtttcaggacatgcagtaagcattattcctgcagcaactgaacgtgaagttcacatcaggtcacacccacaagcttgagctcccaggggatcgcactcaatggtacagctcactggatatcgagtgcgtgtgagccccagggagaagaccgtgaccaagtgaaggaaatcaagcttgctcctgacagctcatccgtggttgtatcaggactcatggtgggcaccaaatatgaagtgattgtctatgctcttaaggacactttgacgagcagaccagctcagtgagttgtcaccactctggagaatgtcaggccaccaagaagggctcgtgtgacagatgctactgagagcagcatcaccattagctggagaaccaagattgaacga

SEQ ID NO: 490622 - DNA, 391 bp, Homo sapiens
  misc_feature (386)..(386): n is a, c, g, or t
ttttttttttcttcacacatcgaatacccaaattttggaaactagcaggaaaaaaacaatattcaaaactgcattataaacacaaggaatattgcaaaaatcaaacatatagcaatactgaagttatcatgctgtcagttgtacataccaaagcatgaacgtgcttccaattgctctgataaagatgagagagtaagaagtgggattatatggctgggcgcgtggcttgtcggtgtaatcccagcactttgggaggccaaggcaggtggatcacctgaggtcaggagttccagaccagcctgatcaacatggagaaaccccgttagccaggatggtcttgatctcctgaactcgtgatctgcgcacctcagcctcccaaagtgctngggat

SEQ ID NO: 490623 - DNA, 390 bp, Homo sapiens
cctgtaggcccagctactcgggaggcttaggtggcaaaaaaaaaaaaaaaagggaaaaccttccggcccggtttttttgagaaatttgggggaaaaacccctaaaaattttttgccaacttaaccaccggttaaaaaggttttttcttctggagaaggggggtttttccccggggggccggggaaattccaccttagccaaacaattcagggggacccttcttccccccaaaggggggggcaaaaccctttggacttttcaattggacccggaaaaacctttggaaaaggtcaaaaacccctgctggataaaaaaaaaacccttaaaaatttggggggaaaagggaccttccctcaccttataaaagcccttttttgacaaccccccggt

SEQ ID NO: 490624 - DNA, 541 bp, Homo sapiens
gatagttctccctgactgagacttgtctgatgatctggcccctggctcctgttctggtctccagtcatggtgtgtctgaccgctcccctgagaatggcgtcctgtcagtggacaggttctagaccatgccgacactgaatggtgcgtgagctcttccactggctttgcgtctggtggtacatcgcagattcaagtttcttggaagtactctacgtctgagatgtcatttcttcaatgggacggagcggatgcggttcctggatagatagttccataaccatggagagagaacgtagcgctatctatgagcgaccgctggaggggaatttccggggcggttgaacgggcacgtggcggcagtgtcctgattgtgcgaagttccatgggaagactggcaagaagggacgattcccttggaaatactgatgcggggccatggttggactcgcttactggtggaccgtaacgtaccgggggttgtggcagagcttcacagtgcaacgtggagttcatcctaatgtgactggtttccttcactaat

SEQ ID NO: 490625 - DNA, 764 bp, Homo sapiens
  misc_feature (1)..(1): n is a, c, g, or t
nccggttgcgtccgggcagcccatcgtttttctccgccggggtgtgccccgccgggcgtgtggttgcggggacgcccccctgctttctccccccccttgtgctgccgttgtgttttatgccgccggccgcccacgtacggttgttgttgtgtttatctgccgcgccgcccgctctatttagtggcgcgcgtttgttttgctctctcgccctccctcgcggtggtgcgtcgctgggcgggcgcgctcgcgcgggttctacttcgctgttgttgctagagtgagttagctcgcgcgccgcgccacgtagtattctcttggtatttgccgcgctcgctatcttttgtatgcgaggtgtttctctcgtctctcggctcgcgtgcgccctgcgcgcgaaatattctccccgcggaggatttcgctccccctcattctccgcgccgccgcgcctatattgttgtgacgccccccccctggggggtggatgagttacgcgccccccttgctggtgttgcgcctcgtctagctcacgtcgccaccacggtggtcgttcctcaccacagcgatgttctgctcgccccccgccattctgccggccccctcctttatactacctcatctcagtacgtcgcgtcgtggcttgttcataacactcttcccttataggagaccccgttgttcttgttatcgtgctaacccctccgtcgtcctccctcctccatcacacataaaaataataaaataaaaaacacgccgacaataacaaa

SEQ ID NO: 490626 - DNA, 221 bp, Homo sapiens
  misc_feature (33)..(33): n is a, c, g, or t
  misc_feature (187)..(187): n is a, c, g, or t
tgacaccatgcctggttaatttttttaattttnattttcagtagagacaaggttgcgctatgttgcccgggctggtatggaactcctgtgcttaagcggtcctcatgcctcggcttcccaaagtgctgaggttgcagctatgagccaccgcacccagcctacattccttcttatcaccgagaaacangttgatcttcacaggtgtaatgagtatgaaggga

SEQ ID NO: 490627 - DNA, 196 bp, Homo sapiens
  misc_feature (41)..(41): n is a, c, g, or t
  misc_feature (186)..(186): n is a, c, g, or t
gtctagaggatcctgaaatagcgagggcagtgggcgagggnggcaatgatctggcactttgagatgagagagaggaaagcaggatatatgacaagcaagtatagtcaccaaacagtagcccctgttcatatctcaattttcctaatttgaatggatcacctcctttctttctttagttgcgtcggntaattttccg

SEQ ID NO: 490628 - DNA, 365 bp, Homo sapiens
atctgggtccgacgctaatgtcaagggcacccagatctggcgcctacttcggggcctccctctgctccgtggactgtggacatgcaacggcagcacctgacctggtcctcatcgtgggccccccattactacgaagcagacccgaggtgggccaggtgtcctgtgtgcccgcttgcccagtggtgtgatgggctctggtgtgcatgtgttgatgcttgttactctatcgtggtgagcatggtgccaagcccttgtgggcctgcttatgggtgcatgcccataactagttgcttgggtggactgtaaagtggtggacaatgcttgacggacgttggccatttggttgccccgaggaagaggattga

SEQ ID NO: 490629 - DNA, 2474 bp, Homo sapiens
aatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaattttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaaaaaaaaaaa

SEQ ID NO: 490630 - DNA, 204 bp, Homo sapiens
  misc_feature (66)..(66): n is a, c, g, or t
  misc_feature (83)..(83): n is a, c, g, or t
taattctcttttttttccttctttcctctttttttcctctctctcctcttaatacacacttttttnagtagggggaataccangatgtcgctctagccgggccccggtagacgcgaccccggggccggcggttaaaaccacggtagaatcgagagcgggagcggtggtagtggagggaagcgtcgcgcaggggtaccgagctcg

SEQ ID NO: 490631 - DNA, 2420 bp, Homo sapiens
aatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaattttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattattgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaaaaaaaaaaa

SEQ ID NO: 490632 - DNA, 262 bp, Homo sapiens
ctagaggatccccgataccacctcgaaatagaccagctctcctcctgtcaggcaatcaccacttgtcgctggttcactgcacacttcacaattgttttctttccaggggtcttccactcattgactctcttgtctgctcgtatgtgccgaatgccatctggatagacctagagtcagtaacagaaagaaacctgactttaacaatttgattcatcactcagaatgaccctcacatctatcagatctgtcactggtggtatag

SEQ ID NO: 490633 - DNA, 1463 bp, Homo sapiens
tcgccagccttacgggcccaaacccttcgttgttaaagggtgcagtaccataacccggagccggggttaaaggcgggccgggcaccccctttcttagacctctccagtgtgcccgccggccttcaaaatctcaaacatgtggcccaaaactttgaagagactttgggggaacggcttgcccgccgggccccgggccatgtgggcacgcggcccttgaaccctgtgttgtgctgtgggggccctgcccccggtggcccttacgggtgtgtgcgccaaatctctgtggtgttctcacgcggtggaaacgggcggagcaccagaaaacgccatctcttctctctctacaattcgagagatctcgggtgtgaagaggtgtgcacagacagagagaacacctatatctcctgtggccccagagagggcgcctttctcatcttttcaggagatttcccctgttggagtcttctccacaagatataacccccccaaatatttatctctatatgtgaaccacatctcctcagagccgcacaagagaaacactctctgagaagatacattatctctctctctcttctccctctattaccgaagaggccttttcactaaacatcgatcaccccctatagccgacggagatcctggtgtcgctgccagcatctcatcttcttcttcctccccctgttggctcgcgaaccacgctgattgctgtcgtcggctccctctcctgaagagccccaccgtaatgagagtggcccccctccacaagaggatgccagcgactgttcctccccctaatgcagtcccccatggttgttcgttcaccccaccacacagtgcggcagccctccatcattaacgtcggccggccctggtggccggccactctctattaatgcaagccaatgagcgatcaacactcgcccgtacatccgtcgctgtatcctagctggccccccccgtgatcttcctcacccatgatggactggtcgcctccccactcttcgccgataatacgtcgatagctttgcactctctcaccatccaagctaagcaaacggccaggatgcgtcgctcgggcgaaacgagttgggacacggtcctacacgcaaacagaatcgctcttcttccttacccaaaccgatagcttgggtccccccctcttatcacaacacgtacccgacacggccgccatgttagggacacttctattcactaaaaaccacccaccccgaacaaggagtcgcaccagggggagagcaccccccccccaccctccagcggagtcacattcaatacctccccccccgcactggctaggatgatcttactctagacacactccctcctcccacgaagcactccacctggtcagtcgatccacaagctcctgcctatattttgtatcaccccccaccgactataccagtcacataacggggggcaggtcccccaccacaatg

SEQ ID NO: 490634 - DNA, 161 bp, Homo sapiens
cgcagctgatcatgtgtccccctcgactccttcatataaatccgccacaccacggaaatttggggatactccccagaggtccatccggccacgctcctccccccattcacctgatcccctgaaccaacccactgtctacctactccccacaacctcctatc

SEQ ID NO: 490635 - DNA, 540 bp, Homo sapiens
aatgactgtgtacccagcgcaagctcagatggtagaaatcggcgacctagtccacatcgctcatgtagcaggatgcaacccaaccccggcagcgtcttccttttgaagcctaagctaagcctttagacaccaggggggcttttacgtgctcaggaagtgttgcgcagaaaactttttctaccaccagccccctactaagacaaggagagcaaaaatcctaaaataattgtatgtcctgtaggacttcaacccttctcctttagctctagatagcctgctatatagcgagacacaaagctggatacagctagaaccaggtgcagtgtaggttaacctcggactcaggtggtcgaatgaactgaaccactgcttgaaattggacttatatactgatccgattatttttttccagacagataacttgcagaaacaaaaccacctgctgtttcctacgccttataaagctgactgaaaaagttgactcaaacaaaatttgcaggtttgttacaactccctggtcctcccaccacaaacgtggga

SEQ ID NO: 490636 - DNA, 326 bp, Homo sapiens
  misc_feature (1)..(1): n is a, c, g, or t
nggagcggtcgcgcatctcttagcacagtgggctaagcttctcatgcagctcgtacagcttctggcgcgtgacctcttgcagctatgcggtcaccgggttcacgttctgcaggtagagctgcatctcgtccttgtacttcgtctggatgtcgtccaggtaaggctgcacattggccttcgcctcctacagatccttgctcatctcgtgcgtcaggccctctgtctccgtattcaggttattgcaaaactagtgggtcacagggcctacctgttcactcagcttgctgcgcaaggtggagccttcacagtggcacacatagtctctg

SEQ ID NO: 490637 - DNA, 944 bp, Homo sapiens
ggtgcccgggctggtgcccaggctgttgccagagccagcactaaagtagaggcggtcccaggaggtcctggtcgggagccagagggcctccgccaggcaggaggccaggaggctgaggagctcctccaggaggggctcaagcccgtcctggaggaatgtgataactaggttggggctggggaggcagtccatgcgcgatgtcctccccgtggcaaactatggctccgacgggcccctggtggcctcctctcctcctctcatggcatgctatgggccctgtgaggacatgtgcggatggctggggcctatgggcctggtccctctaccccgactatcgtgtatcggggccccctcacttcgccctctcaaggggccctgccctgtctacgcttcttcctcggttggacccgaggatgtaccacatttaatatcctacaatgtgggtgcgggcggtgtgcgccccgtccattttgctccattctggtgccagcgtgcttgtcgagtcttccttggtggatgccctggtttgtgctcactggggtcctccctcgctaatccgttggagtccccattccttcttgcttttccccttgtctgctcgtgatcttgcgtctctgggtgcttggccttggtttttctttggtgtgcatgcccgtggtggtggtgcttcctgcttgcagtctggttttccttcctcccactcgggagctccctgctcgtctgttccccggggcggatgggccgcgccctggcaacgggcgcctcagtggtcctcagttggtcctcccttcctttccggtctgtcctctgcggtctgcggcgagccgtctcatctttgtggttgacgcaattgtcttcgtgggtccgcggggtttgttgtgtgggtggttgcctcgccggctccctgtgttgcgtattgtggtgccttgtgcgttccctggtcc

SEQ ID NO: 490638 - DNA, 87 bp, Homo sapiens
  misc_feature (48)..(48): n is a, c, g, or t
  misc_feature (60)..(60): n is a, c, g, or t
gaatgtaggagtaatgataagacggatcgtttgatgtttgatgcttgngtgagtgtcagngcagtattaggagagagttcctgaagt

SEQ ID NO: 490639 - DNA, 170 bp, Homo sapiens
ggtaacttagcaggatcttcccgatagcccgacagacgagatagtttaaccctcgtttcgggcgaaagtagttcacatttcccgagcacaagcatggagcatttgaggaaaatctcccgggccctgtgaagtacaacgtgttatcccccccactgtcgggctagtcgggg

SEQ ID NO: 490640 - DNA, 363 bp, Homo sapiens
tatctaaatgtatggatatgggctaaggcttgagcctggtgttgtcataggaggatcaggagctgagggtgtcaggagttgggtttaaattcgggtatgaggagggggtgggactcttgagcttccagtgtgagtactgtggctctgggggtatctgccgccctgggccgggcgagcccttgtcccgattatgtttggggacctccttcactctcaggatgtgatggtggtgggggagcccaccctgatgggcggggagttcggggacgaggacgagaggctcatcacccggctggagaacacccagtttgacgcagccaacggaattgacgacgaggacagctttaataactccctaaacga

SEQ ID NO: 490641 - DNA, 189 bp, Homo sapiens
  misc_feature (173)..(173): n is a, c, g, or t
cttgaggatacccggttatatacttttcatacataaacattacatttgttgtagaataatcttaaaccagacatttaaatctaggacttcaatttaatttgttccttgtaatctatttttatgtggcccttaagaaatatccaaatcaacccattgcataatatagcaagtanacaaatactttgggta

SEQ ID NO: 490642 - DNA, 184 bp, Homo sapiens
cctttcagcatcatgtgcactctttcctaaagccaacgtttctgttgccttctgttttgccacaccccgtagtacacggtggtctggttgtatacacatgctgccttcttggggcttcaaaaacaggtttatgcttttgactcgcacttcgtgctctagtgctgtttaagctactacgcggtaa

SEQ ID NO: 490643 - DNA, 777 bp, Homo sapiens
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggaaggtatgctgaaagggagtgaaaattcaacttaaaaggttgtggaataccaattctgactgatgcgcggtttccgaagtggcccgtgatgtaatcaatttgaagtccgagaagcgttacacccagagcacatgtgaggagaggcagaccatattttgcagcagcactgtgccaaggggctgttttcattaaagagggttaatgacattaagatgaggttctcacttaggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagaaccaacttcttcttaaaacaggaagaagacttgatcaaagataatctctagaacatagtctgggactatggcaaggactctctgataggagagaggataaattccttcgaatgtgggccgccagc

SEQ ID NO: 490644 - DNA, 381 bp, Homo sapiens
gtagcatgaggaagaagctcttaaaagttaaagcttactcagtggtaaaaaaaaaattgcagtttttgtatgggagctcggccaattcagttcaatgcagagcttgatcagtctcaatgccggttacttctgatatttggtttcaggttcactcagaaatgttatgcgtgtggattgaaaaatattgccaatttaaagcttaagaatgatggctggatatcacttaatctttgatgagcataagaagaagattgtttgagttatccctgccttaagatattagagtgaacttgaatatccttttgttgagtctagtcaatatatataaattatgtgatccaaattcaccaaaatctagtctttctatatacacaaaaatca

SEQ ID NO: 490645 - DNA, 850 bp, Homo sapiens
  misc_feature (676)..(676): n is a, c, g, or t
agaagttgatgtatatacatggtctgtattcttttagataaacataagggattcctcttttgtctggcataatggcttttcaatatttcaactttaaaaatcattgtttctgttgtattgaaaatattttggggaggaactacattttgggtgtttatagtaaaaaaatagtaattacatctgcaacatttgggtgatgtgaaactagatcttttttttatttgccacacactcctaaggttactaatgttgcatcacaacatttttgtctactgatacccatactaactctctttgttgcactattagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcgggacaagaaaacgggggatcaggtctcgcttcccgctcaagaantaacaaacagcgctggagcacacacggggttgcacacaggggggctgcgcacaaagagagatgtgtagcgaccagatattaaaaatagcggggcgacagccccctaggggagaccacacaggtgggggcgctcacgggggcgggacacacaccgacggcagagtggaccacacg

SEQ ID NO: 490646 - DNA, 1069 bp, Homo sapiens
  misc_feature (895)..(895): n is a, c, g, or t
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggccccagagcacatgtgaggagaggcagaccatattttgcagcagcactgtgccaaggggctgttttcattaaagagggttaatgacattaagatgaggttctcacttaggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcgggacaagaaaacgggggatcaggtctcgcttcccgctcaagaantaacaaacagcgctggagcacacacggggttgcacacaggggggctgcgcacaaagagagatgtgtagcgaccagatattaaaaatagcggggcgacagccccctaggggagaccacacaggtgggggcgctcacgggggcgggacacacaccgacggcagagtggaccacacg

SEQ ID NO: 490647 - DNA, 521 bp, Homo sapiens
acccccccccccccgccccccccccccgggcggaggggaggagcgaacgccgcaaaagaggcgcttggtgggcttcctgagaataaggactggaattaaaaagaatcacttatctcatcccacacaccatcctgaggcccagacagcctgctgaggaaacatcaggtcctctccttgatgtgagccattgaaaatgacaagatggaactggagaatacctgcagtttgattccccaacagaaaaatggggaagatggggtatttcacgttcaatttctccttccacatcgatgaataagaatagatcatccctcctctgatgagaggaatgagtaaacaggaagactgaggtcaaagaagattgtaatactaaaattctgtctatatgaaaacaaaaaattaggttagaaagaagtggtcacctgcaccgtaagaattgatagtggactatagaccttgagtttgagtggaaaaaccccatttctccaataaaaattgtctttgtgagttgactagcctca

SEQ ID NO: 490648 - DNA, 102 bp, Homo sapiens
tatacatcttgtaggatctactttttgaacttttcattcccttgtagttaacaaatcctgcaagatgtaactgaatacttttctaaacatcaagatacaggc

SEQ ID NO: 490649 - DNA, 657 bp, Homo sapiens
  misc_feature (628)..(628): n is a, c, g, or t
acccccccccccccgccccccccccccgggcggaggggaggagcgaacgccgcaaaagaggcgcttggtgggcttcctgagaataaggactggaattaaaaagaatcacttatctcatcccacacaccatcctgaggcccagacagcctgctgaggaaacatcaggtcctctccttgatgtgagccattgaaaatgacaagatggaactggagaatacctgcagtttgattccccaacagaaaaatggggaagatggggtatttcacgttcaatttctccttccacatcgatgaataagaatagatcatccctcctctgatgagaggaatgagtaaacaggaagactgaggtcaaagaagattgtaatactaaaattctgtctatatgaaaacaaaaaattaggttagaaagaagtggtcacctgcaccgtaagaattgatagtggactatagaccttgagtttgagtggaaaaaccccatttctccaataaaaattgtctttgtgagttgactagcctcatcaactggtgtgatttgctgtctagttaatgaggaaggaataaggccatttcatcataagacactcaaatgggtgtttccttcctcctcccttcattgtggaaactnagagaataaatcgctgttatgattggggg

SEQ ID NO: 490650 - DNA, 345 bp, Homo sapiens
accaaacatggcggttccactaggcggtatggtgtgtgggcagacacccgctccccctcaggccccgccggaccttacgcaccaagcttagcttgttcaggcagctgcaggcgctcctagacgtagcagtagtacttcgcaggacgagtcggagccatgtctggaggcttgctgagcatttctgatgagtcaggactatgtcaatggtaccgatcaagaagtctgaaccgagaggcattgcctctgtgtacacaatgttttgggcttcagcagtatatactcagtgctaattgtatactatcatgtgcttcagtgctgaatgtattctaggaccattagagtgct

SEQ ID NO: 490651 - DNA, 170 bp, Homo sapiens
  misc_feature (106)..(106): n is a, c, g, or t
gcctccgccgattcgtgaccaagaaggctctatgcattcaggctttccaggagactcaaaagctgaagaagcaaagaagagccttaaaggctgcagcagcagtccnaaaaacaagcagagcagaggaacccagacagccctgccaaagccatgccaaagacactcaaaga

SEQ ID NO: 490652 - DNA, 605 bp, Homo sapiens
  misc_feature (563)..(564): n is a, c, g, or t
acccccccccccccgccccccccccccgggcggaggggaggagcgaacgccgcaaaagaggcgcttggtgggcttcctgagaataaggactggaattaaaaagaatcacttatctcatcccacacaccatcctgaggcccagacagcctgctgaggaaacatcaggtcctctccttgatgtgagccattgaaaatgacaagatggaactggagaatacctgcagtttgattccccaacagaaaaatggggaagatggggtatttcacgttcaatttctccttccacatcgatgaataagaatagatcatccctcctctgatgagaggaatgagtaaacaggaagactgaggtcaaagaagattgtaatactaaaattctgtctatatgaaaacaaaaaattaggttagaaagaagtggtcacctgcaccgtaagaattgatagtggactatagaccttgagtttgagtggaaaaaccccatttctccaataaaaattgtctttgtgagttgactagcctcaccccacacctcaccatcaacaccctcaaggaagacagaaagnnaaattggcctctttggccctaacggggggagcctgggcgcc

SEQ ID NO: 490653 - DNA, 169 bp, Homo sapiens
gggttgaccgctgcgtgtgggttgaacgtggcttgcccggacccctggtcgagcgtggtggaccttgtagccgtggtttccctggcgcagattgtgttgctggtccctaggagtcccgctggtgaacgtggttctcctggccctgctgggcccaaaggatctcctggtg

SEQ ID NO: 490654 - DNA, 278 bp, Homo sapiens
  misc_feature (108)..(108): n is a, c, g, or t
  misc_feature (113)..(113): n is a, c, g, or t
  misc_feature (146)..(146): n is a, c, g, or t
  misc_feature (153)..(153): n is a, c, g, or t
  misc_feature (156)..(156): n is a, c, g, or t
  misc_feature (228)..(228): n is a, c, g, or t
  misc_feature (257)..(257): n is a, c, g, or t
taatataggcagggctaaccccttatccctttggaataaatggaataacctaggaaaaaccttgcaaggggggaggccaaagctaaagaccccccggaaccaggacgnggctncctaaggaccaggcttaaaggggcccacccggnctatggnagnaaaaataggggggaaggattatagggaggaggcggcaaaacctacccgagcctgggggatagctgggttggnccaagataggaatcttaggttcaactttnaaatttggccacaggaaccct

SEQ ID NO: 490655 - DNA, 363 bp, Homo sapiens
  misc_feature (326)..(326): n is a, c, g, or t
tactatccgcccgacgtgcaaaggctctttccaaactcgcttcacctccattacaagggcaagcgaggttccacgaccggacagggcgagctcaagaaagttcgcttcgatccgctcttcagcctgaatcacacctgcgcgatgttccgggcgaacgtgaatcggttgttccgcaaaacctggtgcacgaccaagcgatcagaccgcttgtacgcacacctgatgctttacgcccagtaccacaacgaagagttgcttaagccgtcggcctaactgcaacgagaaaccgacaaacctccgaaaagtttggcggttttcaatacacnatcaaatgggccagtttggtcctagcccagcagcgcc

SEQ ID NO: 490656 - DNA, 237 bp, Homo sapiens
cggcgtccgctacggatgcttatattgaaactagtaactactctcttttaaggtagcacagccagccaggcacagtagttcacacctgtaatcccagcacttggggaggccaaggtcggtggatcacctgaggtcaggagtttgagacgccagcctgaccattatggtgaaatcccatctctactaaaaatacaaaaattaggcctggtgcagtggctcacacctgtaatcccagca

SEQ ID NO: 490657 - DNA, 678 bp, Homo sapiens
tgtctcaattgagctggaagtcgccgtcgcctgttcgtaggaagtcaggcaagggtttctggcgggctgaattggtgggctttacgattcgggtggcggcatgatggacgggcgtgaggtgtgcccctctcgtgaacgtcctcggatgatgggcggcatttagcgccacccccgccggtcgccccagatgggcaggcctcctctggccagtggcccccagatgggatttaaataggccgcttgttcacctgaagccacccttttcaagataccgcgattaggtaattaggcgttgttggtatcttgtgacgctcttatatttgccctccgttacgtgctattgcgcgtcaatcatttagggccccacgcctcccactacccgctaatttcatagtttggcgaccttaaggcatagtaccaagtagctctccccctcagtgcatcctacccccggctctcctgcccgatgtagtggctccacgccccccccttaccgggtttttgcgcccaatagcggcctccttctgcgttggatattccccgataaccatggagcgtgtgatgccgcaccccttattgtggtcacctccacgaggacgccctcttgactatatggctttgagatcaacggctaattttttccccccctcccccagccccaaaaatctcccacaaaac

SEQ ID NO: 490658 - DNA, 135 bp, Homo sapiens
agcggtatcctgagaacagtccatctgtccccactgcaggtgtccacaaatgcagcagttccatgtggcagccccggggggctggctgtggagtggttgtggggcagccggtcgacctcgagaatgaagtcatcc

SEQ ID NO: 490659 - DNA, 207 bp, Homo sapiens
tacagtatcataatcttacgagaccatagtcttatacggggtcagtctctaaaacattgttattgggtgcatgactgtaccttttctatgcttagtgtatatttagatatacaaataccactgtgctcacaacggactacattattcaatatagtaacatggtgtacagggaaggcttgcgtagagggggctaccgcagcctctaag

SEQ ID NO: 490660 - DNA, 140 bp, Homo sapiens
tttcaggaatattttatctaggtacttcattgatttcatccagttatgtgccccttctctccatttgtgacgttctcttttccatcctccacactccttatttctgctgttcagcgagcctctcctggtattggagagtt

SEQ ID NO: 490661 - DNA, 661 bp, Homo sapiens
agccaatgtttggtggcaggcacctgtattcccacctactcgggaggctgaaacattgacaattcagtaaaacctgtggcccggggaaggtgtgccgttgacgccgtgagatctcctgtgacccttggttactccaggccgtgggctacagagttgacatttccattcttcgaaattaaattaagattaagaacattaaaattaaaatttagctttactttataaagtgagcatttgcttatattttttaaattctccagatttcctcgagcggcgagaaaaaaccgtgggagcagggaagctgtgggctcaagtgtgtacaattgagttctcaataaaagtttgaacattaggggtacggctttatgctggtataaacattgacttttctaggagctctcctcatttgggtgttggcattagattttatttaataaatttaaaggactacctaatgagctaggcttatatcttaaaggatactctatggttctcccttcacatccagaggtttaaagaagaactccatgtctcagaacgttataggaggtccaagatttaattggccatccattttcaccccctcccttaagtcgtcctcaccatatttgtgcctgggcttttgtcataactgttccttctgaaaaatatgctgatattc

SEQ ID NO: 490662 - DNA, 714 bp, Homo sapiens
gatgctttgttcaagggttggggtcgtccctcggtgtgggtcaacccctgtttggaagttttaagatggtggacccccccaggttctgtccgtgggtggatgccgcccgcttgtcagcccgatcctgggtttagaccccgccccgtgcgccacgtttgtacatgtaacgctgttttgtagggcgcccagaattatcaacccctctcctggactctcctgattaaggcatttttctgtgcctgttcatcttctcccttgtggcgtccccctgcccctcacattcacattttcttaaaacataataattcttggatttttccccgtgtgtcaagaagcaatcctcatacccctcacaaataaaacttttattcccaatgtttgtggtttaagaaccatagctcttcgagggcgggtcttacaagcccctaaaaaatgcatcatctccacaagggaacacttctatcaatgattatagcatcgaataaagcatgcgccacccgagagatctgtgttccccgtgtcaaattcctgtttatttcttgatagggtcccccatttatctatgtagggtttgttgcaccatccgggcacttggatcagaaattatactggaccaccaccttatgtttcagaaaccaagaagccagaaattttattttttcaaaagcgtggggatgctttaaaaaaaatgtcaatctcagtcgcgacaaaaca

SEQ ID NO: 490663 - DNA, 255 bp, Homo sapiens
cgacttatcgttgcacaaacgaacctttaatagcggactgcaccatcggcgatgtcctgatccaacatcgaggtcggtaaaccctattgttgatattgaccctacaataggattgcgctgttatccctagggtaacttgttccgtcggtcaatttattggatcaattgagtatattaattcgctttgactggtgaagtcttagcgtgtactgctcggaggtcgggttctgctccgaggtcgccccaaccgaaatt

SEQ ID NO: 490664 - DNA, 96 bp, Homo sapiens
cctgaggacactgccgtatattactgtgcgagggatcaggtgttatcctgtactagtagtacctgcctggagggtatggacgtctgggggcaaggg

SEQ ID NO: 490665 - DNA, 319 bp, Homo sapiens
aaaaaaaaaaaacccccctacccattctttgaagaaaggaaggggttaaataatttttttccccaccccttttttgaagggccggggctttttttatgaaaaagtagtaaatagttttttgtaccctgggtgaagccccccccccccttaaagggggccctttttgctaatggttagacccgggaaaactagtggaattgtttggggcgcctttaagttttttttaaccaaaattactagatgatagaattccagaccttgttccctgttttccttggggggtcgataatcctttaaaagtaaaggctttgtcctgcca

SEQ ID NO: 490666 - DNA, 188 bp, Homo sapiens
cgggtgactctacgaggatcccccaaggcagttgaatacagactcagattaacccacactaacaaaaatttaacaaagctacccctaagacaccgagaataaaacttgaccttttccagtcaaagggcagagagacggcctactccatgtcctggacgttgaagtgagttcaaagacttggcaattaa

SEQ ID NO: 490667 - DNA, 160 bp, Homo sapiens
ataaaagtcgtagctgaaggtggtggcatatacctgtgggtcccagctgcttgggaggctaaggtagaatcactaaggagaatcacttggggcagggaagtggtggctgcagtgagctatgattgtgctattgcactccagcctgggcaacattatggag

SEQ ID NO: 490668 - DNA, 900 bp, Homo sapiens
  misc_feature (10)..(10): n is a, c, g, or t
  misc_feature (107)..(107): n is a, c, g, or t
  misc_feature (131)..(131): n is a, c, g, or t
  misc_feature (142)..(142): n is a, c, g, or t
  misc_feature (146)..(146): n is a, c, g, or t
  misc_feature (171)..(171): n is a, c, g, or t
  misc_feature (184)..(184): n is a, c, g, or t
  misc_feature (186)..(186): n is a, c, g, or t
  misc_feature (200)..(200): n is a, c, g, or t
  misc_feature (212)..(212): n is a, c, g, or t
  misc_feature (224)..(225): n is a, c, g, or t
  misc_feature (244)..(244): n is a, c, g, or t
  misc_feature (254)..(254): n is a, c, g, or t
  misc_feature (258)..(258): n is a, c, g, or t
  misc_feature (267)..(267): n is a, c, g, or t
  misc_feature (271)..(271): n is a, c, g, or t
  misc_feature (285)..(285): n is a, c, g, or t
  misc_feature (307)..(307): n is a, c, g, or t
  misc_feature (310)..(310): n is a, c, g, or t
  misc_feature (319)..(319): n is a, c, g, or t
  misc_feature (323)..(324): n is a, c, g, or t
  misc_feature (336)..(336): n is a, c, g, or t
  misc_feature (348)..(348): n is a, c, g, or t
  misc_feature (353)..(353): n is a, c, g, or t
  misc_feature (379)..(379): n is a, c, g, or t
  misc_feature (389)..(389): n is a, c, g, or t
  misc_feature (395)..(395): n is a, c, g, or t
  misc_feature (407)..(407): n is a, c, g, or t
  misc_feature (421)..(421): n is a, c, g, or t
  misc_feature (442)..(442): n is a, c, g, or t
  misc_feature (448)..(448): n is a, c, g, or t
  misc_feature (457)..(457): n is a, c, g, or t
  misc_feature (460)..(460): n is a, c, g, or t
  misc_feature (481)..(481): n is a, c, g, or t
  misc_feature (543)..(543): n is a, c, g, or t
  misc_feature (555)..(555): n is a, c, g, or t
  misc_feature (565)..(565): n is a, c, g, or t
  misc_feature (567)..(567): n is a, c, g, or t
  misc_feature (620)..(620): n is a, c, g, or t
  misc_feature (636)..(636): n is a, c, g, or t
  misc_feature (670)..(670): n is a, c, g, or t
  misc_feature (683)..(683): n is a, c, g, or t
  misc_feature (693)..(693): n is a, c, g, or t
  misc_feature (757)..(757): n is a, c, g, or t
  misc_feature (768)..(768): n is a, c, g, or t
  misc_feature (770)..(770): n is a, c, g, or t
  misc_feature (786)..(786): n is a, c, g, or t
  misc_feature (790)..(790): n is a, c, g, or t
  misc_feature (792)..(792): n is a, c, g, or t
  misc_feature (809)..(809): n is a, c, g, or t
  misc_feature (835)..(835): n is a, c, g, or t
  misc_feature (838)..(838): n is a, c, g, or t
  misc_feature (895)..(895): n is a, c, g, or t
gtttacagcnaagatgtcatatacgaagagcagaaatagccaaatatttttggtcataatttagaaatgcaaactaatctataaaatggagcacacattctccccanttcatctctctcatagaagagcangagcacgggcnctcngttccttgatatcctcaaggggccncgggtacgtctgntnagagcctgtatganactatatcgagntcgaacttttgnntataatccttcaatgtccngaaggttctnttgnagtgattcnccanaagcgttgattgcntcagcctgaagctggtctaaancangttggctcnctanngccagcccactnctaaaatctagnttggnttctggggcgaaggaatcttgcggtnttctgctttnaaaccngggtctcgaggnaaattagggatctngagggtccgtgggcatgcaangtgacnagtagtacnccngatggcgccaaagggtaggtnggcaggtctctatgataaaaggacaaagggaaagcagttttgctcgtttgttgatcaccttnaccaagcgccgncttgctagancntatttctgagctgtggtgattttatgcaacgccagcaggcatcacagactganacaactcttttatctnatctggggggagctgctctacattttgtagcttnctgacactctgtngatgactgtnataatagctgaagaaatcattagcactctgtttcagcaggtagatgataatgcctaaaccaggnaggcgccagtntnggaccactggagcttnggtntnttgccgcggtccatctntattaactgtttctgaaaggctaggngtnaagagacacacagcatgctgggaggtagggggactctgttacatgagtaactggcanattca

SEQ ID NO: 490669 - DNA, 436 bp, Homo sapiens
accatggccatccccttactagcgggcgcagtgatttataggctaccgctcttagattaggaatgccctaacccacgttcttaccactatgcaccaggcacccgctagatagatctacctcgcgagtgcctacacggactctgtggagaacccgggcagtgcatttgcaccgactgctgggacgagaagctactgtgatagagatgtacggacctgctcatacgagcccctatgccaaaaaacgggacctgcgtagagcctggacgatggcctctataaatgctcatgtgcccccgggtactcgggaaaaggagtgccagaaaatggacgggcccctatgtgatcagggggtccccctgccagcacggaggcacctgaattgataactagggccgggcctcccatgcctcctgcctgtgccccccttgcttctcat

SEQ ID NO: 490670 - DNA, 939 bp, Homo sapiens
catctacagttcttttcaaatctctttgcaagcgacgtccacactacctgaaatggtgacctccagaagacaatatctgtaaaggacgtcgttggaagagatgaaagaatgtatgcccgcttgaaatacgtgaggactgaggtggtggacgatgtgacggcccaaaaaacctattgatgtcccatgtcattacacaccacatgcagctatatgccagttggtacggaggatcacatgcttgcttccacgcctgagttctaaccaagttattgcaacacccacaacaagggcttcatgaacagcactttggacctagcaatttgttcgccacacccattccaggtgtttggacagtcactgtcgtcaaacattggcttcattcagtatattggcgggtaagggaaggtgggaaagagataatctgtcttgataacctggtgtgggtctggatgggcaggggatatgaggatataaaaccctgaattggaattgttacagccatacatgattactcaggcacatattgtgactaagtggtattacacaaggcagaatgttgaagagaggaaacggtggatggggtattcattcagactggagtatggatcattatgttgtaacaaaccgccaaaggggtgcaggtactgacggagccgacagttatggatattagggaactatccagatcgagggaattacagggtgagacaggacattaatgcggactggacctctcaggtgacgacaaacataggaaatcacactgctacttgggacacaacgagacaaggttcgtggaaacgaccgtaggatatcaaaagctggatgaacacagtgaagagattgagtgactcagaccaccaaatgaggtggcatacagtaagtcagtaacgtgtaaagaggtccgtacacatgctctccccattctctttttcttgg

SEQ ID NO: 490671 - DNA, 178 bp, Homo sapiens
  misc_feature (17)..(17): n is a, c, g, or t
  misc_feature (43)..(44): n is a, c, g, or t
  misc_feature (48)..(49): n is a, c, g, or t
  misc_feature (61)..(61): n is a, c, g, or t
  misc_feature (68)..(68): n is a, c, g, or t
  misc_feature (70)..(70): n is a, c, g, or t
  misc_feature (87)..(87): n is a, c, g, or t
  misc_feature (110)..(110): n is a, c, g, or t
  misc_feature (119)..(119): n is a, c, g, or t
  misc_feature (121)..(121): n is a, c, g, or t
  misc_feature (174)..(174): n is a, c, g, or t
gtaaagaggagaaaaanacataagctgtgtttccccataagtnntttnnaaattgtatatngtatttntngtaatattccaaaagantgtaaataggaaatagaagagtnatgcttatntnaagtcctaacactacagtagaagaatggaagcagtgcaaataaattacatttntccc

SEQ ID NO: 490672 - DNA, 1022 bp, Homo sapiens
gacagcagtccgtgccgccgtcccgcccgcagcgccccagcgatggaagcagctgctgcatgccctgtggcccatgctgcaccctgcatgcaagctgccctgcatgctcgtcctgcgccatgttccatggctggctgatgctgcccccaggagttgggccaatggagggcccccgcggatgggctgacagaatggagcggctacttggacgaccgtgcactgaaagcgggccttggactccatgaaaagaccgacggagtacgagccatgaatggtcaaagtgagctgcaggagaatcccgggcttcgagcccggcaggagggttgcccgctgcgggatcgggaagcccctgggagaggcacgcgaggttcacctgaagcaacgggggactcggttccttgccaacttgggccaattcattcccatgaacagcacacaacgtgcatcttggacccatgggcaaacgctgattccaggcccagggttgaacacggggacgcaccctgcgcgttgcgctcaacgctttccaaggaaagaacaccttgcgagcccagcacttaccagttcagactttggctggttgagtcacacaagaccagcgccactacacacactttgcttgaagacgcaacttctgtgggacgcttggcgctaggtgaatccccttgacgcctccgtagaaccttgtcgaagggaacacttaccgcagcctaaacacttttgcccttgggtatccacaggggcagttgcccttgaggtccaactggagttggggaaacagttccttagcctcaaggtccatttggaggcgagtcccactggaaacgtttcgatatctcatagtacctttggaaagggtttaccagaggctaagagacactgggcacccagttgtgtctataaagcgtaatacaccgtctaagtcgcatgtgcatacatgtgggactatctgagggacagcatatttgagtcgacttgggtcgtcgaaggcttctacacatgccaaagaccctgtgtacttg

SEQ ID NO: 490673 - DNA, 429 bp, Homo sapiens
  misc_feature (42)..(42): n is a, c, g, or t
  misc_feature (127)..(127): n is a, c, g, or t
  misc_feature (166)..(166): n is a, c, g, or t
  misc_feature (192)..(192): n is a, c, g, or t
tgcgtattgaagagggaatacaacgcatcgcctatctgcctntccgcgtgaaggcacaatgacatcgatgcatccggttcgtcaacgatcgtacggcgaggttgctccccattaacggatctgcggntgtcactcaccgggcctcctagtatggatgtcggtctgngctgtacactattagtatgtcggccnccctcccgcacgctacttggtgcgggctgtctgacttccgccccgcctcgcccacgcttagatgacgcacaacatcgattcggagccctgtcgtcacttgtgtcacacgcatgagtggaagaccctcgctcctctttgtttaatatacgctcactcttcctcccccactcttgttgcctcctagttctccccccccccccctttatttcccgggtttcccccctaacaaacaaaaca

SEQ ID NO: 490674 - DNA, 525 bp, Homo sapiens
  misc_feature (4)..(4): n is a, c, g, or t
  misc_feature (18)..(18): n is a, c, g, or t
  misc_feature (36)..(36): n is a, c, g, or t
  misc_feature (50)..(50): n is a, c, g, or t
  misc_feature (65)..(65): n is a, c, g, or t
  misc_feature (90)..(90): n is a, c, g, or t
  misc_feature (122)..(122): n is a, c, g, or t
  misc_feature (129)..(129): n is a, c, g, or t
  misc_feature (168)..(168): n is a, c, g, or t
  misc_feature (445)..(445): n is a, c, g, or t
  misc_feature (489)..(489): n is a, c, g, or t
  misc_feature (495)..(495): n is a, c, g, or t
  misc_feature (501)..(501): n is a, c, g, or t
  misc_feature (503)..(503): n is a, c, g, or t
  misc_feature (507)..(507): n is a, c, g, or t
cccnaggggaccccaagnccctaagagcctaagtgnaggataaacttggncatggtcctacaagnggtttattacaggaacattaaaaancggtatacacaatacaaaaaaagggataacangacccangtcaccccagctttaacaggctacctagtcatgtgtcanttttggttttaccctatacttcccagccattccccacccccaatttcattattttttagcctttttggataaaatgtatattcattgcaaggtacaatgtgaactgtaaatagtagagacatggggtttcaccacgttgaccaggctactcttgaactactgtcctcaggtgatccacctgcttcggcttcccaaattgctgggattacagcataagccaatatactcagcctgagaattcatatttgtaacaaagtacaaatccatagggcacatnagaacgtacaatgtctatctacagtaaatacagtttgatgaatnaaatgnaaaggncnatgnccttgggaaaaaaaaaaa

SEQ ID NO: 490675 - DNA, 220 bp, Homo sapiens
ataagccagatgatcaagaagagagagtcttgtcaagaccatcagaaacatcaggcaactcatggtaggaattcagcatattcattagactgcaccatacccgtctcatgtcaggatcacttgtgtagaccactttaggcagaagcacaaatatcactaaaggaagaaccatcatcataaccattgggttcattagaaagtctgtccagccccacgattc

SEQ ID NO: 490676 - DNA, 411 bp, Homo sapiens
ttgaacactttccatttgtctatactaagaaaagtatttggctggagatagaaaaggatattaacgtgtcatgaacatatataaaatttggtagcacagtcttttttcccctacatttttagtttcagttcactgtttctgtagtttctaaatattttcacctactaatgaaaaccttatttaggtcaaacggtttgcttatggatttaaaagcattttggttgaattccttgctccagatgtagagcagacgtgtcgtacatctcattcaaaactgttaactttcgggtctccagcagtgtgatgaatcgactttggcagatcaacccatgcagatgttgaataatctacatgatttgggttgacttatttttaagaagccattccctattaactcatttggtagctatg

SEQ ID NO: 490677 - DNA, 303 bp, Homo sapiens
  misc_feature (47)..(47): n is a, c, g, or t
  misc_feature (134)..(134): n is a, c, g, or t
gaaagaaaggagagaagcagattccaggggaagaaaaggggagaaancggagaagagttaaggaggataaaaagaagcgagatcgagaccggtggagaatgaggcagaaaagatctccagtgtcacgccccttnagattagacttgcctcctagaagcctctcacaagctctttagccaacaagaagagtagacagacacccttcagagctttgatcactcatgagacattgcagagaaagatccagtgcttctttcattcctgtgactgatttattgctctgctctcatgatcattaacacc

SEQ ID NO: 490678 - DNA, 252 bp, Homo sapiens
  misc_feature (55)..(55): n is a, c, g, or t
ggtagtctgcttgggctagctagagttccccgtaacgagcgcggcatgggcgttnaacccggcgttcgttcatcccgcacgccagttctgcttaccaaaagtgtgccactaggcactcgcattccacgccggtcacgcaggagcgggtttttacccatttaaagtttgagaataggttgagatcgtttcggccccaagacctctaatcattcgctttacccggataaaactgcgtgtgcggctcgttacgga

SEQ ID NO: 490679 - DNA, 168 bp, Homo sapiens
attggccctttctccacttaggccggtggtccctaatggtgtagtttttccttttcctttttggggtccggcgctcgctttcgtcttctgggtcttggctggttcccacgggcttggcggtttccccggccgggccgcgccggccggccccggcgcccgcccctcccc

SEQ ID NO: 490680 - DNA, 466 bp, Homo sapiens
tctgacgagttccccccgatctgcgcgccgccgccgccagcagcttgggagtgtgctgcacacaggtacctgcacatgttgtctattgtcagtgctgtcaagtgtgtgccaggatgatccatggtcactttccgggatggcagcaaggtgactacggatgagtgactgacctgactgaaaaggtgcgtgagcagatatctcgggccttctacacgcatggagctcctctgtgcatcctatcccatccccatacatcctcttcacagggttctgcatcttacgcctgctgctacccactgctgaaactccccttgccaggaacaggagctgtgcgccttcaccaccccatatgaaggattactcgcccccacctgtggactctgaccgaaaacaaggcgagcctactgagcagcctgagtgggtgggtactcgtcatgtacctgaggccagcacagagcgtagggtg

SEQ ID NO: 490681 - DNA, 896 bp, Homo sapiens
tagatgttcgccgaccgttgactattctctacaaaccacaaagactggaacatatacctattatcggcgcatgagtgagtcctaggcacagtctaagcctccttattcgagccgagctggccagccaggcaaaccttctaggtaacgaccacatctacaagttatcgtcacagcccatgcattgggtaataatcttcttcatagtaatacccatcataatcggagacttgtgcaaactgactagttcccctaataaatcgggtgcccccgatatggcgtttccccgaataaaacaacataagcttctgactcttacctccctctctcctactcctgctcgaatctactatagtggaggccggagcacggaacagggttgaacagtctaccctcccttagacagggaaaatattcccaccctgagcctcgtagacctaaacattttctccttacactagcaggtgtctcctcatatctaaggggccatcaatttcatcacaacaattatcaatataaaaccctggaaataaacaaataacaaaggcccctctgcgtctgatcgtcctattcacagcagtctacttctccctacttcttcccagttcctaagtggtggcatcaccaatataattaaaagaccggaactcaaaacaacctttttcgaccccgccggaggaggagaccccattttaataccacacctaatcggggtttgggcaccctggaggtaatacttatccaacgaggtgggaaaatctccaaattggagtaataccggaaaagaaccttggacatatgttgtgcgggaagataaatgggccagggtctggggcaccaatatatgtgaataagaaagaattcggaaacagaccggagattgtgcccacaatgtcgcg

SEQ ID NO: 490682 - DNA, 230 bp, Homo sapiens
cagcatgttttcgtgtactactgtaatgcaaaatttattacatcatatagacataaatattaacatcataagtagaaggaagaatgatgagccttcgtgccccctcattccccctttttcgtcccccaaattgagatgtctgacggctaataggtctcccagggccacagggtaggcaggcacagccacagggcatccctagtaccatgactcgcgcaccaggcgtcagg

SEQ ID NO: 490683 - DNA, 304 bp, Homo sapiens
  misc_feature (105)..(105): n is a, c, g, or t
  misc_feature (219)..(219): n is a, c, g, or t
gtcccaccatcccagaacatcagtaaaactgaaagaaactcagtcagagcctgggatgatgtagatgatgatgagaatatcattcctttctctctatgtccatgngagaatttagcaagcttccagtcgtgaagcaaactgcaactcattccattatacttttcaagggctctcggtacactaagtgaccattcatttcccattaggtgcatgtagtcnagaaccacaagactggtaggtagtgtcgatggggcagggggatggccaccacctggatacttcttgtacaatgctgcaggggtac

SEQ ID NO: 490684 - DNA, 234 bp, Homo sapiens
aacacaagtctgcacgtgattaatcacttccaccaggcccacctttaacattccgactgacaattccacatgagtttggtagacgacacacgagcatgaattttacttaattttctgtccctggctccccaaatctcatgtcttctcacatgaaaatatatgatgccttccctaaatccccaaatcttatatcattaagcatttatcaaatgttgaaagcttaaagttcatctg

SEQ ID NO: 490685 - DNA, 169 bp, Homo sapiens
gtaaaccctccaaagggaaagggaaagtttttggggcccccttgggttttttttttggggggggggggttttaagtttttggtttttaaaaccgggcctttttaaggggaacacctggcccaaaatttgggcccaaatttttgggcccccttaaaaaggtttattggga

SEQ ID NO: 490686 - DNA, 751 bp, Homo sapiens
gatgcccaagaaagttcctagggtgagaacagccgatagtcgagcagacggtccgaggcacgtttcggcagaggtcgataggcggcgactgatgccaagaagcagagagtgagctggagcgatgccatactgtggatggacgacgacgaacacgtcattgaggaaggagcacgtgcatgggatggagatagggagaagcggcgcctcgaccagctggaacgtaaggaaggagacgcagcgcctactggtaggaggatggactcctagagcgtcaatgtcggcaaggtgccgcgggtggccacgtccacgcaagggtcatcctcgggcccagatcgacggacacgtctgcgcctgagaccatcagctcagggaggccccggacacatggcgagaaagtcatagagccagtctggaggtgccgctggaggagaacgtgaaccagcgcgtgctggaggagggcagcgtggaggcgcgcaccatcgaggacgccattgcagtgctcagcgtggcggaggaggcggccgagctggacccagaaagacgcatgcgggcagccttcacagcctttgaggaagcccagatgccgcgggtaaacaagagaaccccaacgatgcggtctgtcgcagctgaaacagctgctcaaagaaggagtgagtccgtctcctggaaacccatgaaccagcgggcgtgcccttcaatgcccccaagtgagcccagaacttggggagccaagttcacccacgggtggtca

SEQ ID NO: 490687 - DNA, 627 bp, Homo sapiens
ggggtgacttcgcgtatcaggcagggtaactggccgtggttatagaaactgtccattggagtgctccgctgcgagagggagtgggacccctgactcgagtaagtttgtgagagcactacgcgagtcagtcggtgggcagcagcaagatgcgaagcgagccgatacagatcccgggctctccgaacgcaatttcgccctgcttgagcgaggctgcggttgaccgatggccctctccagccaaggaaaagctacgcaaataagcctggatcactcatcgaaccagccctgaagccatgtgaaggctctctcgcctcgccctctagcgttcgtctggagtatgcagccagacccggcttccttggggacacaggggttggcaccaatggggcccaccagcgtcccgctggtcaatggccacctgcaggctcggtctctgactacgtcagactatgatatcatcgtccggcattacagctacacgggaaagctgaatatcagcgcggacaaggagaaactagcatttaaactgacctcggtggtgttcattctcatctggctgctttatcatcctggagaacatcttggtcttgctgaccatttggaaaaccaagaaattccatcgaacca

SEQ ID NO: 490688 - DNA, 312 bp, Homo sapiens
aggcctataatcccagcaccttggtaggccagggcaggaggctcgcttgagctcaagagtcaagagcaacctcagcaacactgagagacctgtctgtacaaaaaaattcaaaaattagccaggtgcagtggcatgtatctatggtcccacctactcgggaggctgaggcgggaggatggcctgagcccggggggtcaaggctgcagtaagccataattgttgccactgcactccagcctgtgtgcactgagaccctgcctcaaaaaataaaaattaaaataaagggatcagaggtatctgggaataggcagg

SEQ ID NO: 490689 - DNA, 616 bp, Homo sapiens
tgtgatactaactcgtacgttgattttacattgctttgatatcatcataatattgtcctactcttttctctagttgcctactatattaaggagaatctgctatcaacctttcctttgttcctccataaaacatgtcctttgtctctgacttgctttgaggctttcaattttaacactgatttagagcattctggtaatgactcatgtggcttagtgtagttttcttcatgcctcttgtgctcagggtttgatgagcttcttagatcagtaagttcccatcacatttggacattttttcatcatctcaaaatattgttttctgttcttttcccactttccttttacagactccaattccatgtgtgttagagactacttgaagttctcttaaagctcacaggggcttggagtctgtaaaaggaaagtgggacacgaaaagaaagacaatattccaaaagattaaaatgttcaagtattgtgagaggaaaggggagatacaaaatagaatgggttcagaataagtcaattatatttactaccttaggagagacactgacacaactgtttttatccaggtatattttatgccattagaacacatactgttatccattta

SEQ ID NO: 490690 - DNA, 327 bp, Homo sapiens
ggtgagaaaatagtgggcaatgatccataagaagataaacatctcaggccgggagcggtggctcacacctgtaatgtcagcactttgggaggccgaggtgggcagatgcttgagctcagaagttcaagatcaccctggctaacatggtgaaaccctgtctctactaaaaatacaaaaattagccaggtatggtggcaggtgcctgtaattccatctacttgagaggcttaggtaggagaagtgcttgaactggggaggcagaggttgtagtgagccaagattgtgccattgcactccagcctgggcaacagagtgagactccatctc

SEQ ID NO: 490691 - DNA, 252 bp, Homo sapiens
  misc_feature (207)..(207): n is a, c, g, or t
acatcctagctgagcgatcaactgctatcctcagtgagaatgtttaggttggcttagccaaatcctccttacccctaatgtttcctcttagtaattttccatccactgacccccacctgcctatgctgtattcagagctgagcccatctctctccccagtgcagaatctcactgcagtggtctggtccctacatctttcatccatcntctgagttaatgtctgtattaccgtgtctgatacgcgttccccag

SEQ ID NO: 490692 - DNA, 2523 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 490693 - DNA, 258 bp, Homo sapiens
cataagtgtatacattctctgtgtgtagcatttttaattcatgtggtttattgtgcctcgcatgacatttcgcaggcgggcgagacccgcgacaccggaggaggccggtttccgcaaggggctgggcaggcgtcagctgcagatgatcgcggtgggctccgcgatcggcacgggcctgttcctcggcaccggcgcccgcctggagatcgccggcccgtcggtcgcgctcatgtacctcgtgtgcggcagggtaccgag

SEQ ID NO: 490694 - DNA, 252 bp, Homo sapiens
  misc_feature (42)..(42): n is a, c, g, or t
  misc_feature (62)..(62): n is a, c, g, or t
  misc_feature (120)..(120): n is a, c, g, or t
gatatgtctatatggatgccatctcatacctttgactggttnatactataacatcactacantttatataacattcgcctattaacggtacatttaggttattttcagcatttttcactntaatcagtaagttgccaaatatctctgatacactttccatatttcttgagtagagtatttgtatttggcaactgttgactgtaaccataatatctttctttctacgtatcttcttgtcctatctaaagaaga

SEQ ID NO: 490695 - DNA, 121 bp, Homo sapiens
gtgtagctgtcatgtcttttggcataattgtcaacgtatggcctggatatgcacacaggttggtgtcttcaaaaaggccaaccagataggcctcatttgcctcctgcaaccgccccgatag

SEQ ID NO: 490696 - DNA, 345 bp, Homo sapiens
gtcgaccctaattggaagcgccaccctagcactatcaaccattaggtgcatgagtaggtggcctgcagtaatgttagcggttaggcgtacggccagggctaacattactgcaggcactactcatgcactaattggaagcgccacccctatgcaatatcaagccattagaccttcccgtctacgacttatcgatcttcacaattctaaggtctacgtgactatcctagaaatcgcttgcgccttaatccaagcctacgttttcacacttctagtaaggctctacctgcacggcaacacatagaaaaaaaaaaggtcggcgcggcctgggattttagtaggtagtag

SEQ ID NO: 490697 - DNA, 690 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 490698 - DNA, 928 bp, Homo sapiens
aaaaaaaaaaaaaaaaaacttttgggcccgcctgggcctttaaaatgggcccccgaaaaagttttttaaaacattcgttgggggggggggcccaggggtaggggaactggggctctttacggcgtgggtgttcctataagggagaatccgtggccaatcgattctagtgcttgggggtttctaaccaaattaaaaaacggccgggggggcaaccggacggggtccctggaacaattcaaagaagggagggttcgaagcgtcattcacggggcctcttatcaccaggagtccaaaggcagagctcggattatcaaattaacgccccggcccgggaaatcggactgcgcacatctacgccttccggcggccggaacagtgggagacgcccctcaacaacgggggatagggagtgacccaccgagaacttaggaccagaggggactatcaagcacaccctggcggccaccttgggggataacaaaacattcgaggcgccaagtgggcggaacccacgggggggacacaaaaaaatgtgggtccacctatgtgggagcacggggtaacacaccacgaccggggtgtgaacaccaaccacagcggagctgggcgtgacacagaaaaaaagtacttctcccagaaaagaccccttaaggggaaaaaacgcggccaagcgatcacccgggacaccagcgccaagctggccagatcatttggtgttagaaacaccgcgcggaacaaatcagcaggcgaccttaacacccacaaggcgagaaacaagggttcaggtcaggtccagtgaaaccgccggtcaaggggagacacttccaaatcagcggcacgtttaatgcaacaccagccggaagaaattcacgccgaccaatgtaaagccggcaaaaggacttactaacagggaaagcccaaccgagcg

SEQ ID NO: 490699 - DNA, 788 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 490700 - DNA, 564 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggatgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 490701 - DNA, 242 bp, Homo sapiens
gcagatactgattaagtcggggcatgttatatgagggggggtcatggtgcctcagaacagttagatggtgacatcaaaaatcactgattatgataatcatagcagatataataacaaaaaagtttgaaatattgtgaaaattaccaatgtaacacagagacatgaagtgagcacatggtgttgaaaaaatggtcccaacggacttccttgacacagagctggcacaaaccttcaacttgttc

SEQ ID NO: 490702 - DNA, 222 bp, Homo sapiens
attgggggccggtccgacacctaaggcaggacgactgtggccgcaaagaatacgagaaagtcggtggagtcaatcaactctaggctccaactcgttatgaaaagtgggacgtacgtcctggggtacaggccgactctgaagatgatcagacaaggcaaagcgaaattggtcattctcgctaacaattgcccagctttaaggaaatctgaaatagagtactat

SEQ ID NO: 490703 - DNA, 352 bp, Homo sapiens
  misc_feature (24)..(24): n is a, c, g, or t
  misc_feature (49)..(49): n is a, c, g, or t
  misc_feature (67)..(67): n is a, c, g, or t
gggatggtcacagaggaaagcccnagctctcagcatggccccacgtggntgaggagcccccaggctnctcccggctgtctcggacagagactgagaagcctgccgcgtcccgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 490704 - DNA, 121 bp, Homo sapiens
cgggtccagataaatgaggacgcgaaatgggaagagcgaggcagcgagctggccgagatgcttccgcatcttcgacacgaatgcaaactgctacatctgacctcggaggtagctggacttg

SEQ ID NO: 490705 - DNA, 368 bp, Homo sapiens
  misc_feature (162)..(162): n is a, c, g, or t
  misc_feature (180)..(182): n is a, c, g, or t
ccagccctactgcccaggtcctccggtgcctgcctgggagcctgtttgtgcacttgactctccggcctgctgccggaaaatcatccaggctgtggttcctgatcccatcacctggctttatctgagatacaagcacaatattcaccgagggctgtgccttcntgaggttgcctgatacannncacctgtacccacctgcacgacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 490706 - DNA, 576 bp, Homo sapiens
atcgagcgctgtaccttccagccaacgcctgcttcggccgactgcagcgccctctccttcgtcctgcatctacttccccaagcggctggcctagacgctagacaacaacgaatctcaacgactacggtgtgcgggaggtgccgccctgtttcagccgcctcattgtgctcagactcagtgtaaaccagatcactgccggtggggtagaggtgctaagctgaagagttgagcaaatacaatattgtgacctacatttgggttttatagaaccaaccagatcaccgatgtcgtagccaggtaggtcaccaaaatcctgtatgaatagcaaaggccgcacagcatcttaagaatgtgaaaaaacaaattaacacgtgaaggaggggaagtatcctcgcccgggcttgtgcagcacagcacatcaatctctgaggttggtcttgcgtccaagggctctccacggaaggaggaaggcagccttgagaaggggcctgcaggtaaagacgtctctagaaatactgtgggtgaccgaaaaggaattcgaggatgaggtggaagagagttaggcgttggatggaa

SEQ ID NO: 490707 - DNA, 776 bp, Homo sapiens
acccatctgattgaaaggccggggggagatttcacgctctgaccgtcccttcagtgtagacctgtggtgtcagtgaagaccctggaggaagaatagctccagggcctgctggagacccatagtggagagcccaagcaggccagcctgtcccctttgcaaatcctaccccacaggtggcctgggagggctttgctaaggagtggccagctctggcctggccttgtctgtcctcggcacccagaggtcactcctggcctgcagcctcctccgtagccaggggctgtgcacccttgggctccccttcaggcctgtgcttgttcccagatgtcaacgaatgcagccaggagaacgggggctgcctccagatctgccacaacaagccgggtagcttccactgttcctgccacagcggcttcgagctctcctctgatggcaggaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcacaccggtaggaatgcagtacccacatgtggacgtttctgggcagggcggctcttgtctttcctcttcagcctgggcctgtgcattgcacatggttggggaggcctcagaatcacggtgggaggcaaaggcacttcttacacgca

SEQ ID NO: 490708 - DNA, 431 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccagggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 490709 - DNA, 237 bp, Homo sapiens
acttgcggtcagagacacttgcatccagaggacacttgcatccagagacacttgcatccagaggacacttcgcatccagaggacacttggcatccagaggacacttggcatccagagacacttggcatccagaggcacttggcatccagaggacacttggcatccagaggacacttggcatccagagacacttcgcatccagaggacacttggcatccagaggggtaacgagctcga

SEQ ID NO: 490710 - DNA, 349 bp, Homo sapiens
cactcggacactgggacggtgcttcctagggggtagtcctgatcccgtttcgtgcacgactaggaggtggcgtgctgctagggctgcaataatgcacgggtaagatgacgtgcccggtcaagcatcgtgtgagggtgggactgtctactgagtagcctcctcagcattcattgacctaggtctgtaccaatgtatgggctggcggatagtaagtatgtacttcctgtggcccctcagcaatgatcatttggcctcacgggaggcacatagccaatgaaggctagtagctaatagtagtaagcaggaggataatgccgatgtaacaggaaacagaatagagaaatgatcc

SEQ ID NO: 490711 - DNA, 581 bp, Homo sapiens
  misc_feature (347)..(347): n is a, c, g, or t
gcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgcaggtaggtgctccctgtncgctcacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaac

SEQ ID NO: 490712 - DNA, 343 bp, Homo sapiens
  misc_feature (285)..(285): n is a, c, g, or t
  misc_feature (288)..(290): n is a, c, g, or t
ggccctgctccgacctcactagtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctngannnacgggtacgtgcgtcgcactccctggcaggggacgaagggggcccgcggtggg

SEQ ID NO: 490713 - DNA, 170 bp, Homo sapiens
agaggagggaagggatgcctgtagaagactgaggtcgtccataagatgttgtgaggcagcagataccactcacaggacagagaggcagaccctgaccgtgtggctaggaccacggaatctagggggctcctgagacctggaggcagacctcagatcgaggtaaacggctc

SEQ ID NO: 490714 - DNA, 309 bp, Homo sapiens
tgagacggagcttgctctgtcgcccaggctggagtgcagtggcagatgctcagctcactgcaagctccgcctcctgggttcacccgccattctcctgcttcagcctcccgagtagctgggactacaggcgcctgcaccacgcctggctaattttttttttatttttttttatttttagtagagacggggtttcatcgtgttagccaggatggtctcgatctcctgaccttgtgatccacctgcctcggcctcccaaagtgtacctttctatttatttctataattttgtactttagtcataaaagtcga

SEQ ID NO: 490715 - DNA, 126 bp, Homo sapiens
ctcatacagcaccttgttactgcagtatcacatcgccctcaggcaggtcattgtccgagatagcgaatgaaaaactgtttcgctgttcttctccaggcaacagggttttctcggcaaggaccttca

SEQ ID NO: 490716 - DNA, 1425 bp, Homo sapiens
  misc_feature (874)..(874): n is a, c, g, or t
gtcgatctctgtgtgtactgtgtgtgcgcccggtgcccgcctgccgcggaccagtggagagactaccataagcctggaccagcgatgagagactgcaggaccttgtacatggacactggcgcaaactggcgtactggtaataagtgtctcactcctcaggccaagcaacctgcgttctgggctcttggccgacactcacgacagttctatgcgtgcaagcgcgcggcgatcagaatcaatggcatgatagcatcttttattcgcacgacctagtggcgcgtacctagagatcccaaggcatccccaggtaatcccgtgacaacttgcatcggctgtgtgtgacatacatcacaaaaggaggcgcatgtgtgcatgcatctcgagatcacatcataacggacgggtgtcgtgaggtcctgaaaagacgtgggtgtgtccatggtacgcgaaggacgagactgcccttgtctgaaatcacctgactggaaaattgagttcactggcgtcccagataccttgtgaaacgtggacatcccggccttgccccgtggatataacccccgtgacctattttacacacacggattcggttgagttgcgccagactgtggtgttctcacctgtggtgtgcctcgaggcgtgtccgcctacgcgggtgtccccgactctttgatcgggggtacttgcgtagccttagcaccacgtaggttcggataattaatccttgtctggattccaaaagggcttccaagcgcttaacccccgtaatgtgcataacttcgtgccgttattagccaatggggcggaaacagaacccagaggaggaggaaacgccatatggttccagcaggaaaggaggggacctacctttggntaacattcgcgcggagtgcggccccgaagttggacgccccatttatcagaggcaccaaatgagcgaacttccctacatagagatcgccttcgccgaaccaaaaacacaccttattggtttgcgacccccaattataccttaacggcacctgatttacagacagttccaagacacgctttgggggagcccccacgcgaatgtttggaaccccacaggtgtcgctaccaccataacacatgggctgaagtgcaaacgccacaggtaatttggtgaacacgagttcttaaaccccaaagaaaaagcgcctggtgttggccggaagggcagcccatatacaggaggtttgggtgacaatttgccccaagtcccaattcccgctagcgcatttggcgaccaaccacaacggccgttttagtatactagtgaatgccgtagtgttgccacaaaggacgccttttttggcgccccaatgggacccacactgtcacaacccaaggacgactaatagctaggcgacacacattcaagatagtggccaaaaatggaaccct

SEQ ID NO: 490717 - DNA, 567 bp, Homo sapiens
  misc_feature (29)..(29): n is a, c, g, or t
  misc_feature (73)..(73): n is a, c, g, or t
  misc_feature (87)..(87): n is a, c, g, or t
  misc_feature (101)..(101): n is a, c, g, or t
  misc_feature (137)..(137): n is a, c, g, or t
  misc_feature (225)..(225): n is a, c, g, or t
  misc_feature (318)..(318): n is a, c, g, or t
  misc_feature (371)..(371): n is a, c, g, or t
  misc_feature (390)..(390): n is a, c, g, or t
  misc_feature (427)..(427): n is a, c, g, or t
  misc_feature (445)..(445): n is a, c, g, or t
  misc_feature (490)..(490): n is a, c, g, or t
  misc_feature (506)..(506): n is a, c, g, or t
actcagagagaacccaccatggtgactgntctcctgaccggacaagaccaacgttcaaggaccgtcctggggntaaggttcggcgcncacgctgggcgagntatggtgcggtaggccctgggagaggatgttcctgntccttccccaccaccaagtacctacttcccgcacttcgacctgagaccacggctctgcccaggttaagggccacggcaagaaggtggnccgacgcgctgaccaacgccgtggcccaacgtggacgacatgcccaacgcgctgtccgccctgagcgacctgcacgcgcacaagcttcgggtngacccggtcaacttcaagctcctaagccactgcctgctggtgaccctggccgnccaacttcccgccgagttnaaccctgcggtgcacggcttcctggacaagttctggntttttttagcaccgtgtnaacttcaaataccgttaagcttgagcttggtagccgtttcttctncccgttggcttccaangggccttctccttcttgaacggccttctggttttaataaatttagtgggggaaaaaaaaaa

SEQ ID NO: 490718 - DNA, 515 bp, Homo sapiens
cacgaggagggcagctgccctgactccaagggctgccatgaacaacttccaggccatcctgactcaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcatagagcacataggaccagatgaagtgatcggtgagagtatggagatgccagcagaagttgggcagaaaagtcagaaaagacccttcccagaggagcttccggcagacctgaagcactggaagccagctgagcccccactgtg

SEQ ID NO: 490719 - DNA, 749 bp, Homo sapiens
ggagtccggtggcccaatcgctgttactacttctctgaagtctcctctcggttgcttgccgagacacacctgactgccaagatgcctcgaattatgatcaaggggggcgtatggaggaataccgagggatgaaattctgaaagcagaggtaatgaaatatgggaaaaatcagtggtctaggtattgccgtcattgctgcatatgaaaatcagtcaaatgccagtggaaagaccagagtggtgatgaatgggtgtatccaagcgattaagaagacagaatggtccagagaataagaggaaaaactcttgcgagttggccaatgtagatgccgaattcagtggatgagatcatagctctgatcattgggaagaacagcggctgagtgcttagatcactatgaatttcttctggatagagctgccgatgagagacaatgatgaggaagacaagagatgatccatgaaaacttaaatctggggaattagatccatatgcgaggaaacaataatcagaggggtcttgatcgaggttgatattggatgaaggatgaacttgagatgcgattctgaagcccagagcctctgcttggttaactatctcagggagcaggaaggtcagcgaggaacgcaatgagagtaaattgtgtggaagaaaggcaatgagttctttggttgctcctgcaataacatggaagatgaactgtctgaagcaggtgggtattagactttcatacagaaatcgaaagaggc

SEQ ID NO: 490720 - DNA, 119 bp, Homo sapiens
gaagaatttaagaaactcaactgccaagtagattggtgcttctgtggattctcacttctgtcatctagcatggggcaatacacctaaggaaacaaggagggactgggacccatgaacat

SEQ ID NO: 490721 - DNA, 189 bp, Homo sapiens
ttctggtgggattcagtggttgagagggaagaaggggagggtggggggctccttcccttcacaacttgaagtttctcccactgcctcctttccagaggtctcccaggagccagacccaaaagcttttcctacagggataccctttatttttacttccccttgactcacatgctttaacatgattttacc

SEQ ID NO: 490722 - DNA, 208 bp, Homo sapiens
gcctgggactggaacgtgacgttggctgaactgatgaacccatcgctttccgtcgcggggttcaccccccgtcgcaaacgcccgtcgatctggctgctgctacctgtgctgttgctggttggcctgagcctgttgccgctcgcctacgtcgggctcaaagcctggcaggcgggctggacggaggcggtgcatctactgtggcggcctt

SEQ ID NO: 490723 - DNA, 207 bp, Homo sapiens
gtacagcggccaatacacctcccgcgtgtcgaaccgcgcgggcgccatcaacgccacctacaggtggattgatccagcggaccgttcccaagcccgtgctcacaggccgcaccccgtgaacacgcaggtgggtactgggaagaggctgttaccccagaccaaagctttatcctgggagcaacaggtagaagtatagtctggaccccc

SEQ ID NO: 490724 - DNA, 296 bp, Homo sapiens
gagccttcaactcatgacttttgaggaagaacaggcgggtcagggctctgtttatctcgagtcccaccaggagcccttgataaatttacaggtgggaaccaaacatgagcttatcaccttttagtcaattcaggagtggctcgctcctccatttgcttccccccatccaacattgcctgctcttcagaagaacttttagtctctggggtaaaaggagaaggatttaaagcaaaaatcttagaaagtacagaagttaaataccaagatcggctgactcatatccaatttttgttggt

SEQ ID NO: 490725 - DNA, 176 bp, Homo sapiens
attcatctccatttcagtttggttgccatttctctgcatggtccaatgcatgttgcagccaccttttccaccttttccatcatgtgtgtttgaccatttgtcatatcttcttttgcagcaaatgcatattcaaatctttcacccattgtttgatcagattgttagattcttttttt

SEQ ID NO: 490726 - DNA, 92 bp, Homo sapiens
ccggccgagggcagggctcgcggctgctgggctcgcgccgtatatccatataagaattcaacagagaaacggcaagaagacccttactactg

SEQ ID NO: 490727 - DNA, 434 bp, Homo sapiens
acctctggggtccacaccattctgcgtcaccctcccaaatagttgggattacagtgcacctgccaccacacccggctaattgtttggtatttctagtagagacggggcttcaccatgtaagccagcatggtctcgatctcctgacctcaggatccgccggcctcggcctcccaaggtgctgggataacaggtgtgagccaccggtgcccggccagatgtacgaatctttaatgaagacctcgtcgatcagaatgcaggaggaagtactaagctggggggggacaatacctcttgatttagagtaacttcggacggggatctaatatctccttcaactataatatagagaaaactaatagtagtggtgattctcgtcaccaatacaattcatatatatttccatatttaatattacggggtgggcaatacttcat

SEQ ID NO: 490728 - DNA, 807 bp, Homo sapiens
ccttgtaaaatggtgtcttggccgggcgcggtggctcgtgcctataatccaggcacttgggaggctgaggtgggtggatcatgaggttaggagattgagaccatcctggccaacatggtgaaaccccgtctctactgaaaataccaaaattagccgggcgtggtggcaggtgcctgtggtcccagctactcgggagaatgaggccggagaatcggttgaacctgggaggcggaggttgcaggggccgagatcgcgccactgcactccagcctggcaacagagcgagactacgtctcaaaaaaaaaaaaagaagaagaagacggggaaagaaaaatagttctctttaaatagcttctcaagggtttatggccaggaagttaatggttcaaagatatatcccatcttaattagagcctacagattatgaaacctggggtgagctaaaatttctgggtggaggaatggtaaaacacacccttgtgtggcaccttgtggaagtgaaaaacccggtatttagtaagtgtgactccgggtgtgtaccaggaagtttcagttcaacgcagcaaatagctatagggctgtactggcggaaggatgttaagtgggagatcataagattttatccttggaggcgggcctggtattgataatcctccagacacggggttggggttccagcgggagagttttaaaatatgagggtttgcctgacaatacgggggtgtttatggcgcgtcacttgggcccctgttttttccgggagtggggagtggcacttgcaacccgagttgaagatcgctaaacggg

SEQ ID NO: 490729 - DNA, 200 bp, Homo sapiens
cattcctttatcaaagaaaagtatctactacctttttggaataggagtaatagctgtcaccctctgccctttatttgaacaggagtgttggttctttttttgcctcatcagagaaggaatgtggactccccatccccccaccagggtaaaagtcctgacctttgttgtcttgacggaataaaagcttgcttttccttgta

SEQ ID NO: 490730 - DNA, 156 bp, Homo sapiens
  misc_feature (28)..(28): n is a, c, g, or t
  misc_feature (43)..(43): n is a, c, g, or t
  misc_feature (77)..(77): n is a, c, g, or t
  misc_feature (79)..(79): n is a, c, g, or t
tgacaatcgtgacaaccaaagccaatcnactgaaggattcagngacctgctccccaggaatggttagactctccgancncaaatcgacagttcataattccaggcccatcaaaacgggcaccaccttgcccgatgacatgatcacccagcgagagg

SEQ ID NO: 490731 - DNA, 854 bp, Homo sapiens
gcaagtgtgcacacgttgtggagaggagggtgtctggcctgagaagctaaagaagaggcatgtccagtatgcttgcaggttgtgttgctcttttccatgcccatgcaacccagatggggtggagcaggaaggagctcttttctgtgcccaagcctcagaactcttgagctgtggcttactttgcttggtcttcaccaggttcaagctccgtggccacactgttgctgtgccaggaaaggtgtacagcctccccaggatgggggcctcatacaacccttcatctgcaactcaacatttaatcgtgtcctgtgctgtctttcttatttgccttttgttgttagcaacaaaacctctatttagatttcaactaagtcacggagacaggtgtcaacaattaaccaccccagattatattggggtaaccagacacacaaagcttgcccgatttacgaaaagtgacaactgctaagagaggtagtaacacgcgtgcagtgggcgaaggaaaagtggcggcagagaacagacagctccaggggaagccgatcggataagacttgggaagacagaaacaatcggcagagaccacagtgatatgtacgatgcagtttgaaagggaagagcgtgatttaacatagcgctatatataggttgccagtgtggacgctaaaggaggataccaatgtcatcgaggttccggtccagtgggaaaagtaattagggaacggagagagagggtaggtattcacacacaatataaaaggggggcactccgaaatatgtcagtacaaaaaagactattatttgaggcactaattaggtattacataggaggtgagaatgatatttatacaagg

SEQ ID NO: 490732 - DNA, 207 bp, Homo sapiens
tatagaaaaggaaagaaagccagtattatctggaacaaaaactcattttaaataccatcattcaccaaattatgtccagaaagtggtcagaacttaagcaagaaaagtcaagaaagaatgcagaattgtggagcaattgctttaggaaatatttctacctagaacacttgtactcttagaattcacaacataaataatgatgacgct

SEQ ID NO: 490733 - DNA, 400 bp, Homo sapiens
cctcgcacaggtgtgatggtggggatgggccagagaaggacaggctactgtgggggggatgagggctcagagcaagcgagggatcctaactctcaaatacccatgaacacggatcatcacaatggatgacatgggaggaaaaagggaatttccttgggggggcaaaaccccaaactcctttctacaatgagctggtgtagcacctgaagagacccacctgctcacagaggctccctaaatccaaggccaaagggagaagatgaccagatcatgttgaaacttcatgtcctgcagtagtcgccatcaagcgtgtctccctctatgcctctggcgcacgacaggatcggcctggattcaggtgatggcgtcaaccacaatggtcccatctatgaaggctatg

SEQ ID NO: 490734 - DNA, 1111 bp, Homo sapiens
gctgtcgaggagtgcctgcataatagacttttccccgtgtgtggcaacaaactgacagacccaaaggccagtcattatgccaacatttgcgcagaggcgagtttccgagtgaccaacactggtgaggatggcttccaaggaactgcgcctgtcagatgccttccctcccaatggttatggcttatacaacatagtaggaggaactgcatgggaatggacttcagagctggtggactgttcatcattctgttcgaagaaacagcttaacccaaaaggtccccgcttctgtggaaatgacctgagtgaagaaaggtggatcctacatgtgccataggtcttatagttacaggtatcgctgtgctgctcggagccagaacacacctgatagctctagcttcgaatctgggattcctgctgtgcagccgaccgactgcccactatggactgacaaccaaggcaacgtctgtccccagtccaaggagcagtcgtgtctgacctaccatcgggcttagctcagaactttgaacgatcccatgcaatgaatcccaccctgaggtgggttaccatacctggccaatggccaaaggaaaccgcttggtggaggacccacattgttgactggcgtcagtgcatgtcgcttcatgagtgtggtgcatcttcggaaacccatcgcatttttaccttttgagatctttcactcacggacgtgacgtggcagcgaaccctgaagttacgctctcggattgacccgcggtctacacagggcatggcaagagggtataaacccaggcgccaactcatgacccttccgtggcttacagtcgcctccatactctctacaggtgtctcccactgacccctgcgtggtctccgcaacctctccgtatcacacaggcgttcgaaccttcggtggctccacgacgcgctatacacaatgtctacgtgatccccggtcgccacgttgccctccctatccatcaccagcccgtcattacatgcgacggtgtccctctcactctcccagcgcattttcaccgctattctttctctctctccgcgcttcacccccccaaaaagttatgttatcaaatctccatacgctcccgccgcc

SEQ ID NO: 490735 - DNA, 129 bp, Homo sapiens
attctacctgcacttctgggcccacggtgaaacaccacttctactaaaaattagccagatgtggtggcacgcaactgtagtcccagctacacgggaggctgatgtgggaggatcacctgaacccggagg

SEQ ID NO: 490736 - DNA, 905 bp, Homo sapiens
gatatcagagttgctttctaatcttgttacattgcttattctaggtctgtaatttattaactggctactgggaaattacttattttctggatctatctgtattttcatttaactactataattatcatactaccggctacatcaaatcagtcctttgattccatttggtgaccatctgtatgagaatatgatcatgtaaatgattatctcctttatagcctgtaaccagattaaggacatacacgctcttaacaacatcacgaacttcctgagtttcacatatacacatggtgacaaacacctgcttctgataaagtttatccaatactgtactctatagcaattctattgtcactactcacgacatcctattcctgtgcttccctccgttagacatagttttctaccttcttgtactaaccaggtacttccatctatattgagctaaacactgttcattgaccagtcacactctgcatccatgtgccctgcctgatttggattcggtttcacttatacaatatagttgcgaccatagccccatactatcacgacaagcatcacctgaactaactagtggatgtccacttacacactcaatgataagtgacaacccgttacactggcaccaccaacaacagtgacatcgggccacaccgaacgccgcagacaactacacgtgccacacgtgataccgagcgtagcacgacactcccgcctcgcccccaaactaactgagcgcagcagagaccgacgagaaagagacccctacagaactacctcagacacacgcacatcaagccaacatccatactactgagcgacacgcaccactgcgggacccacggccgcacaccaactgcccacagacacaagtcaacccccacgcgccaagacaaccaaag

SEQ ID NO: 490737 - DNA, 894 bp, Homo sapiens
gagctgttctcttctgtcaatcccacacgcctttggcacaatgaagtgggtaacctttattgtaccgcttctttttcgtctttagcgtcggcttattccaggggtgtgtttcgtcgagatgcacagaagagtgaggttgctcatcggtttagagatttgggagaagaaaatttcaataggccgtatggtgtgattgcctttgctcagtatcttcagcagtgtccatttgaagatcatgtagaattagggaatgaagtaactgaattgtgcaaagacatgtgttgctgagtgagtcagctgaaaattgtgactaaatgcacttgcataccctgtgtttggagacaaattatgcactagttgcaactcttcgtgaaaccgtatggtgaggaatggcgtgactgctgtgcaaaacaagaacctgagagaaatgaatgcttcttgcaacgcaaagatgacagcccaaggctcccccgattggtgagaccagaggttgatgtgatgtgcactgcttttcatgacaatgaggagacatttttgaaaaaatagttatatgaaattgccagaagacatccttacttttatgccgcggaacctcctatttctttgctaacaaggtctacagctgctttgaccagaacgttgccaagcctgctgataaagctgctgcctgttgacaaagctcgagtgactccgggatgaacgggcaggcttcgcctgcatacagagactcagtgtggccagtctccaagaattgggacaaagagcttccaaagcatggggcagaactcgcctggaccagaaatttcgcaaagcctgagtctgccgcaagttcccagttagggaagggtttaccagggccaccggaatgctgcctggccactgctgacgtctgag

SEQ ID NO: 490738 - DNA, 183 bp, Homo sapiens
agaggcaggacatttacatagagtctgctgaagtcttgcaaataaattcccggatggtatgtttaattattcatccgatgaattgaatgcaatactgggtgaattgatggaagtatcagatgatctgactgcactgtcctacagatatattcttgattctgcaaatattatagtgagcctact

SEQ ID NO: 490739 - DNA, 236 bp, Homo sapiens
  misc_feature (38)..(38): n is a, c, g, or t
gcccaaatccccaagggggtcacccccaagcttgtttnatttgccttctttgcccccccccagcttgggaagggggtttgtgcccgtttttcccagggggtcaggttggtccggccaaaggccaaggccaaggcccaggccaaggttcaaaccaaggcccagggtgcagcccccggtttagttccaggtcagggtccccaagggacccgggcccccacaaagggtttaaagtaaat

SEQ ID NO: 490740 - DNA, 306 bp, Homo sapiens
cagcagagtattgctatttaagaataagaggccgggaacgtggctcacgcccgtaatgcatttctttgggaggccgaggcgggcagatcacaaggtcaagagatcacagcctggctaacatggtgaaatcccatctctactaaaaaatacaaaaaattaaccgggcatggtggcgggcacctgtaatcccagctacttgggaggctgaggcagcagagccgcttagacccaggatgcagagactgcaatgagctgagatcgtgccattgcactccagcttgggcaacaagagtgaaacttcatctc

SEQ ID NO: 490741 - DNA, 126 bp, Homo sapiens
cggccacacgcagtcatcgtatgcgtggagtggcctaaaaagacaaaaataaaataaaaaaacccgaaatcacaacagcaaaaaaacagacatagcatgtaggaaacaaaactcactatgtgaggc

SEQ ID NO: 490742 - DNA, 156 bp, Homo sapiens
gacttccaacatcagaaaccattgatttagttgtgtgagagacctaatctcggccgggagcagtggctcatgcctgtaatcccagcactttgggaggccaaggcaggtggatcacgaggtcaagagatcgagaccattctggccaacatggtgaaa

SEQ ID NO: 490743 - DNA, 1061 bp, Homo sapiens
  misc_feature (14)..(14): n is a, c, g, or t
  misc_feature (25)..(25): n is a, c, g, or t
  misc_feature (30)..(30): n is a, c, g, or t
gtagattagcacantgcacaatttnctttngttaaaaattaaattggccacctaactcactcttgagaggccagaagtgatgctggaactttcttcctctgtgggtgaaaaagggaaaattagggagaacagaaggcatgagagatgcagcgatggatatgtctatatggagcttctgtctgcatccagtagaaaatgcatctgtaggcaccaggtttaagagcaaaatcctggagtcttgtctgttagcattctccttccccacaaaccagagaaggaatatatttgctccagcacacccggatgtaggaaatgtcacattcctatttctgtaacttcacttaaatctgctctgagtctctggatgcctggcaggtggagaattcaatcttgtcgttaccagtattcctttcccttctccatgggcttatgtaagaattctgggcttacacactgttggaaagccaggtaggaactacatcccccgaactctccattcttccagctgctcatgatccatcaaccttctttgggccacctgctatagcaagaccctcctcacagcatcattccactgacccacaggctcagccccagggaccctcactagaacaggtctccactatgcataggaactcacaaaaaccttctcttcatcttggcttctgctgatatccagccactcccccacttctcatcttaaacacagatggcagctccttcccatcgttccaaaacagggggattgtccagccaaattctctgcagacaccaaagcttcacccgtcctcttcagggaggtgatgcaagggcatctgatttctttggaagcccaattctggcctctctttggggtgggctgagagtgggaaccagactctcttttccaaatgtcatgtttatcttgttcatcattatattatctccaatgcctggcacatagtaggcactacagactgacacatagtaggtgctattagtgtctgtataatgggactcttgaggttgaagctattagcagaaacctgccaagcaaaaggatggaaaaccaaccaccaaaa

SEQ ID NO: 490744 - DNA, 346 bp, Homo sapiens
tgggtaccgcgggagggtactgtcggggatgaactgccgtgtggggcgacacatatgtgaattcagtacatttggagacagtattctaccattcagtaatttgggttactgcttttaacacttctcagtgtatttactttcaaactggtttttgtaccttgggttttactgctgcttagttaggaaccagactgtgtcgtggacagtgtaccccttactacacgacacgaacttctactgtatcttaaacctactgactctttctacaacattctactttcccgtaaggtacctatctggggtccttgaagtactttttctaccacacggctcaaccgtggtagag

SEQ ID NO: 490745 - DNA, 237 bp, Homo sapiens
tctcgatctaagctatcggtcattactgagcttctgacctcagacactggagccacctgcctgaagctcagtcccttcttgaggacgcgcacacctgttccaggacgtgacacaggctctgtccttggtcgtctgctgccaaggagatcttaagctttgtcgaggtaggttgtgctccctgctccaggggttccctggagcctccacgagggtcaggtgaaccccttgttagaacta

SEQ ID NO: 490746 - DNA, 284 bp, Homo sapiens
tggcggtgcctctacagaggcaactggccttcctcatgcaagaaagcagaaatgatgaatatgagaatctgttaatatgatgtagaacatacctcggtggacaaatgctaaaatggagattgccagcaaggagccaatgaatccccttacacaatatgtaacggatggaacgctacgctatgtggcgaatatcttcccgttacaagggttatatcatggaataatggtaccctccctccagactgggcaagcatccccatgcaaaagcataagagcacgacacg

SEQ ID NO: 490747 - DNA, 1131 bp, Homo sapiens
gtgagcctgcgggaagtcgtgcgctacctcgtgggtgcagcttggctgtgcgccggcggtcgcctaacccgcggccgcgtgcagggtgctgctggaggaggaggctggctggctcgaggcctgtctgtgagcgcaccctgtctcggagctgcttgcgctgccccgctggggacatggccctggacgggcgccgtcggcctgccatgctgcccgccctgtctcgcagcaagagagcgtggagacagagcgagttacttgagaaagaagaggaacgaagatgcatgatgaacgatgaagactgaagaagatgatgtgtcagagggctctgaagttgccctgagagttgaccgtcctgcaggtgcccagcagcaccatgcttaactggcgagcggggacctcagagtgccaaggagagggtcaaggagtggaccccctgcggaccgcaccagggccaggatgaagggcgggggccagccccgggcaccggcacccgccaggtgtctccatggcagccatgaacaaggaaggcggaacagcttctgtagccaccgggccagactccccgtccccgtgctttgcccccaggcaaaccagccctacctgtggccgacgggaccccttttggctgtcctcccgggcgccacgcagaagccatcttgatcccgtccgagttgacccgtgatggcatgtcgctcaaactatattactgacggctgaaattaccggcacagtgcgacagctatccaggagcagtgaacaatgatgggcaaatctttgctgctcattgcagtgcaacagaatttgctcacaaggcctgtcaaatcgccttgaggcaaagccataaaactataacatgtaccatattcaagactgatataacctacatgcccaccttttgacggaaatcagtgaaccacggaagggacctactataacgcattaaagccccaagtacactatacacccgtcttccacgctaacttacatgacccaacttcaagccaaagactacctcagtatacacaccacattcatccagctaacaccacaaacgcacaccaacatccacatagaaacgcacctctccgaaactatccgccacgcaatcaacacaaacacatcacacacacg

SEQ ID NO: 490748 - DNA, 489 bp, Homo sapiens
gcgttgcgtgggttgggagtaggaagatagagtcaggagagatttgggaagtcaggttgataaaatggcacaaaggagagtaaccagtaaggtgtagagtgctctgtgggaaggacagccctcttgggatgggctttcttcctgcataggagctggtgaccagagccaaggcctaaactcctggtggcagggactgtaaatgtgtgaggggaataggtaccctaacccattcctcacttccaccccctcttcggggcatccgcagctgtagctgggccactgcccagaaaaaagagattattttacactacctagcaaaattcccagcctttttcctgcattgtgtttggtgaatctaaagattccctgatccctccatgtgcaggtcagtgtttttttataacctctcctccctttaaaaaaaaaaaggttcgatggtctttgcatgttgaaaaatatcttttttggaattcagagaagtattttgga

SEQ ID NO: 490749 - DNA, 119 bp, Homo sapiens
ctctagacgatcctttgctgtggacggagctgacagaccagaggcgattaatgaggctagtgtcttgcgcaaggcattcacggggcagacgtttgcagaagagccggatccacagtagt

SEQ ID NO: 490750 - DNA, 1026 bp, Homo sapiens
cctaataaaatttattaaccactcgttcatcgacctccctcatccccgatgccaatcatgctccgcttgatgcaagcttcggctcactccttggcgcctgcctgatcgtccatatcagcacaggtgactatttctagccatgccatctactcacacagcacgcctcgatgcgcactcttctccattacaagtcgcccatcactcaacctcgaagtgacgtaatattgatgggctgcaattcatccgtcttacctttctacggccatatggcgacctccacaatattctttgtcatcatgccatctgtccgtgacgacaatctcgatcgaggtctttatatttaacggaatcatttactctaacatctgagaaaatcctgtaacaccactctggacaattattccatccttgtctttgtcatacttattagtcaagagtccttatctatagggcatatgtccttccctgtgatgggccaatttgtcatttcctgaagggtggccctcagataatataccaagatcattacatatttccgccaagtcccatacatttgtcgaacagcgacccttatttcaaactcgaagtccttgatgcgagggcttagcttcaagtatatgtaccccgatctcccaccctcgtctactcctgaggttcctcttaccgttttcatcttgccatcattggctgcttcaattaattgcaagcccgtagcagcactccacacgtcctattctttgcgacgaaacgggatcaaactaacccccgctatgaatcaccctcccaggtcccgataaaatcaccattccacccttactacgccaattcacaagacgcccgtcggcttaccttctctgtcaattctctcccttaatgagcagtttttcgcgtattctccacccatgacctcctattggcgagcccgacatttattacccttagctaaaccctttataaacccttccccagattaatgccgaatgatatttcttattgggctcaacaatctcctatacttcctaaaaa

SEQ ID NO: 490751 - DNA, 443 bp, Homo sapiens
  misc_feature (113)..(113): n is a, c, g, or t
  misc_feature (119)..(119): n is a, c, g, or t
  misc_feature (149)..(149): n is a, c, g, or t
  misc_feature (156)..(156): n is a, c, g, or t
  misc_feature (158)..(158): n is a, c, g, or t
  misc_feature (161)..(161): n is a, c, g, or t
  misc_feature (167)..(167): n is a, c, g, or t
  misc_feature (171)..(171): n is a, c, g, or t
  misc_feature (174)..(175): n is a, c, g, or t
  misc_feature (181)..(182): n is a, c, g, or t
  misc_feature (194)..(194): n is a, c, g, or t
  misc_feature (208)..(208): n is a, c, g, or t
  misc_feature (210)..(211): n is a, c, g, or t
  misc_feature (213)..(213): n is a, c, g, or t
  misc_feature (275)..(275): n is a, c, g, or t
  misc_feature (395)..(395): n is a, c, g, or t
  misc_feature (397)..(397): n is a, c, g, or t
  misc_feature (400)..(400): n is a, c, g, or t
  misc_feature (402)..(402): n is a, c, g, or t
  misc_feature (423)..(423): n is a, c, g, or t
  misc_feature (432)..(432): n is a, c, g, or t
  misc_feature (434)..(434): n is a, c, g, or t
  misc_feature (436)..(436): n is a, c, g, or t
aagacagagcgggaaggggcgtgtcccattttgtgaggtccacaaggcttttgttaaatgccgcttcccttcaagagggtaaagagtttaatcccctctcaaccgcatctctnaagggntccatgtgaaggctcccattttcagttccntcctgcncnganctgcantgtnttnnagcccnnaggtggtggcangggccctccctccnanngntttggaagccacgcatatgccctgcccttcctaagggcccttggggattttgccccctttgnccttccccaaaggatggtcacaccccagccctttatacacttttggctcacaggaaagtgtttgcagtaggggacccaaagtcccaggcccctggagttgttttcggcaggggccttgtntntcncngcatttggtcaggggggcatnaataaaggntncnggctcca

SEQ ID NO: 490752 - DNA, 918 bp, Homo sapiens
gctctttcccatcttgcaagatggcgggtgcaacaacagttgagcaagccgagcatactcaacagcagcaagcaaacccgcaagcccaagcaaggttgcatgctcggtggcacaggtgcaaaacagggtcaacctcaacagctcaaaacagccccaagaaggggcacagccgccattgcagcctgcaacccgtgtaccttgtccagaggcaaattggccaggtcattcgccgcacccgcatgtcattcgcagcaaaggcgccatgtacaaagcaggacagtactacagaccgactaacatcacaagcgttgcaaaagcacacaagcaacggcagcaaggtctctcgacacacttgtttacgaaaaccaagttgggtggatgacaaagccagcggcgagtaccacggcgtggattacaacttcagcacaaatgccgtagcatcattatcgctacctgcacagactgtgccatcgacaagcatgttgcagaccacaggcaaaacaacccttcagatcacgcacgatgagcaaacactgcgagcccagacattagccaccgggaaccattctgcatacatcactcacatggacggccacaagggggccacgaggcgtggactatacctgacagcacgctggcatagtgggcattctacactagtagactgggacactctggtccctcacatcgacagtacctactacgacagcaaccacaacacagacagttaggtccagtcgcccacttgcaacccaaagaagtcacagtcatcacgccacggacaccacaatcccgacacacaatcttacatgaaaggcaacataccacgcaagacagaagactgcgggaagcccccagacaacgacaggaccgggggcacacacgtacagaacaaaaacagaaacaagatgacgcacg

SEQ ID NO: 490753 - DNA, 441 bp, Homo sapiens
cgtatacattttcgatgtgggcataaatcaagtaaaggtctaatttttacaaactaataaccagtattttttctaacacagattatgaagcaattgtgaagctttcggctggttttaatggagcagatctgaggaatgtttgtactagacgcaggtatgttcgcaattcgtgctgatcatgattttgtagtacaggaagcactatcatgacacagcagtcagcacaacgtggctgattctacgcaagctggagtctaaattggactacaaacctgtgtaatttcactgtacgatttttgcatggctgcatgacagatgttggcttcattgtaaacaatccaagttaacagaaaataatgtatgtattggcaatgcatgtcattaaaacagtcatatgaataaaaatcatgcagtaacatccataaaaaattagtaattcca

SEQ ID NO: 490754 - DNA, 126 bp, Homo sapiens
tgctgtgtccacacctactctggtgtctgtcgagccccatgcccacacccactcttggtgagtgctcttctcaatgctggtccacatgggtgatctctagacgtctgacctgcatggcagtgcaat

SEQ ID NO: 490755 - DNA, 353 bp, Homo sapiens
aatgtggctccaactccgtccttgccctttgtccatggcattctccagagaggggcaagggtttctttattcctaccccatccacccattcattgcaaccctctccctgatctctctctctctctctctctcacatacacacacacacacacacacacacacacactctctggtgtgcctagctcagctcccacccctgtgcatgccttttctggagtgcctggtctctctgaggctccctacacatggctgtaagactcagtatacacacacagacccactggggttcaaactcactttatccccccttcttcactgataaagaaacatctttagccccctggtttccaaca

SEQ ID NO: 490756 - DNA, 845 bp, Homo sapiens
tgattggctgagtgtctgtcccagaatctgttctctgactgtgagtgcttgtatttgaaccactgtgctttcctagtcacatctgtattatgagtcaggacattcgtacaaggagctgtctgcttatatgcactgcctaggatggtctaggatgtagacaatctttcgaatcttctaccttttttgcacatgtatacatgggtgggatgcggctttccaatacgcatgggctgcaattcggagtcataatcccagttttgatcaggtatttgcgtctgggataaggatcttctggtggcaacagttgtacttatggacttcatacacctcctttagcttttctcttgagcaaatgtgactccagagagcattactggccgtctatctctaaatatggtagtttctttccttcctttagagccagtgacaaacaacggctcagactcttttaccactgagtactctgtccagcgatctcgcagggctgggtctctctctctctgtaactagtgatgtagccatcgaattctttagcgaactccatacacctgtaggggaatgtaaacaggctaaagagtgacgactgcaacttgggtcattacagctcacttctaaatcttcacttggggggattccggcgtcaactttagaaggatctgatgcaagcaactggttttggggaactctagtgggacgccagggccatattcccgtgaacagacagatactcctgaagttaataactcaattccaaggcacacagattggtacatggaagcatgtacactcaactacagggtaaacggcgaccagtctatcaggtggacaagttcacccagaaacgg

SEQ ID NO: 490757 - DNA, 351 bp, Homo sapiens
aggagaccaggagtatgccactgagaaatatttctcttgagatctgttgaattttaagtgtctgaaatatccagtctaggatgtccgacaatcaggagagatgacaggatgagattgcgagggagtacagattgggtcgtgaaagaggactaagtgcagtaactccggaacatgcgtactgccatatactaaaaggtcagaggacggtgtgaccttggacaggggcagtgtagaggagagtaagtggtagaggcactgactgaccagctgattgatgacgaagaaggcggcctcgggtattgggttgtagacacaagccaccctttggggagagtagagtcctgggcggtg

SEQ ID NO: 490758 - DNA, 353 bp, Homo sapiens
tcctggtgcctgaagccccgtttcctggggtgcctgaggccccatgtgccttttccctttgctgacattgctgtggattattcactgtaatgagtcttagccagagtgtgactgtgtgctgagtcctgtaacactgaatcacctcaggatgatcttggggacccttaacacatgcctggtccagtcttttgctttctttttttgagacagggtctcattctgtctggctagagtgtagtggtgtgatcacagctgactgcagcctcaacatcctaggctcaagtgagcctcccaactcagcctcctgagtagccaggaacacaggcacaggccaccacacccagctaatggtt

SEQ ID NO: 490759 - DNA, 726 bp, Homo sapiens
gcagtggtcgtccctgccctccccggccccggggtgcaccccgcaaggctcccgttggtgtccctggagcatgggaggctgctgagcgtgagtggcggggtactggcaggacgctgcgtggcacgggcagggcgtccatggctgcagccaacaagggcaacaagcccagagtcctggagtatccgctttgcggcaggccacgatgcacacggatcccacagccacgtccactttgatgagaagctgcatgactcggtggtcatggtcacccaggagagtgacagcagctttctgggtcaagggttggcttcctgaagatcctgcacagggtatgagattaccttcagtctgcccccatgtgcacagggcttgagcaaaggattgtccggcgagggcaccttgtccccaggcgctgaaccttcaaagcgtccttcaggcggtggtgcccgggtcccgtgaagggttatacggggtcaaggtgttgaggtactcgcgcgcacaaaggaagggcgtcctccaaagaggagatacctggctaagcctgcgaaagggtggcactgggcacctgttgtgcgacgtgacgggtgcaggcccgcgtcatggaccggcaacagggaacgcccatgctgctgggatggtgtcaagtgtgtgggcgccgagctggaatacgactcagagcacagcgactggcacgggttgactgaggcccgaggccccgcatgtccg

SEQ ID NO: 490760 - DNA, 195 bp, Homo sapiens
agcacgctggagtggaagaggagggtctggtactccacacactgcaagggaccaaggagcaagtgcggcatagttgattatgtattagtctcacgctcagtacatcggcactttatgtaacgcgtggtgaacatggagcagctaccagtggggatatttaaccttttatctgtagctgtctgattaggaacagga

SEQ ID NO: 490761 - DNA, 573 bp, Homo sapiens
  misc_feature (7)..(7): n is a, c, g, or t
  misc_feature (367)..(367): n is a, c, g, or t
tggcgangtaatgttagtggttatctcagtgagtgccgctggcgaagcctttgcgtattgggcccgcacggagaacaggtaggtggtgcctgggtgcaggttggagaaccacatggtatgtctcattgcggagcttggagatggtacgtcgtgggcctggcacgttcactgccgggtctgatgactcgatgctctggtagctgatctcatacggggtgatgagaccattgttttcctggggctcctcccacttgaggaagatcatgtcctccagtggagtgaaggtcagggactcggctgcaatcccactgggcacatcctcatccgtctggaaagtgacctccttgccctctttgcgcccctcagngttagtgaggacaagcctcacgtgaacgttccgatagggcagcaggttcttgatggtgtagcggctgacaccttgctctgtcttcacacactctcggatggtctggttgtggctgctgcccagggtgtagtgatagcacagcgacacagtataggtgtggcaacgcgtcacgttgttagcccagtgttcccactgcagggtcagct

SEQ ID NO: 490762 - DNA, 678 bp, Homo sapiens
  misc_feature (678)..(678): n is a, c, g, or t
caggtattactcgactactaccatgaacgatacagtaacttagccaggcctggtggtgtaaacctgtagttccagctatttaggaggctgaggtgggagaatctcctgagcccaagaggtcaaggtggcagtggctgtaattgtgccactgcactcctgcctgggtgacagagtgagaccttgtctcaaaaaaagaaagaaaattttaaaatttcttgaaacaaatgaaaatggaaacacaacatactaaaacctacaggatacagcaaaaacagtactatgaagaaagtttatagcaaaagtgcctacatcaaaaaagtagaaaaacttcaaataaacaacctaaaaatgaatcttaaagaattagaaaagcaaaagcaaaccaaacccaaaattagtagaagaaaaagatcacagcagaaataaatcaaattgaaacagaaaaaacacaaaagatgaaaggaaaaaaaaactgggtgtttggaaaagataaacaaaatggacaaacctttagccagactaagaaaaaaagagagaaggctcaaataaataagatcagagatgagacattacaagcaataccacagaaattcaaaagatcattagaaactactggccaggcatggtggctaacgcctgtaatccccgcactttgagagggcaaagcaggcggatccn

SEQ ID NO: 490763 - DNA, 198 bp, Homo sapiens
aaacatgaaagaatcagccgttaccacatatcatctggtttgtgggccatataccttcccttattttatagaatatggttatatttgaggtcaaaattaccttggaaagatatttcccacaattaagcatgctttagagcacctcacaaatttagtgtttacctgtgttgtgatttttgtcgccacaattccatgaga

SEQ ID NO: 490764 - DNA, 243 bp, Homo sapiens
ttcaggaactgggtttcctcaccacatgccccatccagtggaagccagtgagctctgaccttggctgggcctctccctcccaccagcctgttcctgacaggcctgctgtttccccactcatcaccacaccaaatcagtggtatgtgcatgccctgttcatggcttgcgggcagggccttcctggttttgacatctgaccaagccacaccacctcccatcagtgctcaaaacctgtaacaaaaa

SEQ ID NO: 490765 - DNA, 487 bp, Homo sapiens
  misc_feature (324)..(324): n is a, c, g, or t
acaaccaattttattccaacccccttgaggtttaacggggcagttaattttaatattggccccggacttacatccttattaataatttgcctagcaaacttcaactaaggacggaattacagttggattaatatccttttttaaggaattcaaactttaattcccataaaaggtttttgaaggattttaggaagccttggtaaccttgccttaccccccactattaacctactgggagaactctctgtgctagtaaccacgttctcctgatcaaatatcactctcctacttacaggactcaggtggtgtgactcaggtggtgtnactcaggtggtgtgactcagtggtgtgactcaggtggtgtgactcaggtggtgtgactcaggtggtgtgactcaggtggtgtgactcaggtggtgtgactcaggtggtgtgactcaggtggtgtgactcaggtggtgtgactcaggtggtgtgactcaggtgg

SEQ ID NO: 490766 - DNA, 518 bp, Homo sapiens
taccaatcgcgcgcagggcattgcctaccccgccgcctcatggcagatgatactgaatgattcacaagggagactgcgtttagcccaggctgtttgcggtgttgaggaagtgagattgtgagaagtgacacgaacaagtgcatgtgtcctcgtctacattcccagtatagcagtacttgaaggtccataatcctgccaagttgcatctccgcaaactttctcccacgtgctgctcttccataaagttggtgaccggccggacgtctgtgcccctccactcctgtcgcaggcttattgttccgctgcacgaaccactgcaagattttggacacccatcttcatttcgcgtttgcaacatcgtccagttcgtcaaccactcacacaccctcaaaccaaccatcatgtctggacgaggtgctgccggcggcgctcgcggccgcggaggcaagttcaagaagtacacaagaggaggtaagcacaatctgcaatctttgagcttggcagccaccggatcgact

SEQ ID NO: 490767 - DNA, 187 bp, Homo sapiens
tggtggatttacgcttcagagtatagaaggaccaaaaaaaaaaaatcccacagccacctgccggagcacctattgaaccttaaacctgaggtcggcgtttcattctcatatagcctaggagaggcgatcaacagcaaaaccaacctggataaggctgaataaggatgtcaaagcccaaacaactagc

SEQ ID NO: 490768 - DNA, 831 bp, Homo sapiens
gttgcaatgagccaagatcatgccactgtactccagtctgggtgacagagcaagactccatctcaaaaaaaaaaaatgtttaataattagccatgcatggtggtgtgtgcctgtgaccccagctactcaggaggctaaggcaggaggatcatctgagctcaggaggtggaggttatagtgagctgagatgtgccatggcactccagcctgggtgacagagtgtgaccctgtctcaaaaaaaaattttttttttaaacaagtggcagagggatccttaaagtattttccattggtttcaagttgaaaaccaggcaaagctaagcatctttttagggtgacacgataaacacagtgaagaagtgtctgaggactatggacaagttaacggttggggtgcggagcatccaatgagggatgggcacacaagacttgaaagtaggggtacgggccgggcgcggtgggctcacgcctgtaatcccagcacttggagaggccagaggacgggtggatcactgaggcagcagatcgagaacactgcaaacagggtgacaccccgtccctctgttgaaaatgcacaaattgcggggcgggggggcggcgcctgatgacccagtcgctcgggggcctaaggcggaaatgcggtgaccggaaggggagcctggccgagacgaaatgccccatgcaccagctgggcaagacggaccgctcagaaacaaaaaaaaaaactgggcgcgcgcccaaattcaacagtggcggcccagaaaacgaccgcccagactggcagtgggcccacagcggccgcacacacactcgcaggcaagcacaaaccgg

SEQ ID NO: 490769 - DNA, 343 bp, Homo sapiens
gggggtttcaacatgtactctgcggacagtgcgaatatgtcaatgctcgacagaggagcgggacaccgtacctcagaatggttatatatatataggacacgggtcgtgacagagccatcacacatgtatctaaccccgttggacaagattatatgagtgagaaagggtctgcataggattcagatctcccttgaggcaggtatgttagtgcccagatatacgggtgagactacaaactccaatatgaagacactgatatggacctgatataagaatccttggtcgctatagtgacactccgagaacttttgtaactgggccacttagggtgctaattgtcttc

SEQ ID NO: 490770 - DNA, 411 bp, Homo sapiens
  misc_feature (244)..(244): n is a, c, g, or t
  misc_feature (255)..(255): n is a, c, g, or t
  misc_feature (305)..(305): n is a, c, g, or t
  misc_feature (312)..(312): n is a, c, g, or t
  misc_feature (325)..(325): n is a, c, g, or t
  misc_feature (338)..(338): n is a, c, g, or t
  misc_feature (365)..(365): n is a, c, g, or t
  misc_feature (377)..(377): n is a, c, g, or t
  misc_feature (399)..(399): n is a, c, g, or t
tttggagacagagttttgctcttgttgcccaggctggagtgcaatggcgggatcttggctcactgcaacctctgccttccaggttcaagcagttctgcctcagcttcctgagtagctgagattacaggcatgagccaccacccccagctaatttgtgatttcgctttctgcagtttcagttacccattgttgggggctcagaaaccaataccccgaaatatagtgggtgtgacattctgaactngaggagccttnaggtctcttccgaccagattcccacagggcccccaacctttgtctttttnccaaggntaaagtgaagttnttctttgaaggtncccaattgccttaaggtttgggacccncccaaggggggnaaacatggccctggggcccttnccggggtttttt

SEQ ID NO: 490771 - DNA, 110 bp, Homo sapiens
gtgattgccaagatgggattggaagacaagtgaatgcaatggaagatttgatcacaaatgtaatttctatgtggaatttcctatcttgcagcatcctgtaaataaacatt

SEQ ID NO: 490772 - DNA, 115 bp, Homo sapiens
cgctaagtgatcagcagtctctaacaatagtacatacaataattgtacattattgttctcaaattggggctctccacaacctggggacccttccttattgtagctgaccacaggt

SEQ ID NO: 490773 - DNA, 106 bp, Homo sapiens
ggcttatgcactactgtagaaatccaattagtataagtgattttttggatgggcacggtggctcacacctgtaatcccagcactttggtctgctcgggaggctgag

SEQ ID NO: 490774 - DNA, 400 bp, Homo sapiens
aagtgagcatgccacttcgaggtagagcaaaagcctcattgtgaaaggcactggacttggaccaggacaccatcaggccttggttttctcacgcataaaatgggggagtgggttaattcggccaaagattcttctgatctgacattttgaaattgtgagagaaactagatgactgtaaacttggtcacaggcctggttctggcagttctttgcggacttttttctagcatttatgcaaataaacatgcagtctcggtgtgctctcgcatggtatgaatatctagtcctttctgtggttctcaggcaagacataaaaactaggactcagagcacatacaaaaccagttatgtttcggaaagagggaaaagagtccccgagcccggatcttgtgctgctttt

SEQ ID NO: 490775 - DNA, 253 bp, Homo sapiens
gcttctggatcgctggcaggagtacagcttccagaatgtgcggatgtatgtgagctgggtaggcagatactctccaaggtgtctcctaaatagtcattatcatctacaaattctcatttagaaagtaatgaccaatttaagggccaagaacggtggctcacacatctaatcccaacagtttagcaggttaaggaccgtggataacctaggtcggagtagaaccagcttaacaaaatgagaacctatgtgcaaa

SEQ ID NO: 490776 - DNA, 245 bp, Homo sapiens
atgcaagttctcctcagcctccccagtagctaggattataggcatgggcaccatgcccggcaagttttgtattttatcagaggtggggtttcaccatagttggtcaggctggtctcaaactcccgacctcaggggatccacccgcctcggcctcccaaagtgctgggattacaggtgtaagccaccatgccccaactccaatgttttcttatagacgtttcatagtttgaggcacagattgcagt

SEQ ID NO: 490777 - DNA, 383 bp, Homo sapiens
tgaggagtagcaacaagtacattccccaggtaatagactgtggaacttctggacctatctcattcttagcgcgctggtgaattccacttgagaaagggagcatccacaagtttaggagtggtccagggtagagtccatctaccaaggcagacgggcattccgccgctgcggccagtgatcgttagagcagattgtctatgctcgtgctgtcgtggcgatggtctttgggtgttgtgctcgtcccgatgcgtataactacggtggcaccttgagcgatctggggtcatccttgatctacgagcctacagtatcgcggacgtccctttcctacgtgttccgcgcacccgacgcacccggctacggcggtatcgctgaatgtatgg

SEQ ID NO: 490778 - DNA, 759 bp, Homo sapiens
tcccctctttctttttcctctctttttttttttgtgtttaaacacacccctcttggtgttgggccccccgcgcgggggccgcggcttccccctgcgacagagaacaactctggtgggtgggttttcttgacaaagagagggggcgtcaagaagaacctctctctgtcagtgagaggcgaaacatgtggggaacaataacgaattctctctctatctccaatcatagagaggtagggggcagtacagaggaccagtgagtggagttcttctaacaaaagatggtcctaagagtgaggtgcgcctatgtggagaaaaaatgtacccacagagggaggatgcgagaggcagcaccccgcggtggagggtagggtgagtacaacaatcacactgaacacacaccacccaacatagagagaaacgaatctctctcttatgcggcacagtgggggtggaaaagcatacacacagagggcccctcgtgggtggagaggaggcgtgagtgggcgttctccccgacgacgaagatctcccatggtgggtcgtggttccctcgtgtcggagggggacacggtggtgtggcgcgcttgtgtccgacatagttgttctccccccgcagaactcaccttgttggccgcggtggtggttcaatgatgtggaaaacgttgtggccgaggatgttgtttgtgccccgggaggttgggtggtggcgtacacccctgttgttgtccaacttattcaccccacataccggtggggtct

SEQ ID NO: 490779 - DNA, 294 bp, Homo sapiens
gtcctccttcttaaaagtctactagcctgggtgcagtggtcacacctataatcctagcactctgggaggctagaggcaagaggattgcttgagcccagggtttgagaccagcctgggcaacatagtgagaccccgtctctatttaaaaaaaaaaagaggagtctcccatcacttcagaccttagaactttatgtgtcctcatcccttgagtccagagtaccttctctattgactttgcctgtcccacagatcaggaatctgagcattgatgagaggactcaagaggccaggttg

SEQ ID NO: 490780 - DNA, 807 bp, Homo sapiens
  misc_feature (232)..(232): n is a, c, g, or t
  misc_feature (235)..(235): n is a, c, g, or t
  misc_feature (240)..(240): n is a, c, g, or t
  misc_feature (266)..(266): n is a, c, g, or t
  misc_feature (271)..(271): n is a, c, g, or t
  misc_feature (277)..(277): n is a, c, g, or t
  misc_feature (283)..(283): n is a, c, g, or t
  misc_feature (313)..(313): n is a, c, g, or t
  misc_feature (319)..(319): n is a, c, g, or t
  misc_feature (323)..(323): n is a, c, g, or t
  misc_feature (332)..(332): n is a, c, g, or t
  misc_feature (364)..(364): n is a, c, g, or t
  misc_feature (389)..(389): n is a, c, g, or t
tcgaagtaaagctctcggtcaagttcaacatgcagggatgttcagcttgaatgaggatgccggtcccgacaaacagtagcagtgggtacttctgagatgtcaagcatttgctgtgtgtcacacaacgagcagacgatggtccagaggatgcccttactatcgttgcgccacgttgcggtggagggacgactctgagctgccgagtgcatgagagtgaagtgtggagcatctncgngtgtncggtgtggccggacatccagcactgnaggcngcttcnacgtcnatacaggacgtgtcggtgatgatgagcganatggangtgncgccatcgnaggcacgctgaagctgtacttccgtgagctgnccgagcccctcttcactgacgagtnctaccccaacttcgcagagggcatcgctctttcagacccggttgcaaggagagctgcatgctcaacctgctgctgtccctgccggaggccaacctgctcaccttccttttccttcttggaccacctgaaaagggtggcagagaaggaggcagtcaataagatgtccctgcacaacctctgccacggtctttggccccactgctgctcctggccctccgagaaggagagccaagctcccttgccaaacccaagccagcctattcaccatgactgacagctggtccttggaaggtcatgtcccagggtccaggtgctgctgtacttcctgcagctggaggccatccctggccacggacagcaagagacagagcatcctgttctccaccgaagtctaaagggtcccaggtccatctcctgg

SEQ ID NO: 490781 - DNA, 908 bp, Homo sapiens
aaaatgtgtccacgaagtagctttgtgatcgcagatacattcatagtgaactcatcagaatggctggtttgcagtactgaaatactatcttctaggctaattgtagcactacatacagcctagaagatagtatttcagtactgcaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacattggactattcatggagagtttacccatacatttagcaaaattgacctggccacaacatttgatctccagtgagggctcaagttagatccctatagaaagaggaccacttcatcttacttcaggtcatagttacgatctgtgatacgaaccataagatatgcctgacaagcagaatcaccaagttcccactttgaattaccacaaaaagtgtagaacccatatactttct

SEQ ID NO: 490782 - DNA, 467 bp, Homo sapiens
gctcggcccaaattccgaccatacacagaaatcaaactcaaaatagatatagacttgaattttagatctgaaactatgaaactactagaagaaaacactggggaaccaccccgtgacattggtctgagcaaatatttcttgtgtaagttctcaaaagcacaggcaaccagagcaaaaatagacaattggaattacataatgctaaaaagcttctgcaccacacaggaaacaacaaactgaatagacaaaccacagatagagagaaaatctttgcaatctaactgacaagggactaataacctgaatatataaagaactcaaacaactaaatagcaaagaaacaaataatttcatttttaaaaatgggcaaaaaattgggacaaacatttttcaaaaagaagacatacaagtggcctacagttatattttttaaatgtttgacattgctaatcatcagataaatgcaa

SEQ ID NO: 490783 - DNA, 182 bp, Homo sapiens
ggaggatggagcagtaagcgggtctgggcgcctggtggcagcgccatggagacggtttaaataaggaacccacctcgcggcagctgaaaaggttggatgaggtagtttaaccaaacacccagagggagtatttgatgccttaggaaacttggagagggtccaatggcagcctttacaaagct

SEQ ID NO: 490784 - DNA, 555 bp, Homo sapiens
atcctgccatacagaatgatttcagctattatagaagaacatgagtcgtatgaggattaacaatgtaccggcagaaggagaaaatgaagtaaataatgaatcggcaaatcgcatgtctttgttttatgctgaggcaagctccaatgctgaaaaccttgagtgatgccacaacaaaattgtatcagagaatcaaacaattctaccaatagaaacatcaccacagatggttaacgcacacctggctagtgtatgcagagtcactgctggaaacaccggaataccagaagcagatttacaaatgagagagacagtgtcattctgcttgagggtaatggtgggtgtcactaatactctatgaccacgtacatccagtgggagcattgctaacaacttccaaaattgatatgcaaggttcgtctcacagttcttaaggaccaacctcctacatagtgtggacggtcttctacaatgctctcaggtacaccaaaaaaacatttgcacatgatgagactccctccaagcaaattcacatccatgctgcaataacaattctga

SEQ ID NO: 490785 - DNA, 88 bp, Homo sapiens
gtttctgctcccccgtgcccctctcccccattccctggggttaaaatcaaacccccggggccctgcaaatcttttccgtttccctttt

SEQ ID NO: 490786 - DNA, 622 bp, Homo sapiens
tccgtgtaggtccatgtctgaagtcactatcaacagctggtgtacaagtttctccgagtatataggtagtgcgatagctcgcagatatcatcttaatgatgcgcatggccagtgtattatgtcgcttcccctgagctctcacgtacagaacgcatgtcaccggtctcagtacgacactatgtagtctgactgtgtcgtatgaatgatcttgcgctgcatagtctcagtcatggtactatgctgatcgtcttcagagttgatctatcaatccgtgtatgtctcacttcgtcagctctcatgaagccactctcgtggctgtttgacaggacaacctcggagttgtcacctagtacggtctggtgtgcgctacctaaactcctgctgtcactgaagtgttcaattcgtcatgactcatccctttgtctcatgtcgtagtcctggagagccgtctagccatcatcggtcctgatgcagtgactagggatgtagcgaatgtcttcaagtcgggccatcacatgcagagcctgcgggagctcagtgtgagtcacgtcagagctcagtgggcctgcatagatcctagccgctgcagcatctccgtccgagcacacgccctccggctcag

SEQ ID NO: 490787 - DNA, 103 bp, Homo sapiens
tatgtctctgcttcatttctgaagcaccacgggaaggtttctttaagccatgtggtggccgcagttggtagaacgtccagggagaccacttggaatatctttt

SEQ ID NO: 490788 - DNA, 144 bp, Homo sapiens
ctccgaaggaggcattatgaaatgatctgctgcagtggtcatgaagccctaggattcatcttacttttcaccgtaagtggcctgactggcattgtattagctaactcatcactagacttcgtactacacgacacgtactacgtt

SEQ ID NO: 490789 - DNA, 998 bp, Homo sapiens
gataccttgcgccgcgtcgcgtagtggggccttttttataataaatgttctctgcgtcattatatccgttctccttttcgggggggtcgttttttcccccgactttcttccccggcgccacaccctgtgcgcgtgtctcttgtcaccaccccttctacggccgcactagtttgtgtcccccgtctgcgctgcgacggttgttgggtccgcccccacatcccacttgcgggggggcacgcccgccatgggttctgcgcgcccccaaaaaagtttgttgtgtcaaaagctccgcgaaatagcctctgtattctcgttcgtcttactccggtggtggcgtcccgccccgagtagtacaaacgcgtctgtttacacttagggagatttttggcgagaaaaaaaacacctgtcctccccccccgtctttgggggggccccaaaaaattcagcccctcttccttagttgggggccccaccaccacacataccggaagaagccgggagacaccaaatggggcgcccctccgctcgcctaacccacaacgaaaagaaaactctcttaggagcacccctcttgtgaagggtgagcccacaacaacgccgctcttctccggagagattacccgcctggtgctaaatatagaaagaggacctgccaccacctctcgtgtcggggtgtgccacccccctccgcccggcggttgtttaatatgttggggtttgtattccccaccccccccgcgtgtctaccaaatagtggcgcgaccttcgtctcctgtgttgaaaacaacacgtgggcgcaacaacttgtgttatagcacaacaaaaacaagtaataaaaaggagtaatcccacccctccctgcgcccctggggaaattttggtgctgattaaaggagaccccccttcttttaataaaccgagcaaaaatggaaggtgttcgccaaaatatgaaaaaattattgttgttttgagccaaaaaataatatttccccccccaa

SEQ ID NO: 490790 - DNA, 171 bp, Homo sapiens
ggtccctcccttccaccagcgtcgggttgttggggagcagctctggggttgggctggcccactcctgtccccctactcattgcccggctctgtcccagacttctgtggtgctcgacgactcccttcactgtccaggccacctacatctctgggtgagctggtgaagtggag

SEQ ID NO: 490791 - DNA, 131 bp, Homo sapiens
gtccgcatgtccgtatcttgcagtgccctttgctttctgtgacctgcagccggctcatggtgtttgtgctgctgggcctccaggtggtggtggttgtgacagcctgggtgtatggtgagtttggtcccctt

SEQ ID NO: 490792 - DNA, 871 bp, Homo sapiens
  misc_feature (871)..(871): n is a, c, g, or t
gaagggcttccttatgcttctcggtgttcttgtctactctgctgaatggaaaaagaaaagcagtccacttgctaacaatttagaaatgggtagaatagggaagtaaatattgagttactgctaaagccaccactaaaccaattgcatctgtagatgttatgcctagaatgtctcctttttttttttttggaaacagtctcactcgtgtcaccaagcgggggtgcaggtgagccgacttcgcgccatggcactccagccggggtaacaagagcaaaacttccgtctcaaaaaaattttaaatggtccgcggggcatgggggcctcaggccgttgatctcagcgcttgggaaggctgaggcgggcggatggctagaggtcgggagtccgggaccatccgggccaacatgggtgaagccccaggtctactaaaaacacgcaaaaagtgggccaggttggatggcaggcaccgggggtcccagctatcgggaggctgagaaggagaacctgaaccaggcggagatcgcggagctgagatcagccattactcaggctggagaggagcaaaacttccgtctcaagaacacaactgtccgactctgggggttaaatgttggctcgtcccttcggattttggccaatgtggtttgtcggtcctggttttaattttctgtcagccacctgatttccagtacacatagaccgcgtctacaataaaacatttagtttcaaagcccccatattcgatatcatgtgctactcggactgggcaccttggcaaatttttacaacaacacagggtcagagagcctcaaggaggtgtgggtgggagaagcgcatttgtgcaggctggcatcatcggtcagatactatn

SEQ ID NO: 490793 - DNA, 1019 bp, Homo sapiens
gggaaaaaaccacaaatggtaaataaaggtttgctatttgcaaaaaaaaaaaaaaaaaaaaaaaaaaaaatatttttgggcggctggccctgaaaaagttttctgaaacaccatgtctggttggcggggcgagggccccgatggagtataggggagaacacgtgtgccgaaggagtggtttcccataggagaaactcggggctcttgaaagaagtggctgtgggtttcttctcacagataaataaaaacgccccggggggcaacagcggaagtggttgcgtgaaacaacattccagaagagtggacgttaccgaggggcgtcctaacggggggacttctttccaacagcgaggaggcgtccccagagcggagaggccgcgagattatcataaatattaagcgcgcccgcggccacggggggagggaacagtagccacaccaaacagaggagacgaccgaacacaacaaaggaacgcaagctggcactcgacgcaaaggaaccaaagagaaggcgcagaccacagaaacatgaaagcagcaggagacaaacccaggacgaacaacaacacaccaatacgacaacaaacgacgacaaaacacctagcgcgacgacaaagcaacaagcagacagcccagacagcacggcgcacgcagcaaccagcagcgtcaaccacagcctcacataccagagacgaggagaagtgcacgagacacaacaccgaagagcaaacacataagaacgtagcaagaaggaaagacagagaacaacgacaagcacacaacaggcagacacgcatcagcgccaacgagcacagacagaagtcaccaacaagcgagcacaaagagaaggagacgagcaacggagacagcagcacagagcacaaccagccagacagaggaacacatagcagcaagacacacgcgaagacaaagcagcagacgagacaccggacaacggagcgatgtggaagtagccagacgaacaccaagcaggaagacagcacaaaaacataagagct

SEQ ID NO: 490794 - DNA, 159 bp, Homo sapiens
gctttgaaatgattttcctcctaatatcatgggggaaaaaatccccaattttaattatatgttttgggctctcatttattatcatttttttctggccaaatttattatttttagatttttgtataacatgatagacataaaattggtttttttccccca

SEQ ID NO: 490795 - DNA, 221 bp, Homo sapiens
gtatgatcagagtcaatctccatataactcttggtctaggtactttactatcaagtacccccttttttaaaaaaggtcttccaactttaagactttatgagttgatgaaaatattaaggtgaagaataatggtataaagggaaaaaagacaatattcaacttaccatattgttccactttccaaaggatacagagctgataaatccacgtaataggacaaa

SEQ ID NO: 490796 - DNA, 244 bp, Homo sapiens
gactaacaggcagcttaaatgtactatagctaaggtgaacacttgggaaactattaatttggaggtttagaacgcatacgaaacacacaacacttcaacagcacttgaaagtaaacgacaatatcatgaggtcgaaaaaacttcaaaaggatactcagggaacgagaaaatgtgaatgaaagcagtgaatttctgcctctcctcgtatatagggtacttaaaattactacaaactactgtttac

SEQ ID NO: 490797 - DNA, 226 bp, Homo sapiens
acacataagatacatacttgtgttgcagaaagtatcttcctccaggtcttgtgatacccttcagcatggaacgattaatgagggaaatctttatattctgtataaaaagcaaagagcaaatttatatactaaaatcatttgtctaaagaatttaagttgttgttcaaataaacaattagaatgccatttcttgattattgcaaaatacacatcacacatagaaagg

SEQ ID NO: 490798 - DNA, 435 bp, Homo sapiens
  misc_feature (138)..(138): n is a, c, g, or t
  misc_feature (373)..(373): n is a, c, g, or t
  misc_feature (389)..(389): n is a, c, g, or t
  misc_feature (391)..(391): n is a, c, g, or t
  misc_feature (421)..(421): n is a, c, g, or t
gcggcacgagggaatgagaaggtgtgacccagactttagacttttataacagaggctacaaaataaaaaaatagatgctcgcagacagaactgattttacagcattctcctccccacagtacaagagctaccctgatngtcaaaagacatgttttgggataccttctgtgaacaaaaagtacctttttctgtctcctccattctgtcatctccttcatctggcacaggaagcctgttttggtgtaacagtttaggtaaacaagggaaggacttgatttcctgttggatccagcaaacagtgatatgatcctcacacatgaagctaatgttcttgcacaaagaattgtgcgcagctagctagggtggggtgggnaagtgatgacttggantngggcagggagggttaccctcaccttcttgntgggtcttagtttc

SEQ ID NO: 490799 - DNA, 537 bp, Homo sapiens
tggctcaaatgatacttctgctttaagttctttgagaaatcgccacatgctttccacaatggctgaactaatttacattcccaccagcagtgtataagcatttccttttctctacaatcttgccaacatctgtttttttttgttttttactttttaataatagcctttctgactggtatgagatggtgtctcatgattttgatttgcatttctctaatgattttacatgtttctgtatgcttgttggctgcatgtgtatctccttttgaaaagtgtcgttcatgtcctttgcccacattttaatgggcttgtttgttttttgcttaatttatgttccctatagattctggataattgagctttgtcagatgcatagtttgcaaattttctctcccattctaggttgtctgtttactctgttgatagttactttttctgtgcttaatctctttagttaaatttggtaccatttattaaatgtttgtttaagttgcaatttgctattgggggttttcattactgaaatattttgccggt

SEQ ID NO: 490800 - DNA, 182 bp, Homo sapiens
cccccgggtttttgggaaggcccccggttccaaaggggggccctttttttccccatggggtttaaaatgggggaaaccccttttttcagggggggccccccttttcccccgattggggccaaatttaaaccctttttttggaggaccaaaaatgggttttgaattttttttttttgcgccca

SEQ ID NO: 490801 - DNA, 1032 bp, Homo sapiens
  misc_feature (317)..(317): n is a, c, g, or t
  misc_feature (324)..(325): n is a, c, g, or t
  misc_feature (330)..(330): n is a, c, g, or t
  misc_feature (341)..(341): n is a, c, g, or t
  misc_feature (343)..(343): n is a, c, g, or t
  misc_feature (357)..(357): n is a, c, g, or t
  misc_feature (367)..(367): n is a, c, g, or t
  misc_feature (369)..(369): n is a, c, g, or t
  misc_feature (373)..(373): n is a, c, g, or t
  misc_feature (995)..(995): n is a, c, g, or t
gcttgcttctccttcagtcttctccaactcagtaaatggcaatgccatacttctggttgctcaggccaaaaaccctgaagtcatccttgattcttcttttagcacccatatccaatccattagcaaatctggtagaccctaccttcacaatatatctaaagctgaccacctcttttgacctctactattaacgccctattccaagccaccatcatctcttccctggattgaagctgtcatctacaaaaattcttcttatatccttgcattcctacagtctgttccccataaagtagccagaatgattatttttaaancaagtcnnctcanaccattcatcngntcaaaaccattcantggcttctcntntcantcagagcagtcaaagtccttaaaagttgcaggcctagactccctgtcctacctcaggtaccaccatatcccacctcctcatgcagctccaggcaccttggcctcagtgctcctcaaagcatcaagtatgcacttgccttggacagtctgtacttggtattccctctgccttgaatgttgttctcccagaaaaatgcatagttcactcttacatccttcaggtgtcactccactgttacctgagcaggtcgtccttgaatatatacatcagcattccctttcccccctgctttatgtatgtccatagcactcaccacgatctgactttactaagtatttattcatttactgtttgttttcccataccgaaatataaactttctaaggacagaaatttttgtgctttattgttgaatctccaatttgtagaaaaatgcctaccttatattaaacactcagtaaatgtttattgaacattaaaagtattactaatagaactttggtttttgaaagaaataataactttaattataagacgtatatgatttttgcagttttacttagtggtgacattgggtttatgagaatcgtgtacattcaagtccaggaatattaatgggcancaaatggttgaaaaggaaataatccagtggcaaatgt

SEQ ID NO: 490802 - DNA, 341 bp, Homo sapiens
aaaaaaaaaccttttttcccccggccctttttttaaggggggggagggggttttttccccccgggccggggggggagccccttttaaattgggggtttaattttttggggtggggtttaaagggtgccccgtttttcccttttgaaaaaaacccttttttcctttttggggtcccctttttggggttttggggggggggtttttttcccaaagcccggggtggaaatttttttaagtttttggggggggccccttttttttttggggggtttaatttggggtttccccttaagggttttttgggttcccccttttggttcccaaattaatttgccccctga

SEQ ID NO: 490803 - DNA, 108 bp, Homo sapiens
cgtggtgagtagacgactcatgaagaactctgctcatcgtttgtgcatcagtgtactcatctgctgtgtgcactggacacatgtgagggtatctcaagactgctgtca

SEQ ID NO: 490804 - DNA, 1272 bp, Homo sapiens
tttgtcttttcgccttttttctcccgtcggagcctcctgtcaccacgttgtgttttggcccgttgttatttttttcccccccggtcgtgtgtttccgcacttgtgcctgttttccccgtaaggggccctctggggacataggtttgctttgggctgtgtgtccctgggcctccttaggggttttctctgtggtggccccccccattatttgccccgttgggtatatggctgtgtatccccccggagcagagtgtttactgccctctcgggtcgccgctttgtcgtccccgcgattttcgccccccaccggggcggtcaaagggtattgtatgccctgaactttctgcccataaccctttcacccggatatgcccatttattggaaaatgtagttttgggcgccaacaggtggcttcctgtagggccccttatgggatgtccaattctcctttctcttgtgacaccccgctaaggggtggggccccttgggctcggggcactgttggtaatgtagcgccagagcttttcagtccactgttatggacctgttctggggatagtagacctccggagacaccggtgatgtgtatacgcttgtttaaggctccaaccgtgttcccccacttattgtctccttttcccaaatatggagccctgttaattttgcccactctactaatggaaggcttctactttcacctgaagtttctcccctatttttcacaggctaacacccccttaagagccccaaaccttattccccctacaaatgccacttttcacactattacataaatttcacattcgcggcgctataaattctaaaaacttttcttatcccaccaaaccaacttttcttcggcccctatttcacggaatatgtcccccgcacacgcttaatctccggagacttaacccccgcagatggcactaacacccaccactggaacactccctattcacttctcgtaagggtgcactttcactttttcttctaaccacccacgtaatattatataatttttcactcgagttgtgaagaaagcctcttccctcttcgaaagcgaaaaagtcctatatatgtatgaagaaaccctccacttaaacctcggaggtgaactaatattggaatgccccccacccctatccaccaccacttcgcagaaacccgtatatatcacttaaaattctatgacacaaaaaaggaaaggaattcgaacccccccaaactggtttcatagcccactcccctggcctccatgactttttcca

SEQ ID NO: 490805 - DNA, 268 bp, Homo sapiens
tcacatacaaatcatccatccttgccaatagtggtcatcctcacagtgaacactcagtgggcccagggcattttatagggcataccttcttatggggtggtcaccaaggctacggtgctattgggtcatctggctccgtgttcacaccaggagaaccagggctacaaggagaaaaaggcagaggccaaggaggttggaggggagacaatagtcgggtgaaggaaaccggtatccattaaggacccggattccacttaaatgtgtgctg

SEQ ID NO: 490806 - DNA, 314 bp, Homo sapiens
  misc_feature (163)..(163): n is a, c, g, or t
  misc_feature (169)..(169): n is a, c, g, or t
  misc_feature (179)..(179): n is a, c, g, or t
tgttgagtcattccccagagggaaggggaacctcctccatctttttggcaacatctcctatcttcctttgctgtgcttttttcccacttacactggtttgttctatcctacactacagatttctattttgaacttgctgccattttttcatacttgaaaatgntgacanttgctccaangagccaaacaataaatgttgaattcggaaacaaaaaatgcacacgttctcacacaaaatgtgtacactgcatgtttacagccagcattattcataagtagtcaaaagctggaaacaagccagatgtctatcatca

SEQ ID NO: 490807 - DNA, 543 bp, Homo sapiens
gatgttcacacaatgatgcagttttttagaactattcccatcattaagcaatgcatgactgtacacatacatatacttgcatgtaaaactggggaaatttgagtaagttgggtgtatcaatgttaatagctggttgtgatgctttgctatatgcaggatgccaccattgggggaagctgggagaagaatatatggtgtctctcttcatcatttcttagaactgcatgtgaatctacagtgatgtcaatgttttgtaaaaagctcacccagtgtgattatcgttaataataacttaattgtacattttaaaatagctaaaaaaatataatttgattttctgtaacacaaaagataaatgcttgactggatggataccccattctccatggtgtgattattatgtattgcatgtctgtaacaaaacatctcatgtacctcataaatatattcatttcctatgtacacacaaaaattaaaaacaaaaaattttcaaaaggtgacacagtggaggcttgtagagccaaattacaatattgctgctga

SEQ ID NO: 490808 - DNA, 215 bp, Homo sapiens
tccttgagtaatagccattatctatatcactctatcctctgccccccgccacccccccctgtcccctatacattgtaagagttgttatccaccttttctgagggtatcaaaattaattatcattttccatgtgatattctaatacataacaggtggcagcatacagcagtatatatataaacaggaatagtatatgctgtaatagtttatgctgt

SEQ ID NO: 490809 - DNA, 559 bp, Homo sapiens
tgggtgggggttgtgtgggaaccaccctacagcctaaaagactttattaaagatcttattggcgttatggcagttataagaagacactggattggagcgctacaggtgtttcctggtgacctgggtgctcagggtcactctggtggcaagacgtcttccccagggctggtggggagacgctgggagaagactggctagcgcatggtgtgcaggtgccccaggattgtgggagaagtcgcatgggtacctcctaaggaggcttcaagatgtgggtgtacgcggggttctcaagagacaggcctctcaggggtagaaccaagaagaggtgtcaggagaggtgtgtcgggttataaggccagtgggggcccagtggggtctgaacatttcctctggaagactagagtgtcaagagctccaagcctcttcttctgggtgtgttttcacagagaaccacaaggtgctaccgtgtgtgtgggggggatagcacgcactctgtgcggagaaagagtggcgctttgtgggatgccagatagttctccacagagaggtgatttttggt

SEQ ID NO: 490810 - DNA, 283 bp, Homo sapiens
aaatctgcgggcgcgtaatagggtagtcacaataccgcagagatctggatataggtggtctgtttatattcttctgtgacaatgacatcacagagctctggcttggcaggttcctctcatctttgacagtcaaggatgaacacagtaggtccccacgttgcaagcccaagtcacagatagcaacacgtgctgttagcattctgcgaagctgcacccctatcaggtacctgtgttttttcccagaagatatgagataattttctgatcatctgagctcttgctg

SEQ ID NO: 490811 - DNA, 258 bp, Homo sapiens
cctatccggagcagtgggaagtacagtggggttgttcaggagcagtgggaagtacagtggggtgttcaggagcagtgggaagtacagtagggtgttcaggagcagtgggaagtacagtgggggtgttcaggagcagtgggaagtacagtggggggtgtccaggagcagtggggaagtaccagtggggtgttcaggagcagtgggaagtacaagtggggttgctcccggatcgggtaccgagcctcgagttcggttaat

SEQ ID NO: 490812 - DNA, 134 bp, Homo sapiens
ccaggctcagctccacttacaagcttgtcaggagtttaaggtcgcaaaacgaaggcatttcagccaccttgcagcccttcaatacggaaacacaccagactttcctagtagctccgtcccgtcgctctgccaaa

SEQ ID NO: 490813 - DNA, 499 bp, Homo sapiens
  misc_feature (6)..(6): n is a, c, g, or t
  misc_feature (65)..(65): n is a, c, g, or t
  misc_feature (106)..(106): n is a, c, g, or t
  misc_feature (127)..(127): n is a, c, g, or t
  misc_feature (161)..(161): n is a, c, g, or t
  misc_feature (168)..(168): n is a, c, g, or t
  misc_feature (181)..(181): n is a, c, g, or t
  misc_feature (221)..(221): n is a, c, g, or t
  misc_feature (259)..(259): n is a, c, g, or t
  misc_feature (264)..(264): n is a, c, g, or t
  misc_feature (271)..(271): n is a, c, g, or t
  misc_feature (278)..(278): n is a, c, g, or t
  misc_feature (281)..(281): n is a, c, g, or t
  misc_feature (283)..(283): n is a, c, g, or t
  misc_feature (286)..(286): n is a, c, g, or t
  misc_feature (290)..(290): n is a, c, g, or t
  misc_feature (297)..(297): n is a, c, g, or t
  misc_feature (304)..(304): n is a, c, g, or t
  misc_feature (317)..(317): n is a, c, g, or t
  misc_feature (328)..(330): n is a, c, g, or t
  misc_feature (341)..(341): n is a, c, g, or t
  misc_feature (343)..(343): n is a, c, g, or t
  misc_feature (357)..(358): n is a, c, g, or t
  misc_feature (387)..(387): n is a, c, g, or t
  misc_feature (399)..(399): n is a, c, g, or t
  misc_feature (408)..(408): n is a, c, g, or t
  misc_feature (411)..(411): n is a, c, g, or t
  misc_feature (423)..(423): n is a, c, g, or t
  misc_feature (461)..(461): n is a, c, g, or t
tatggngaaaatatagtataatggggtgctgctgttaatctccttccaattctgcattctgtganatcatagtggtaacctgaaatccaccatagtggggacattnacacaataactggcaaatgcnacaaggctgggctttttcagtattgttgattgtntggacanaaaaaggtaatanagaaaatgtaaccaatacaagcatttgggaaaaataaacnaaaaccttttgtgaaaaacaacaggtttaatggaattnacaanaaataanactgtanatntnatnattnataaatnctgtgcnacacattcttcanatcagtaaaannnagaacaaatanangtatccatacattnncttttctagaaagccactggttgaacatnaaccagcacacnactggagtntcnacccacaaaggnagtataggtgggcaaggagtaaatactctgtaagaatnctgggggagtaactaactaagtacatcaagagtagtgc

SEQ ID NO: 490814 - DNA, 213 bp, Homo sapiens
tcaattaaaaaatttaaattatcaaagtaaaaaatttaggcgaaaaaaaccttttaaaaagggggttaaaaaaggacacccatttcccaaaagccacttataaataaaagggggaaattattttcccaaaaaaggttggaaaaagtccagttcggggaaaaaaacttttgaaataaaaaaagggcattttagagggaaaaaccccctaaaaag

SEQ ID NO: 490815 - DNA, 163 bp, Homo sapiens
ccctatgtctcgatcgtaacccttccccagttttttttgaatactttaaaccccgctcctcatggcctggccgtttctgaagctgcttcctcttataaaatcgctttggcgcgcaacatagttttttcttcgcagatcccaaaatataatgaaggggctgggg

SEQ ID NO: 490816 - DNA, 494 bp, Homo sapiens
tgtccatgtgtatgtatgcccgactcatatggtgatgaacaggctgatagggaacggcactgcggatgatggactaggcgaatgtagatcttgacctcagcctgtagcacacggaagttccacagccggctagccgtagcgcaataaccatgtagcgcacggactcctcgatcttgaaggggtccatgatgacagtgggacacgaagtataaggaaagatgtggtagcagtcggtgcgcaccgctgatgttatagaacgccacctccagctcgtccattgcctccaggagcagccgatcaccctcgaactgcaggttatccgaagggagggctaccctttgtgatcaggtcaaagtgcctaatgaatggcgcggataaagaaacctatggcccgtcactaccaaaccttcctacaccttggcagcacccaggtaaaaggtgctctagtggtaggcacagggcacggcggtcagatcgaagtaacgcatccggta

SEQ ID NO: 490817 - DNA, 377 bp, Homo sapiens
gtgtcgggcgtcacagccacgatgccttcagcctcgacggtacttccaatatagactacatccatgcacagaagatctgtctggcctgaggttctgtttaacaaaataccataccaggtcaggcatggtggggaagtgagtgaggatgtgcgtgaaattcaaaaaaccatgggtagataattattaagtctcagtgatgggatgctcgcttccttcctcccttccttcctttccttcctctttctctctccctctcctctctctttctttccttctttctttgagacagagtctcgctctgttgcccaggcagggatcttggataaggttgctcagcagaaaacacatttgctgcttcaggaaagcacagcagcttc

SEQ ID NO: 490818 - DNA, 711 bp, Homo sapiens
gatttataattgactgatatatgactcgtctatatctagacggtgaggtcatccgaccggacagagcattcaagtgatcccagtgtcttgagaatagttcccgggagcaccttgtgttgctacaatgagtcgactgattaacttccgtctcaagtcacatttgagttagggaaaagcgggaatgtttgcaggagtatgttagtatcttgccgtggatatcttgtctcatttccgatttgagcactagatggattagtcaccagttgtggaggtggccaacggatactccgaaatttctgacccctaataaggtagaagtcagtcatatatcagattacaccttgcgcacaggtcgagtattagcaaacggtcaggtgaacatgaggacatagactgctgagacgattagctccaaggtgtaagtcagaccttgtcatgacagcattccaccctgtttacgtccaagcctagagcgataacctagcagacaggagtgccctgctactcgactcgagcacattcaccgaacaagatagcggcatatcgtgcaatgggcgacatgggccacattgtgatagcgttcaataattcaggttaaaaatacgcgggttaaattctttggttcagatcagcgttcatttaattagacaaataaggcggaaattcgtgcaaaagccccttttttcgaagtagacccgcgaatgggtgttg

SEQ ID NO: 490819 - DNA, 161 bp, Homo sapiens
aaaaaattagaaaaattagctgggcatgatggggcccctttaatcccagctacgcaggatgttgaggcaggaaaattttttgggatttcgagttttaggcggcagtgaactatgatttccccagccctccagtttgggcaacaaaggtggcccctgtttca

SEQ ID NO: 490820 - DNA, 933 bp, Homo sapiens
  misc_feature (63)..(63): n is a, c, g, or t
  misc_feature (89)..(89): n is a, c, g, or t
  misc_feature (95)..(95): n is a, c, g, or t
  misc_feature (139)..(139): n is a, c, g, or t
  misc_feature (221)..(221): n is a, c, g, or t
  misc_feature (284)..(284): n is a, c, g, or t
  misc_feature (300)..(300): n is a, c, g, or t
  misc_feature (304)..(304): n is a, c, g, or t
  misc_feature (342)..(342): n is a, c, g, or t
  misc_feature (419)..(419): n is a, c, g, or t
  misc_feature (437)..(437): n is a, c, g, or t
  misc_feature (468)..(468): n is a, c, g, or t
  misc_feature (499)..(499): n is a, c, g, or t
  misc_feature (846)..(846): n is a, c, g, or t
  misc_feature (860)..(860): n is a, c, g, or t
  misc_feature (922)..(922): n is a, c, g, or t
gtactacctcccaactctgttttccatccccttcaggtccttcctcgggaagcggcgaaggcngtccaccctgcgcgtaatcctttatncccggnccctgcccctccctccgggtggaacttccccctcaccgccaganttaaactgaggatcgttggatctctggcggggtgcagaactaaacccaggccacagtaccctattcacgctctgtgcttgtnccaaggtttcaaataatcctcccgcctcaacctgcccaggtgctgaaattacatttataaacnactgcacctggaaaanagcnaaaaatttaaagtgctagctgaaggatgaacagcagcnagccaggcaaaaggggcaatggcggcttccttttttctactgcacactgggcagaaaatgcctctaattggtctggntacctggaaaaataaacntggtcaagtaaaaacagcttttaattattcncttatcgtaggctaccgccacattaattgtnctgctatctacagcaataagccttaaatttgggaggccctgaaggaggacgttggaacaggcaaggcggtgcctcgggaggagctgtttgtatacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtncaacttcaacagtnggcagattgatgacatactcagtgtggcctccgtgcgttcagctgtcttgcacgtgggaatncacccatactt

SEQ ID NO: 490821 - DNA, 276 bp, Homo sapiens
caacacccgctatgtgaacacccctgctacgtggaacaccccgctacgggggacggggaccctgccccgtttagttcatgctctgggggctcactgtggtgctctagtgctctctgctatttcatcacgtttcagcctggctccctcagaaaggggccttgagtgcaacctgtcagtttggtctccctgagtttggtcaccctggctcaggtagaacccgtggttctcagctgtcactcgcttatgcaaccgttaggagatgagctctggggcctg

SEQ ID NO: 490822 - DNA, 967 bp, Homo sapiens
tcccgagtagctgggacttcaagcttccgccaccacaggcggctaatttttttgtattgttttagtggagacggggtttcaccgtgttggccaggatggtcttgatctcctgacctcgtgatccgcctcctcggcctcccaaggtgctgggattacaggcatgagccaccgcgcccggcctttgtgtgtgtgtgtgtgtgtgtgtgtgtgtgtgtgtgtgtgtgtgtgagatggagtattagctcttgcccctgtctggagtataatggcaccatctttggctcactgaaaactacgcctcccgggttcaagagattctcctgcctcagactcgcgaatagctgagattacaggcatgcgccaccacgcaacagataattttctctatttatataagagacgaggtctcactatgttgtacaggctggtctcgaaactcctgagctcaggtgatccacccgaactcggattcgcaaagtgctggaattacagggtgtgagcccgcgcgtgcggctgtcactaaaagagtattatagagggcactacataaacgtgggcagcgtatttaagacatactgaagtgtctctggagaactggtgtcacgacgagacgaagacacttagtgtcgttggtgtaaaagacccaataaacaatctccttaaaacatggtcgattactacagaagctctacgcgtggagagagatgcccccccccggggataataaaaacgggctctcgggaaactggtcgtgacgggcctccgaaaaaatcctgacattaaaacaaaggacaaacttcacgaacataccgagacatgaggcgtgtacaaaagggacttaccacactgcacaacatagggaaggcggcaattgaaccatgatgtcccaccaaagacggaaccgagacatagtaacacagctgtaaccacagcaggctccatcgcatatacagctcagccctgcgta

SEQ ID NO: 490823 - DNA, 120 bp, Homo sapiens
gagccggtaccgtctgtgacttctcaacctccacaactatgaaaaaataagtctttaagtcacccagtctgtggtattttgttatggcagccctactgactaatacagctaaggagctat

SEQ ID NO: 490824 - DNA, 774 bp, Homo sapiens
ggttaactatcagtcgatccgaggccgctacaggtctggaggttgggggctctgtggatttacctgattgcgtggggccccgtctcaaagtactcccaggcggatgccagcctgtgagcgaggggcccattcccgaggtgctcaagaactacattgacgcccagtactatggggagattggcatcgaggacgccccacaccagtgcttcacagtcgtcgttcgacacggggctccatccaacctgtgggtcccctaccatccactgcaaactgcttggacatctgcttgcctggatcgcacacaagtacaacaggcgaagaagtccatgcgacctacggtgaagaatggtacctcgtttgacatccactatggctcgtggcagactactccgggatacctgagccaggacagtgtgtcgggtgccctgcccagttcacgcgttcgctcaggcctccttgccccttgggccggatgttcaaacgtggaggatggccatggcacatattggaagaacgtgccacccaaagccagcccaagagcacatcacacgtatcatcccgcgagcctaaagtatcggatgggcactccctggggccactggggcgtatccccccgcggcgcagttgtcacggtcgaaactactagcgctgccgtgtcaccggcggcgtttcggaccaaccacgtgcattgcacgggaggaaaggcgtaggaaggaaacacggatagccaccatcacatccatttgttacactgtatgcaggggaacccagact

SEQ ID NO: 490825 - DNA, 111 bp, Homo sapiens
atagagcgagccgtgtaccattaacattctagaaagcaaacttggtggcagatgttaatacagtaattataaatatgttcgagttattttagtacttcttttctaaacttt

SEQ ID NO: 490826 - DNA, 533 bp, Homo sapiens
  misc_feature (47)..(47): n is a, c, g, or t
  misc_feature (160)..(160): n is a, c, g, or t
  misc_feature (236)..(237): n is a, c, g, or t
  misc_feature (243)..(243): n is a, c, g, or t
  misc_feature (299)..(299): n is a, c, g, or t
  misc_feature (438)..(438): n is a, c, g, or t
  misc_feature (473)..(473): n is a, c, g, or t
  misc_feature (531)..(531): n is a, c, g, or t
gaatacgttagcggaaatggctccgagaggctttgacgcatgtgtanctttttagtggcggtatctcggccggggattttcgggctccagtggaggtggctatgctcaccccatctcccttgagaggcacagaaggttagagatgtgtgcgaggaacggncaggtccagcgtctcctcgttgctgccccttgagcccgggaccggcgccaatgcgcgcccgggttcttgggttctnncgtccngcagacctgccttggtgtggcgtccctgggccgtagttccgaagctgcagccgacntggtcgggtcctctagcccgcttaccctcccccattgacagatggagaactgaggcccagccaaaaaatatctcactagaggctcacgccattcctggatggggtgggactcaaggacgctcgtcagcagcacgcgganttccgaatgcgcccgtgacgatgctttgtccttanaagcgtgtgttctgaatgcttccagcgcttatgagccccgattacaactgggttaatncc

SEQ ID NO: 490827 - DNA, 633 bp, Homo sapiens
acgatttagtgtatggctctgctactgctggtgtcctttgagttatctatatccttagatttgacagctgagaaatctaggtggattcatattcgtaatcattgattaacatgcacatttgggtatagcacattatatgtttatcatacatttaactccgttttctattaaagaacatgctctaggggaactattaatagcccaccagtcgggtaggcagcattcaatccttctatgccttctttcgccacctgttgaggtctttcttctgaaacaaagaagaaatagacaaatcagactatgccctcttggaaatgtggtccagatttctctactcccaagctccaaaaaaggtatacattggatgggctagatcaactcctcctgagagccataaatccgccaagagttgttttccatgtaaagggtgtggtacaatggggaacacctgatgttggaggaaagcaggaggactttagagtggagttgcattctaatctactctgccgcttcaactatgtgacctggggcaaatgatataaactctatgagcctctttccttatctttaaaatgaagagaagtaatactaacttgtaaggctgtagtgaggattacatgaagtaatgcatac

SEQ ID NO: 490828 - DNA, 203 bp, Homo sapiens
ctccacactctatgcttactgggtgctgttaccgtcgcaggttactgcagatcaccgtggacagcatcaccatgaacggtagaggcatcgctgcgctgagggctgccgagcgctattgctgacacctggcatctctctgctgaccggcccaaccagccccattgccaacatccagagcggcatcggagccagtgtggagagag

SEQ ID NO: 490829 - DNA, 108 bp, Homo sapiens
ggtaccaaacgcctggattgataacttgggggaagggacgcccatatcgccttctggtagagtgtctcatggaagaggatgacactctaccagaagtgcgcctgggtg

SEQ ID NO: 490830 - DNA, 1059 bp, Homo sapiens
ggtttcaggagaacgtggaaagcaaacacaggggagtcccggggcaccaggaattctcggggagtttgcaagagtgtggccttatttgggtatatatcccgcaagtgaccaaacccccccttggaagtaaagtgcccccgacccagttggccaccgtggggcaatacacgcgtggggtaatagggagggccttccacagggaaaccccgggagtatttccccccggagtagagccccccggtgccccaaaggtgggggacacgagcgcgtggacccacacatggcccctccttagagccccccctgggcgtctccccccccgcggaatattgtcgcgagatgtagcctcccccagagaggttttgtctgtgggggacacccggctattagcgcgaggcctttagaggctttaatccccagagtgcacctcgccaaccgcccctgtggtggcacactccccgcagttgggtgcccctctctggggtgttcccccacgagggattctgaccccgccgtagggtgtttgggtgtggccgcccgagccagcccagaaagagtgttccctcggagagttctcccgaagacctcgtttcccttggacccctctgggccggagagcccccccggggctgcccctgtgctgcttctggtcgggcaccccattgcgctgaggggcttccagacccgtttcccccgggttgcctcgtacggccgaagccagaacgggtgttttccccccgcacattttgggaggcttccccctggaagactcttgtgcccaaaggtgggagaacaagaagctggagcacctctaggggtggtctcccgcccaacaacacccgcggtgtggacccctggaccagggggggagtacacccggccccctgggaacacacaggggttacacttacgaggctcttggtcccggggccaacccagattcagacacccaaccacttccgggctgcattattcccccacccggttccccaccacagccttttttcccgcgtttttttaaaaaacgcacccctctttaaacaccccttcggaaaccca

SEQ ID NO: 490831 - DNA, 387 bp, Homo sapiens
gaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctttgactttgtatgatgcttatttgtggatgaatgggcaatggaaaaaatgtaaggaccagtgtaataacccgtattgggattttgaaaaaggggttaaattggggttagttgaaaaaaaggttcaaaatgggattttggttttcgggaaaaatttttacatttttggggaaattttaaaaggggggtt

SEQ ID NO: 490832 - DNA, 2018 bp, Homo sapiens
  misc_feature (1731)..(1731): n is a, c, g, or t
  misc_feature (1829)..(1829): n is a, c, g, or t
  misc_feature (1907)..(1907): n is a, c, g, or t
gcccactcagctccaggctagtgttctgcctgagtacccgcaatgaactcgggtgtgtcacgtagggtcatgatggcaactcacctgccttttgcacgggctgcatgacattcatcaggtggctgcaagacagcacaggaatgtggttactctcttctactgttcgctgacgccgggttgtaacgtctgtggacatgaggagagctaccgggagatagactccatcgtaacgcttttgcatttctctatgttccaagggcacatgcggattcgcagccagttggaactttgcgtaatccccgtctaggtcccgtggttgtttcgtgcgcgtccagaacgcgggcagctagggtaagtgtgctctaccatgttgtgcgcgtccacgcgtctctcttgtgtgcgtttaggctcgccttgtgtgttcatggcgcaccccgaacgcgacccgtgcgaggagcccgccaaggggtcgaaggctcaccatccggcccatgcgcgttagcgcgacctccccaattgttcctcgctcatgtcaattgtggccccaagcaggttccttccttttggccacccgggttctttcggttagaactagaatactcgtctttggcctttgtgtccccttgcgagcgtgactatcggctggtggatcacccttaggtgtggaaccacagttggtgccccactgggccctttcctgggtgcgtctccccactggtgtgtctaagtctttttctaataaggcctagtccggtttcccacacttacccttgggaagattgcgtttaggcaccccccattttagttctttacactggcctaagggtgatcacaccggcttttgggggaacgtgggttctctgttatccacaaaattaatacaatcgccgaaggcaatggtcggacaatgtgggcgaatttcaatggaccattgccgcgttcccaaacaaggaacacacacaaaggattaccaccacacattttattatacatttataatacaccaccatatcataaaccattatttgataccacccaaaacggaaacacggccacaagggcggaggagtatattcaggcacccttacttattaagggaacacaagacccccaagcaaaggtactgtatagcatcacaattgtgtttggcttcggactcccttccacacccgttaatcgaaagttcgtgaaagcccacacagggtactccttaacgttggacaggagcgcgatcacgagttcagctaaaagtggggacacccattttgggaaatcaggtctcagcagtaaccgcgtggggggttgacattcaggggctatgcactgggcgattcacgaatcagcagagaaagtgcccctcataatagagggtcatctatcgcaagccgtatttacttgccacgacggcgatgcaactcaacgaattccctgtgcgccaacggccggccaaagtgtgggacgctacatgtctagacattcaaacaaaggagcaacgacacaagagcgcatcttaaatataaagcaagggatagcccgcaacaggagtagagtgatgactcacacacgtagacaaatgagtactctaagtgcagaaagcccacagcagtacaagctgggagcgaacacaagagctagatcgagagctacagagacatatcactgtagctcagaagaggagagagatacacacagagagacgagaggcgaagaagacacaacacagaaagctanccagacgacaggtatatgactgaatcgcgatcaggcacaacaccagcctacagactgttatgcgataccgaccgcatcacgacgcagacagaggcgtnagcgtagagcgacgttgagctacatatgtgaccatactgcctcgactagacagcaagcgagctcagcgctgacaagangtagaagacggaggaacacacgaacgagtgaagacgctgcgagacccgactacgctggcgcagcactgccgacagctcggcgaccgactcgacagcacgtcacactcgacc

SEQ ID NO: 490833 - DNA, 679 bp, Homo sapiens
gaggcagccgatggccgagctggtgttgctggacctgggtgctggctgcgcctgcgctgctttctggctcccacggcctctcccatgcgctgatgtggagccctggctgggccgggccggcggcgtggaggggaggctcctctccagtggtccagaatgaccatgcattgtccctggggcccttacccaccctcccatgtgatgatccgccataggatgtgtcttctgaccccatgccctgcatgtggcaaatacatgcaatgaggaaatgggcgatttcaaactggtcatgatcgggagcacgtcctcggataccacatccaagcagcttttgtccgccagggctcagctggagtcctacaccaggccgtccatcagactctgattgtatctcttggaggggaggacctgggaaggccttaatgggagtggaaggcaggagcgccaggtgcattagcgcaggctcgagcaaggccaatgaccaagccagtggcattttgcgtgtgcggaccaaattgttgggctaacaatccggtactccaggggatcgaggttgcctggtgcaggggtagttggccatcacgcttcggagcccaaagaataccttgcaaatcagcggcatgaaataacaataattgacttggtaggatcggggcggcttgtgaagggacggctgtga

SEQ ID NO: 490834 - DNA, 620 bp, Homo sapiens
  misc_feature (243)..(243): n is a, c, g, or t
  misc_feature (483)..(483): n is a, c, g, or t
  misc_feature (576)..(576): n is a, c, g, or t
ggcggtggtgaaggtgcaggccgtgggggcggctcagaggtcaggtgactatgagaggcttatatttcgcaacagagttccacacgatgaagaaataacatttgtagttgtcagagaaagaggataggatcattcgctgtttgacacgcaggagtagacttctgtgaaagcgttcacagttgaaacgtcgttgtgtcgtcatgaggcctacgatagatagttacataacgcattgcatggggncagaagagtgagacgatggaacagatagggactctgtcagttctgccgtgttctggtgggacgacgagagacattcgctggggaaaacttagttgagtatcatgcactggtgtcggcaacgccagagggctcatttcagtgtgctattactatctccacggagtgccagtgacaagtcatgttctggtgaaatctgtgttgccgcacttggggatctcctgggagagaccaccttgggangctctatagtggagacagtctagtctacagacagtagcgactggaggcacagttagcgttggggtcttcagtgatagactcccagagaagaangtgtgcagcactcgggaaccggcgaaagggcaggcatgcgaaac

SEQ ID NO: 490835 - DNA, 104 bp, Homo sapiens
gtgaagatggcaaattgtaaccatctctctgaagggcaatttggtggtgggtatcaaaaagcaatgaaggccaggcacagtggctcaagcctgtgaccccagca

SEQ ID NO: 490836 - DNA, 211 bp, Homo sapiens
tatgtagcgagcgtaatccggaattatgggctgaaagggcatctaggcggtaagacaagttgaaggtgaaaacctgtggctcaaccataggcttgcctacaaaactgttgaactagagtactggaacggtgggtggacactacacgagtagaggtgaaattcgtagatgtgtgtaggaatgccgatgatgaagataactcactggacagaa

SEQ ID NO: 490837 - DNA, 391 bp, Homo sapiens
atgaccagaaactacacattgtattaatcaggagttagcgcagtacaggtaccacgtggttgtttccaggatatagaggggcctagatcagactggggggatatcccctccccagggctgagaccaattgacacccttctgcccaagggctggccctcggatccaatccccagcagtccaaaggctgtgtcgaagaggttgatgggagtggagcaaacggtgatgagggttgattacaggcctagggaatgggcgagttataactgtatctcaggaccagtcacagtacagtccctgatagctctggtgctatggctctgtcatctgattgatcttcttcacctccacacaaacagctgctggtccatgtctactccagttacaaattgtc

SEQ ID NO: 490838 - DNA, 131 bp, Homo sapiens
gaacgggtgatgcggttgctgcctgctcccctgcctcccacccacatctggttgatgaacaccgtggaaggagacctgactgatgaatccctgacactgttcttctgcacactctgatgtagcaacgatga

SEQ ID NO: 490839 - DNA, 107 bp, Homo sapiens
acatgatgccaaaatggcggaacagaccaagcgctacgctcaacacaataatactgaaagcaatttagaaccagatatcaaaaatgcacctggcggtattcgtgata

SEQ ID NO: 490840 - DNA, 990 bp, Homo sapiens
  misc_feature (18)..(18): n is a, c, g, or t
gggagctgctgtggggancgaggcgaggcggtgcggaggagacccacccctgtccacatgaagagtcgcaaaggcctccgttgatgcattcacgcctgggcggggtggcggaccggccgaagcgggcggggcttgcagaaccgagctaggggcctggggggcggcctgaggggtcgcaaaagaccttcggcggcttccgacggcgggcggttgcggccatttacacgggcctctgggacgaaaggacacggcggtgttggtgtgctcgttttcattcctccattttctgggggaaccccaaggggtgtggggagaacggtccctacaaggagcaaggccgtggtgtgggacgggagacattggggaagtcagtgggccgagaaggaaacccggggggccgggaaagggcgcaggccagacagttcagcaaggcgggagcgggtacctcccgcgggagaggggcctagtaacaagctgggagcgggggcacctttgggtatgcccggacaagccgaggggaacgaggccccaggggggcgcctgtggggctcgcttaaggaatagggccccgctgagggtgggaaggcgcacaccgactggacggtttacccccgggtccggcaaccccggggggagattcaccccctcctcgggggagaccctaaatcccgggaagcaggcggaggatggggccacgggattaaccaacgagcgaggcggtcggagacgaatcatgcggccggcaagcgcggggacaccaagcgagaatcaacttcgggaagcgacgtaggtcatgccgtggggggaaaggggcggatatggcaaaggggcgcccaagacccggaattcagcatcggcggggagacacggggcgacacaacacacgacagcaaccaggagacgatgttggagaccacggcgaccgcaagaaggaacagcacatcaccagagcgaggtcgcaacaatgggctagagcgagactcacaacaa

SEQ ID NO: 490841 - DNA, 942 bp, Homo sapiens
aggccggccaccgacatggcggacggggagaacggcagcaccacggacaagcggcgcaagacaacgaggcacacaaccacgagaatcacgggcgcaccacccccgggggataccaacgggccccacatcctcccaggagggggatgcccgcaaaaaagccctccccaagggcgcaaaaccgaatcggaaagtcagactccctggcccagtactgttgggccaccaatggagccggcataggtccccccgcccgctccgggtcagctaaacccacagcgtgcttacaacgtttgccgcggcacacagcagcgttccccggtcaacaatgcggacgccccccccaaggggtcccacagttaggacacatcccgcggacacaaacgagaggggcccccaaactttgtgtcgaacaccggggcaagaccacaaatggtgccgccccacgggagaaacaagggtcccacgtgcccaccgtgcgcagaaaagggcacacgacacacaacaaccagttctcgttctcgcggaatcatagggagcccgtgaaacccatagaaggagattcccaggcgcccgctcctctccaacccggagggtccctcatgcccagagagaattcggagaccgcacaagcgtgagatgattggggaactacgcaaactggtgtaagaaattaatatgtggaaaacagacagatggggacaacgcccccacgcgttaacccaggacgagggagtagcgcaacccacaacttattctcagtggaggacccaaatctgggaaaaccacaggttcacatggattggcagtgtgcctccgaaacccggtcgccggggggaagttcctgcccaccccctacccaccccgcaagaggagaagtctccttattggccccagaggggcattcccataaaaaattcttcagggggaacggcaaaaaaaaca

SEQ ID NO: 490842 - DNA, 194 bp, Homo sapiens
taaatccacagagtgggtgagatgatgagtttggacatttaaatgagagaatgatgctcccaatcaagtaatttcaaggatttgattgacttttttttccatgtttatggatattacttgttcctggttaacttccaggactcaaactgagctctaacaacaaaagccactggcattcatgagtgagaagaatg

SEQ ID NO: 490843 - DNA, 266 bp, Homo sapiens
ccagttacacagtggaatataggcagactgactaaccttgcctgtattttcttgtaggcaggcagaaaatcagaggcatcaacgatctggtagataaaaattttttagagtttttgaaaactttgagtacaaattactggtgtacatatagataaaactagtatgtagacgctttgtacactggggggatcctgctactactcgagtctgacacggcatgcatagcttggtcactggctccgtccgtttttacaacgatcttcgac

SEQ ID NO: 490844 - DNA, 240 bp, Homo sapiens
cccttctaatgcgttgcctaaacggtccatagctgagtgttctgttgtcttttttccaactttattgggaggagggggctcagggaaaacctccgtttcctctttggtatctttatctggtaacggcaggactgagggaggaagaggaggcgataaggtgatggttcctcctcctttcccttcttaggctcttctgtgtagagcaaggccaaagtagccttaactaaggcccataacgtt

SEQ ID NO: 490845 - DNA, 271 bp, Homo sapiens
taggaactataatctgtgccctttttttcagctactcaggaggctgaggcaggagaattgttggaacccaggaggcagaggttgcagtgaactgagatcgtgccactgcactccaccctgggcaacagagcaagactccgtctccaaaatgatgataataataataataatgaagagaaggaggaggaggaggaaggaagaagaattgcattacattatgtttccttgtggggccgggtatagtggctcatgcctgtaatcctagcacttt

SEQ ID NO: 490846 - DNA, 178 bp, Homo sapiens
ggtgtatcctttgtctggcctctttatatctgtgatgatggtgcggtcatatattatagggataaaacagaagaattatggaattgacagatgagcaagaaatgactgatgaaaaagaagcagtcgactcccgaagactggacatcgtgtaacatactcacctcgtaaaggggaaaca

SEQ ID NO: 490847 - DNA, 665 bp, Homo sapiens
  misc_feature (600)..(600): n is a, c, g, or t
tgaatttaagacaaagaaaacctgaatgttaaatatttaaaggattataaaagagcagccacattcttggtctatttttgtaggcaatagatatgaagatcaagttctgactggaatcctgagtgacacggagacagcccccacatgtgacccacctgtaggtttccaacaggcatttttccaagagtgagttttggaacattaaattaagagcaaattaaattttctcaggctttgaggggcctgggctgaatttttttaatgtatagaggttagaagcaacgatttaaagctcagtgtcccctatatgggtctaattatgaacatgccactatgtccacattagaatagaactgattgtgtaacaagttattttctatgaaaccctgtaaggtggtgaatgagggaaagtgcccaaaacatgtaaacaagaaaaaaggaactattgacgaggggaatgcttttaactgtgaaagctggaacatcagctctgacagtttatgttcacgtaatgcgaaacggatgtggggtgagctgggccacaagtgagtttcctctttctttggacacaacaagcaacaatgatgtgatgcactacanaactaaaacacccaagtaaatgctatgccaaagaaattggagaccttaaaagaatgacatttcaa

SEQ ID NO: 490848 - DNA, 950 bp, Homo sapiens
gactagttcgagatcgcgagcagtcctcctgctactacatacgaggggccctggcacacatgaaccagaacatgagagaaggacatcacaacatcacaatgaaagataattgtcgttgcgagcatccgtgttccggtccgggcgcggggagccccgcttcatcgccgttgtggctacgtggacgaggacgcagttcgatgcgtgttcgatcatgctgacgcctgggagccgagaagattgtgatgccgtgggcgccggggggatagagcaggaggggccggagtattggggaaccatggcagacactggaagtatgaagggcccaactctgcagactgaccgagcgaacctggggaccctgcgcggctactacaaccagagcgaggacggttctcagaccatccagataatgtatggctgcgacgtggggccggacgggcgcttcctccgccgggtaccggttatgtgacgcctacgacggcaaggattacatcgccctgaacgaggacctgcgctcttggaccgctggcggacatggcagctcagatcaccaagcgcaagtgggaggcggtccatgcggcggagcagcggagagtctacctgtgagggccggtgcgtggacgggctccgcagattacctggagaacgggaaggagaccgctgcagcgcacggacccccccaagacacatatgaccgaacagcccatctctgaccatgaggccaaccttgaggtgtggggcctgggtcttctaccctgcggagatcacactgacctggcagggagatggcgacggaccaaacccagggcacgagaccctgtggatcaaccaatggcttaacgtggggcatgcaccttccaagaagtggccgggctgtagttgtgcttattggaaggaacaactaacactgcatctacaacagaaggttccgcaaaacgcccactgacata

SEQ ID NO: 490849 - DNA, 651 bp, Homo sapiens
  misc_feature (3)..(3): n is a, c, g, or t
  misc_feature (71)..(71): n is a, c, g, or t
  misc_feature (81)..(81): n is a, c, g, or t
  misc_feature (130)..(130): n is a, c, g, or t
  misc_feature (220)..(220): n is a, c, g, or t
  misc_feature (227)..(227): n is a, c, g, or t
  misc_feature (229)..(229): n is a, c, g, or t
  misc_feature (234)..(234): n is a, c, g, or t
  misc_feature (283)..(283): n is a, c, g, or t
  misc_feature (286)..(286): n is a, c, g, or t
  misc_feature (350)..(350): n is a, c, g, or t
  misc_feature (362)..(362): n is a, c, g, or t
  misc_feature (381)..(381): n is a, c, g, or t
  misc_feature (390)..(390): n is a, c, g, or t
  misc_feature (429)..(429): n is a, c, g, or t
  misc_feature (439)..(439): n is a, c, g, or t
  misc_feature (507)..(507): n is a, c, g, or t
  misc_feature (523)..(523): n is a, c, g, or t
  misc_feature (526)..(526): n is a, c, g, or t
  misc_feature (530)..(530): n is a, c, g, or t
  misc_feature (535)..(535): n is a, c, g, or t
  misc_feature (556)..(556): n is a, c, g, or t
  misc_feature (595)..(595): n is a, c, g, or t
atnaaacaactggttcttgctagcctctagataaatcccagaacactcagccctgacacgttaatactctncatcagtatnataggctgctggtcacacagactcaccaagccacatacttgtcttccanaagcacgttcttatcttagccatgaagtactcatagccacatcgtactaaaggttgaactcaaatgatatgtactagggtattaaacaantaccaangngaatngttaacttcaatacaaggtcaaaattagcatcaagttctacaatccatnttntgatatcattatactaagtttcaaggacaatttcttttcgaaggtttattccagttttgtgagnctatttttaggngtttgcatttttctttggnttttttttnttctcaattaacccatgcagcaaatgctacgcatctgcngagtccgttnagaagcatttgcggtggacgatggaggggcccgactcgtcgtactcctgcttgctaatccacatctgntggaaggtggacagtnagnccanggatngagccaccgatccacaccgantacttgcgctctgggggtgcgatgatcttgatcttaatngtgctgggcgccagggcggtgatctccttctgcatcctgtccgctatgcccggata

SEQ ID NO: 490850 - DNA, 959 bp, Homo sapiens
agcggaactggtctaaaatactgttgcattataaattcaacaaccggacaagtgtcatgttaaaagacagatggaggaccatgaagaaactaaaactgatttcctcagacagcgaagactgatagtgtttgtaacaagcttgatgacaggacagttaagtatttagatcactgcatttagtctgaaacttgtgtcattgatgtaatctaaacactttcgtttaaagcattacagtatttactctgtgaccatcaacttaatgagggtttgtgctaccagagttaaagcatatgctatcattgtattcttctaagaaccttattctgataaacatgtaaatctgttgaaccctgccacattctcgtatccccacccccaaatcctgttccaatcgaaaaacttacaaacctgatacgacgaaaacaaagaaattccagttaacctattacggtgtctgtaggctgacctcaaccctgtgaacataacccattcacaatgaattctcttttggcatcaacgacagagtactcatctgttgcccaggctggagctgcagtggctgcaatttcagcatactctgcaacctctgactcccaggttcaaggtgatactccatgcctcaaggctcctgagtacgcctgggcactcaccggaacaccagacaacacgcccacgcacaacaccacgaccaaccacgcacacgcgcggcggtaacaccaccgctggccaccatcgccaccaaactccccgacctccacgacccacccagcaccaagacaccaccacaagagcgcggcaacctaaccgcacccgaaagcccaacgcgacccaagcctcacgagagacactcacaaacgacggaagcacgcgcaagcccagcaccaacagcataaggcaccggaacagcggcccagcagaatacaaccagagcacaaaaacgccgaacgaacacacgacga

SEQ ID NO: 490851 - DNA, 296 bp, Homo sapiens
  misc_feature (13)..(13): n is a, c, g, or t
  misc_feature (47)..(47): n is a, c, g, or t
  misc_feature (182)..(182): n is a, c, g, or t
aatagaaagcctnagaaatatcaaacgtcagaaggacccgagacagnaaatacagtcatgtgttaccttaatgatggggatatgttcccaagaaatgtgtcattaggtggtttagttgttgtgcaaacgtcatggagtatacttctacaaacctagatggtatagactaccggacacctggnctatatagtgtagcctattgctcctaggctacaaacctgtatagcaggttactgtactgaatactgtaggcaattgtaacacaatggtaagaatttgtatatccaaacatatct

SEQ ID NO: 490852 - DNA, 250 bp, Homo sapiens
gatatataggggatgcgcgtgtgcatgtccggcgcatggggctgggatcgattagctaaatgttatttcattggtcagtgtcagaactaggattggatttagattgttatctcttgccacagataggaaaatggagcagatgaggagaaaaaagcatttaatgggagagaacatttggactcaatcactagtgaattcgggggcgcctgcaggtcgaccatatgggagagctcccaacgcgttggatgca

SEQ ID NO: 490853 - DNA, 250 bp, Homo sapiens
tagtgccacttcaggctactattcttcccacctacagcaaaaactcttcctttttagtattcatgctttgtgtctcgtgctgtcaactcgtcccagtctaaatcattggcaattctccaggacactaccctatatgcatggagcatgaccacctcttcaattccatggaaacttacttttaaaccatattagtatcctcctccaggggttatactctgaatctcccattccccataactattccgtacct

SEQ ID NO: 490854 - DNA, 1116 bp, Homo sapiens
  misc_feature (429)..(429): n is a, c, g, or t
  misc_feature (621)..(622): n is a, c, g, or t
  misc_feature (627)..(628): n is a, c, g, or t
  misc_feature (632)..(632): n is a, c, g, or t
  misc_feature (639)..(639): n is a, c, g, or t
  misc_feature (645)..(645): n is a, c, g, or t
  misc_feature (664)..(664): n is a, c, g, or t
  misc_feature (675)..(675): n is a, c, g, or t
  misc_feature (677)..(678): n is a, c, g, or t
  misc_feature (706)..(707): n is a, c, g, or t
  misc_feature (728)..(728): n is a, c, g, or t
  misc_feature (736)..(736): n is a, c, g, or t
  misc_feature (738)..(738): n is a, c, g, or t
  misc_feature (752)..(752): n is a, c, g, or t
  misc_feature (765)..(765): n is a, c, g, or t
  misc_feature (798)..(798): n is a, c, g, or t
  misc_feature (804)..(804): n is a, c, g, or t
  misc_feature (824)..(824): n is a, c, g, or t
  misc_feature (979)..(980): n is a, c, g, or t
  misc_feature (994)..(994): n is a, c, g, or t
cgtctctccccttgtatggttccgcgccgccccacaatggtgcgtgtctccgggcgggttgcccacgcaccttgcgaccaaaggggtgtctgctccccacgggagttcttttcgcccccctccacgggagcccttcctacgtagggtcgcctgccccactttcaaattcgctgcgccacaggtgtttccacacctcccttgggtgagggctttttttataccggcggcttccgctaagcggggttttaagcacctcggtgcccacatggtgtcgtgttagactgaaaacctcttttggaggccccgctccgagatgtgtaaatagtggggcgctctcttgtaaaagaagaaactttttggtcgcacgaagataacctcgtgtttcgtttgcaccaccccagtttctcccacttgaagaggagagaaagngggagacacaactggcctcgagagaaaaacctttgagatggagaaatctggtcacgagatcccccactcgagagggtggccccgaaattcttttcccctttcacagggagatatctccagagagagacacgcccagagccctggtgagatgacacttgtgggagagaaccctgggcgcctgagatgcacacnnggagnntgtngcacatnaacacnctttggagaaaaaaatgtngaaatcacgtncnnctaactggagaactgcacccaaactggnncacctgagccacaaattgagncccccacntnttgttgtggaactnttcacttgaggancaccacttaccctcgaaatgaggccacggtganaagccnctcacaagagattgggtganccaccgtgagcccaacttgccccaagaatgggaggcgcccgaatttggcttggcggaaatattttttttgaacacagcacacacaccctgggaggaccacgtgatatatggaagctaagcctcgggctaatttccccactagccgctggggtgannttccctggtcaccnaggcacgtgcacatgcactgttggggtttcctttaccttttttaataaagttgtacccaaaacaatccacttaagttttttgatttgtaccattccttcaaataaagaaatttggtacccca

SEQ ID NO: 490855 - DNA, 492 bp, Homo sapiens
cgatgccggtgcatgagcaggtgcggcggccccccgcggccggcgagtcacccgagttggcaccatggtaactgtcgcgctggcagaatgatggcgaacgccactggtagaggaggtaggccttgagggaagccggcagcggaagagtgtggatctcccccaggcgctccctccccagggccaggaacaccgagcgacggaacaaatccatgagcggaagaggatcgggatcgagtccgttcaaatagcgcattcggatctcacagtggccccagacggcactcactacaggatacagtaaattgcccttaagtccccaaaaagacactcccatgtactgtccatccacaatgaagctcaaagtcccgtcgtacatgtccaggactaccaggaaggagtcagggacaatgaatgtctcatctggctccagagaggctgagtatgtatagctaggctggtacttgccatcgtggtagagccggttgcgcccaa

SEQ ID NO: 490856 - DNA, 592 bp, Homo sapiens
gtgtctcactctggcacccaggtttgagtgcagtagcatgatcaaagctaactgaagtcttcacttcctgggctcaagcaattctttcattttaaccttccgactagctgggaccatacctgggggccacgcctaactaaattttggatttttaatttttggagagatgaaggtttgccatggtgcccaagcttgtcttgaacttttggactcaagcaattcttctggcttagacttccaagggctgggaattcacggctgagctactgtgcccccccccctactttttaaaataacacaatgtgatgggtattttccagacacgagaagaggagccccttccaccttttatatatatatatacagcagctttttacaccagtgtttaggatgtgtacccggcgatttccccgacgactacctaacagctggtggagagcgtccagaaaaaataatttgttgagaaaaagactttttaccacaaattaaaaggtgttttttttgttgaaatttttcaaaacttaaaaacccccaaaaaatatttttataaacccccaagggggggacccccaaaaaacaatttttttctatt

SEQ ID NO: 490857 - DNA, 87 bp, Homo sapiens
cgagaggacgaccggatcgccggccttgaccgaggaggggagctctatgctcgtcgtgtttccgaccgcgcgataggctggggcgtt

SEQ ID NO: 490858 - DNA, 184 bp, Homo sapiens
gccaggtgatttttctttttttttctcagtagtgacaggtttctccatgtgggctaggcaggtctcgaattcctgacctcaggtgatccacttgcctcatgtgctgggattacaggtgtgagccactgcgcccggccttctttttattttggtataatatttcgttgtataaatctaccggggg

SEQ ID NO: 490859 - DNA, 240 bp, Homo sapiens
aaaaaaaaaaaccttttaaaaccccccccctccacccccaccccttttttgtttttggccaaggggtttttccaattttttgggggttttttttttgggggtaaaaaattttttcccccccaaaccccccccttttttccccccccttttttttgggttggggggggggggggggggggggttttttttttttttttttaggggggggggccccaagggaaaaaaacccgggggtgggca

SEQ ID NO: 490860 - DNA, 220 bp, Homo sapiens
  misc_feature (85)..(85): n is a, c, g, or t
cgatgtcttgagaaaaaggacagaatgaggatcagaagcatgatctttctgagtttctgtccttgctgggagacatagccacagncatttaggtacctaaatggctgtatggctgttgctgctctgccaaggcttgctgaaggcgcatccacttccgaaaggagctggtgaatgctcagtgtgcgaaatttattgatgaacagccatacagccatttagg

SEQ ID NO: 490861 - DNA, 1320 bp, Homo sapiens
  misc_feature (492)..(492): n is a, c, g, or t
  misc_feature (591)..(591): n is a, c, g, or t
  misc_feature (763)..(763): n is a, c, g, or t
  misc_feature (1320)..(1320): n is a, c, g, or t
ctggcccgtctgaggcgctccgacttccagtaggagcgctgtgctcgtggagaagacgcggggactcggcgactctgcactcgcgactctcatgttcgatgagcctgcgtgggccaaggcggccccagtcgtcgcgggccttggtgcccgtagtctcggcgacctcctgctcctggcggtgcttcctcggcagataacaaaggagactccaaagcggccggtcgagtcgtctattggtccaacagtgtaactcgtactccctaacacgtgacttgactattattgttctgcctacttaccgcaccaaactggtatgtataatatctgagatgcttagtgaggaggacgacgtacatgaagaagatagtgcctccatatacatgggtcatccaatttgactcagatggcgctgcttgctgtaacttagcgggaaaggaagacgcggacatgtacatgtacaattgctgaagagaagccagtggtaccaccctnctggcacgtgtaaattctgaaaggaaacgcaagctatgtacaagtgataagtacactaacaatgccacagcaagaaccacgcgcatccattgcttggcncacgatggacagtcctcgcagtcgaaagcagtggagtcacagaacgcaataagtaggggacacagtgaccccaaaaagacgagtagcccgccggtaattgaaatccccagtggctccgaggggacacttgagaactgagactgaattgtaccctaatcaccagggttccccnaaaaacgcacctgtgcaaaaggggttaaggtagcatacgaagagtgcagtccacgcaagaagcaacaggccccctggggttcccacattcccccgtagaaacccccactacaataccattaaggcctgcaaagcagttgggcgagaacccgggacaacaaggaaataaggcagaaaagatgataaggaacaagggttttcaagacccacacttccagggttgccaagacaccaggggccccaccaagactagaagggccacccaaacaagaaagaagaacaagaaggaaggtactcactaggtttcccaaggagacaggaaacaggcacaattgaagcagcatccgagagacagagggcgccttttagcggaagcccccgacaattgggcaacaaagcgtgaattgtgaatatgggggccccgaatttaacggcataacctcaaagtgaaaccaggtgttgtacatcaaggaggcccaacgcaggtggcatggaaacaggcgatactcatcccaaggaaagaaccctagaggagatataagtacatacaacacaacn

SEQ ID NO: 490862 - DNA, 993 bp, Homo sapiens
  misc_feature (640)..(641): n is a, c, g, or t
  misc_feature (678)..(678): n is a, c, g, or t
  misc_feature (744)..(745): n is a, c, g, or t
ggcgacacctttgggcgtgcttcctggtgatgggacagggtcttgtgtttaatgccaatacatgtgccagctggtgcagagacataaaaggacacaaccaatcactagaagatgcctgggacctcaaaccagaaagtaggaaggctctgggcggtagtcatccagtgttcaaggtgcttcaacaccagtgtacttcatttctaccaagcgatccgtccttatcgaccgactatacttgatacatttggacaagctctgttgtacgagcgcatcttttccatgtgtgtggatagccgccagcgtcttgccagatcacttttctccagagaatgcaaatgacgacggccaaggaaacatgcctaacattggtttgggcgaagattgcctccatcagggaactcattccgagggataacacgtggaggctatccatcctgaaatgtaacagattcctctccaaaacgggaatacacattatttgcctgccccggttgactatgtcatgatccgagggatcggagacccactagtgtcggtgtatgcccgtgcctacctgtgccgggtgggaatggaagtggccccacatctcaaagaaaccctaaataagaacttttttgacttcctccttacgtcaaacagnntcatggggatacggtccagaacagctggtggtccaanggagtggagctcccatcttacctccccttgtacccgctgcatggactggatcttccagtgcatctnnctaccatgcccccgaggctctgctgaccgagatgatggaaaggtgtaagaaactaggaaagcaagtgcccttgcctgggtctgaaagtttctcgtgccatgtcgtgcccttccccgggctgcagttcactcgccacaaggtctatggatttcattggcatgattaaagagtgtgatgaatctggtttccccaagcatcttctttttcgagtcactgggcgactttacaaaccctttgcgcccttgccg

SEQ ID NO: 490863 - DNA, 182 bp, Homo sapiens
cacgaagggggatggacacatccatgggggatggacacgccaagggggatggacacacgaagggggatggacacacaaaaggggatggacacactaaaggggatggacacacgaaaggggatggacacacgaaagggtatggacacacaaacggggatggacacacgaaaggggatggacac

SEQ ID NO: 490864 - DNA, 145 bp, Homo sapiens
catcccccctctccgggggagcaccgagtggggacggcggcggggggagaagggtcggggcggcaggggccggcggcggcgactctggacgcgagccgggcccttcccgtggatcaccacacagatgcggcgggcgtcgcggccg

SEQ ID NO: 490865 - DNA, 1143 bp, Homo sapiens
gagtagcagcggggatagcccggggcccggtcttcggtcaagggtatacgagtagctgcagctcccctgctagaaccaccagctggcaagcctccttcctagaggactgcgaacgtcatccctggcgagatcggggcgcagcttaagctgctgcctatgaatgcatcagatacggggagctacagaccatcatccgtggagcaagtaagccgagagcggaaggggaaagggaagtggagggtcttgcaggctgtggagcggggattggaagtaaaaggggctagagagacagtgttctttggacttggaaaacttttggagattggggtaagaccgtgtaattggggtgtgatgtgtagtggtgtgtagagtagtggtgtgtagtgtgagttgtgataagattcggagaaggagaagcggttctactcaaaagaagtagcgggggatgattctcaaaagtccaactgtggggtggaaggacagagaacgacgttgaggaggtagatcctgagagcgcctccttgctcggtctacttcaccggagggaagtaagaagacccctcactgtagggcaccactagaccccaggtgcgatagatagaaaccatccccgtactaactcacttagttgtggcggagcacggtggcggttggctaccgaacgttcggtcataaacgccttaatgacacaccaaggaaagcggtggattatcttactacccaaaagcgtttgatggccaatacacacgaaccacacatccaaccatcacggggctaaaacgacacaaccaggcaaagacacgccgcaaaaacagaaaagcaagagcacagacgctctcaaacccagggggcccgcagaagccccaaagaggagcttaagagaagacaaccgaggaagaaaagaaaagaggcccaaagaaggacaccgagacgaacgaaggggtgaccgagtaagccagtggagaagaacaaagtgcccaccacatacctacaaacgttcgccgcaggacaccacagcagcacagcagacaacgaggtaatcacgcgagggcagcacataaaagcgccaccccacgggggcacaaccaaaaccacacaaaaacaccgaggggcacacgaaaccaggcaggaaaccaggggccc

SEQ ID NO: 490866 - DNA, 558 bp, Homo sapiens
gcacgagcccaatttttgaatttggttcttaattctgctatggtattcctctttccattcccagaccttaccaacaaaagcttctcttccatagtcatgtctagtctttctgttcttagcccagatttgcttctccacaacggactgagtagcaataccagcatggtcgaaacctggcaagaataagacagttttacctttcattctgttatatctgatcaaagaatcttggatggcaatagtcaaagcatgaccaatatgtaaggcaccagtgacatttggtggaggtgctggaatgcaaaatacaccttctggtttaaccttaccatcagcggtaaattcaggttcaaaaacaccagtcttgatccaccagtcataccaagaactttcaacgttagcaggattataagcttttaaagccggatcatccaaggatactaagatttttttctcacctggaacagttttgtcaataaattcagggattggctcaacttccttctttttcttaggtttcttttgagatgcacctgtggtggcagcagcattttttttagc

SEQ ID NO: 490867 - DNA, 1497 bp, Homo sapiens
  misc_feature (1496)..(1496): n is a, c, g, or t
tacgggtttaaaaaaagggtgacattggcttatatatacatattgggacaggggtggggccgtgcaagtgaggggggtcagggggtgcctcaggggagatgtggggtgggcttggtggaagattgatgtgacaagaaagggctgtgagaagagaaagggggggtgggattagagaagggcccagggcgccaaggggtgctacccacaggtgtcccggctctcggggagaagggagacacgcctaggaggagaagggaggctcctgggcacagccaatacctagggccacacaactcaatataacaagaacatcctggagaaaacatacaaacgcgtgcgaaccaaatacacagggtggggtggctccacagtaacctacacaacacaaggggcggggcccaaggagagcccccacaggggggcgcacataaacgggggggacccctagcgggagaacacgggccacggataaagtaccagagagatcacaaagggaagagctatataaaggagaaccaccacgaggtccatgggcggcgagcaggaggcgtcgcagcttatataaccccccaatcctctattaccacagcacaaaaaccttacccgcgggggacaacacaccacggcaaaaatcaccggggggcacacctgcgatagagaccacgccgacaaccaaccaccacgagccaaaggggcgcgcgaggcgaaaattattgcggggcccaatgtatcgagggcacgctcctgacaacagcgaagcggccccgaggaaagcgcaccatgagcggccctagggacacgccggcgccataaaaacaacctcctggagagacccccgcccgcgacggcaggcccggtcccccgggcaagaccccctcatcccctcacaagggaggaaaccacaacctacatcctcagaggggcactcaaacagggcaacgcaggcagccggcgaaacaaccgccgggccaccctcacacggctggccccacggggaacccaagagcggagcaaccacgagacccccacaggaatccctgtctgcaccacacaggggggacacacctcgggcgggaaccccccacaaaacgagggccgccgaataaaatgccgacaaaccgcagggtaacccggcaagtaaaaaaatccgccgcacacaaaaagcaacaacaaaaagaagagcgacgaacgacacagcgcacgacggaacaaagaggcgggccaacacacataagaacaacaaacacgcgggagcgacacagaccgaacaaggacgcgaaaaaaaccacggacaccagcagagaaagaccagacgacacgacagcagccacgagcaagctaaagacgcgaggacagagcgagagcaacaccaagcaacgcgagcagccaaacagcgaggaagcgagacagaacacagagcagacgggcagagcgaaggaacagagcaagcgagaggcagaagaagactggcgacgaacacgaaccagcgctccagna

SEQ ID NO: 490868 - DNA, 303 bp, Homo sapiens
ttttgtcttttaatttaagccttggtggagcccttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtggctatagtcccggctgctcgggaggctgaggcaggagaatggcatgaacccgggaggtggagcttgcagtgagctgagattgcg

SEQ ID NO: 490869 - DNA, 228 bp, Homo sapiens
ggtcgaccaaaaccaagatgaagagacgagctgtatgtggtctggactgtgggttctggattgagacagtgggtggcgggtcctggacgttccaatcgcctttccgctgtaagggtaagttcggcattcggagacttgagggatttgaaggaccattggcggctctctacttctttaggaattcctgggctattataaatggggttatttattgtaaaaaaaaagtcg

SEQ ID NO: 490870 - DNA, 886 bp, Homo sapiens
  misc_feature (67)..(68): n is a, c, g, or t
  misc_feature (82)..(82): n is a, c, g, or t
  misc_feature (99)..(99): n is a, c, g, or t
  misc_feature (101)..(101): n is a, c, g, or t
  misc_feature (115)..(115): n is a, c, g, or t
  misc_feature (118)..(118): n is a, c, g, or t
  misc_feature (129)..(129): n is a, c, g, or t
  misc_feature (138)..(138): n is a, c, g, or t
  misc_feature (182)..(182): n is a, c, g, or t
  misc_feature (188)..(188): n is a, c, g, or t
  misc_feature (193)..(193): n is a, c, g, or t
  misc_feature (207)..(207): n is a, c, g, or t
  misc_feature (210)..(210): n is a, c, g, or t
  misc_feature (213)..(214): n is a, c, g, or t
  misc_feature (217)..(217): n is a, c, g, or t
  misc_feature (219)..(219): n is a, c, g, or t
  misc_feature (222)..(222): n is a, c, g, or t
  misc_feature (254)..(254): n is a, c, g, or t
  misc_feature (274)..(274): n is a, c, g, or t
  misc_feature (441)..(441): n is a, c, g, or t
  misc_feature (500)..(500): n is a, c, g, or t
  misc_feature (523)..(523): n is a, c, g, or t
  misc_feature (543)..(543): n is a, c, g, or t
  misc_feature (548)..(548): n is a, c, g, or t
  misc_feature (576)..(576): n is a, c, g, or t
  misc_feature (590)..(590): n is a, c, g, or t
  misc_feature (604)..(605): n is a, c, g, or t
  misc_feature (637)..(637): n is a, c, g, or t
ggctcaccccaggaaggagggaggccaccgagctactgggccgacggactcgcacactagttcctgnngctggtgccaggcnaggtgacacctcctgcngnccccagcatgcggngcnggcgcaggccncaccgttanattggcctggtgctggcggtgtcatgggccatggagctcaagcncacagnaccanccatcttcactggncgncgnnttngnagntagcgtgggacgtgcccacacaggactgtggnccacgcctcaaggtgccacnggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggnatgatgctgcagaaacgtgtggagcactacattcggacacaggagtctgcggggctggnggtcatcgactgggaggactggngacctgtgtgggtgcgcaantggcnggacaaagatgtgtatcgccggttatcncgccagctagtggncagtcgtcaccctnnactggctccagaccgatagtcaaacaggcacnatatgagtttgagttcgcagcagagacagttcatgctggtagacacatgcggttaatcgtcataggcacgtgcgggcccggtgaccctctggggcttctaccttctttcctgactgctacaatcatgattatgtgcaagaactgggagagctactcgaggtccgctgccctgatgttgacgcgtgagaccgcaatgaccatgtctggcctgtgctgtgggctgagagcacggcctcttcccgtctgtct

SEQ ID NO: 490871 - DNA, 249 bp, Homo sapiens
agatgcggtgcaggagctgccactgctgcaaggagacaccgatccgtttgtagaccatctgcagccagtgaagcagcacagagagcaggcaggggtaggcctccgagtactgcagctgcttgtggatcaactcatacatctggaaagcactctcggggtcgatgtggaccatgacaaacctcctgcctagctccaggtcatgctcattacgcaccatctcgaagaagtctaaatgtttgtccaggatgg

SEQ ID NO: 490872 - DNA, 1049 bp, Homo sapiens
  misc_feature (506)..(506): n is a, c, g, or t
ggtggtttcttcttctctgcaatccctcttgcactggccaatcggatcattctccaacacagttcttacagtggctactacatcaggtgcactctcttcttcctggcaggaatattttagaaggctttaccaagaatgtggaattacactatggctttaagaatttggccagacacgaggtcagaggaggacagagcaaacttcagaaatagacaaggtcttactctgctacccaagctggagtgcaatggtatgatcatagcttactacagcattgaacttctggattcaagagattcccccacgttggccacccaagtagctggaactacaggcatgtaccatcacacccagcttatatatgtatataattatttttggacatacaggatctcactacattgcccaagctgctctaaaactcctggcctcaagatgatccttctgcttctgcctctcaaagtgctgggattataggcataaaccaccatgctcagtccaatgtnttaatatcagatactctttagtatctttaagattttatacactgtgtatgcattagttaattattaaattttaaagaagtacaattctatggataacaagtatatccccatattaccaaattaaagagacaaaaggattagccagaaccatattaacagaaaccgttgacgtcaagtaacacacacagaaacagtccacgcaggagaaagagccatggtcggaggcggcgactcggcccgcgcagaagagcgttagaaccgctagagtatataagcagccggaggccacacaccaaagacaacagcaagcaagatgggcaacaaaagcgaggctgccaccagaggaaaactcgcgtgaacacaacacaaaaagggcgaagaagaaataaagaacacacacaagatataagaacacagcgcgggggaggacacccaggagcgggggtccgtcaaaaacacaccgaggagagagccgcgtagacgccatcgacggcggccatccacaacaaggagaccacaaggcgcgccagatataaataatgc

SEQ ID NO: 490873 - DNA, 113 bp, Homo sapiens
atacactattgtgcaaaaaaaagttttcactcaattgaaattgctagtgttaactgaattttgtctagactccatttctgttgatgaaataaagacatatcattatgcattgt

SEQ ID NO: 490874 - DNA, 552 bp, Homo sapiens
gacgccccggccccgcgtgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaa

SEQ ID NO: 490875 - DNA, 440 bp, Homo sapiens
gacgccccggccccgcgtgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctccttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaa

SEQ ID NO: 490876 - DNA, 232 bp, Homo sapiens
gagagagagagagagagagagagagagagagagagagagagagagagagagagagagagagagagagagcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaa

SEQ ID NO: 490877 - DNA, 225 bp, Homo sapiens
  misc_feature (2)..(2): n is a, c, g, or t
angatctgtcgaactggagcggccttgagcagcggtgaaggggccgctgcgggaggacaccgggccaagagttgtagggcttgagggccggcccgcaagagccactggagatcatctctggctcagctctgtctcttgcttggagatgctggactaaaggcactgcctttgctcacccagtaggtcttcagagtcacttcagccaacagcttcctcttcctcagc

SEQ ID NO: 490878 - DNA, 222 bp, Homo sapiens
  misc_feature (53)..(53): n is a, c, g, or t
atcatttatattcatttaccgttctttaatacgaacccaatctaccccctgantagggacttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaa

SEQ ID NO: 490879 - DNA, 1038 bp, Homo sapiens
gacgccccggccccgcgtgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgcccctttcctttcctacctgttcttcccttgcagtggtgtattagccttggacattaaaacatttgctttgtaaatttggaggcattctgattaaacagctgagtaaaacaaaaa

SEQ ID NO: 490880 - DNA, 732 bp, Homo sapiens
cttgggcatcctgtaaatgtaggtgggaaagtaaaatattatcagtggactggaataaatcttatcaccacaaaaacatgttcctaatgctactgcgtcttttcagtttgttcttaaacctgagggttaatcactcttgtgacagacttggtgctgctacacactttttggtatagctatattagtaagaactcttggttccaggtctgaaacccagtcctaataaactggcttaggcaacaaagggcatttattgattcatgtaactgagaagttttaagtagtttggcttcagtcttaggcaggtcttcattacgtggtgataaccacattgaatctttcattctatccctttaccaaccagcagcaattctctttccagtagtgttcataaaatccaagtactgagtctcaatggaataatgtagatcacatgctcatttctgaaccaataactctggccaatgggatgaacaggggactgaccagaacctggagtcacattcttatatttgatattctaacaggcaaggaggaggaagaacgttctctaaagaaaaaagataggtggtattaccaaggacacggtttcatgtgaaatttgtttgaggaaacaatggggcacttgtcctgcaaaggtttctccatggttattcaataacttgggatcacttactttcgcaccagggggatttaaaaaatggcccctggtttcaacttacaactatgtgc

SEQ ID NO: 490881 - DNA, 828 bp, Homo sapiens
gacgccccggccccgcgtgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggataggccgaaacttggggagcctctagat

SEQ ID NO: 490882 - DNA, 1079 bp, Homo sapiens
  misc_feature (559)..(559): n is a, c, g, or t
  misc_feature (572)..(572): n is a, c, g, or t
gacgccccggccccgcgtgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaaaaaaaanaaaaaaaaaaaanaaaaaattgggggggggcctccggcgccctcgagaaaaggtttctaaagaaccaactcgcggttggggcgcgcgcggggcgcccaagagagggaacgggagacactgtgggccaaaagcgcgtggtgccccaagggaaacccgggcgccaaagagaaaaggggcggggagtattatctacacacacaatataaaaaaagaggcgcgcgggggggcgaccaacgcgagaggcgttcgcggaaacaaaattccccgagaaggtggagcacgcgagagaggggccacacaaaacagagggggagcaccccactatcacacgaggggggagttcccccacggggaggaacccgcgaaaaacattcaaacaatataacggccccggggcgtggtggggagatacaaaccaaagaacgacaccacaagcaagacaacctagagacagaagccaaaagaacacgaaaaacacacaaagaacacagaacgacacacgaaaaaaaccaacgacgcc

SEQ ID NO: 490883 - DNA, 652 bp, Homo sapiens
  misc_feature (559)..(559): n is a, c, g, or t
  misc_feature (572)..(572): n is a, c, g, or t
  misc_feature (621)..(621): n is a, c, g, or t
  misc_feature (638)..(638): n is a, c, g, or t
  misc_feature (648)..(648): n is a, c, g, or t
gacgccccggccccgcgtgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaaaaaaaanaaaaaaaaaaaanaaaaaaaaaaaaaaaaaaaaaaaaaaaaaaaaaaaaaaaaaaaaaaaanaaaaaaaacaaaaaaanacaacaaaanaaca

SEQ ID NO: 490884 - DNA, 956 bp, Homo sapiens
  misc_feature (35)..(35): n is a, c, g, or t
  misc_feature (56)..(56): n is a, c, g, or t
ggtgattgccagtcctccggagtggagatcccagntcatttaaagtggtctaagtnccggatgacataggggtagatttccttatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgcccctttcctttcctacctgttcttcccttgcagtggtgtattagccttggacattaaaacatttgctttgtaaatttggaggcattctgattaaacagctgagtaaaacaaaaa

SEQ ID NO: 490885 - DNA, 284 bp, Homo sapiens
tctagatccggcgagtgattgtcaaccttagctaacagttggaggcatgcagcagattgtggagtcaggttcacgacagtttgtgcaaaatagtgatctcctgcctcagctactgagtagctatgactataggtgtgcgcatcatgctcagctattttcttcatttttttttaaagcaggcgtccactattttgcccaagctgctcttgaactcctgggctcaggcaatagtggctcaagctcccaaagtggtaggcttacaggtgtgagccattgcagtccgg

SEQ ID NO: 490886 - DNA, 185 bp, Homo sapiens
caccattaccggatgtgcccccactttgcggggcttaaactcatcccccggcacacgggatggaccaccctgattggcaagggggcacgggggttgcccctttcccccgactaacaccggttgcatatttgggctagcttctgggggcacgggttctttaaaagggatatggtggaccctttcgc

SEQ ID NO: 490887 - DNA, 815 bp, Homo sapiens
gtaccaagccatgtaatggtaacttggactttaataaaagggaaatgagttcaaataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgcccctttcctttcctacctgttcttcccttgcagtggtgtattagccttggacattaaaacatttgctttgtaaatttggaggcattctgattaaacagctgagtaaaacaaaaa

SEQ ID NO: 490888 - DNA, 348 bp, Homo sapiens
agggagatggggtacgtggagttgatggagatggtgtaggtggagttgagggaactgagcatggcacagtcacatcctggctgggattcgtgtagtgcttcacgtggcatgtcacgaaacttgacggctaggcactgtgtgaccggcaggatcagctgactgctcgtagtgtacaggtccccggaggcatcctggctgggtgtgaagtctctggcgggtcacgccctagtccgctctcgctccagatcacactgagtggctcctaggagaagaagccctggaccaggcaggcgatgaccacgttcccatctggctgggtggttgcaagaaagtcagcaggaagacctt

SEQ ID NO: 490889 - DNA, 401 bp, Homo sapiens
gatgaacttgaactcgcgaatccggatcgtctaccacggaccccgccgcggtagtataaggacctattacatacaaaaactcttaggtgggaaattgaggtatcaatttatatatcacagagggtaacacattttaagagcattttcagaatgaaaagcagggatgaaaaagattagggaaggggaagggtgggctttctaacggagagtaaaacccagcttttttttaagggaggtaaaatgcattatctgtcaagattttaagattttccatgaaatggctgaaaaacaagattcttcattgaagggaggatctcccaatgggaaactgggtctgaaaagagcctcgggcttttttgttttgtgtgattgtatacccccgccccccccccctcctgttt

SEQ ID NO: 490890 - DNA, 220 bp, Homo sapiens
gatgccgtgatctatgttctccgctgatgacctgtggtgcagcatctccttcaacctggcagtgtctatcaccatcatcatttgcttcttctacccttacatggagggcgcgtccacagttcgtgctggactcccctctcatctcatttgctctttggccggcatgtgcttggacctggcagttacttggccatcggaagagattctcccaggcaagctg

SEQ ID NO: 490891 - DNA, 670 bp, Homo sapiens
tttttccataaaggtctatttcattatgggtgggtagcgcatttaacagttaaactacttttaaataatgtataggtgactgcaggactgcagcatgtggtaactagaataaccaactagaaaccagcttaacaaagaacgtgctcgtaaattactttaaaattacgagcctcttgtggtgtgaagattcactccctttgtgctttgtgactcattcttatctttgcgcgggaaaacaacgccttgcctgcttggtctccacaatgtggaacattattatttaaaggcccaaattctctctgatgtatccatttccacacagagggttctctttctacagcgtgagagttaaagccttccaacttccagtggcagaagcccaaccctttggtggccctccaagcatttaagtgctcatgtcccattcttacgcaagaagcacgacgcagtggtaacgccttcagacaccatggccgtcagaagctcctgagtttatagcctaactccgatttacagctacgagttcgttgacttctggcagcaaagtgaaagcagttgggcatccaagctgatattctacgctgcaatgccaaaaacgaggtgcagttggtacctgatgtccaacgcaaggttcactgacgtgtcaagatcttcacaaactttctgatca

SEQ ID NO: 490892 - DNA, 101 bp, Homo sapiens
attagctttgattgaatgtgtaactagaccagaggcattcccacccccacccccacccctgttcatctccagccaggctgacagagtgagacttcctagta

SEQ ID NO: 490893 - DNA, 217 bp, Homo sapiens
ggaagaagggcgaaggggaagcaggcaccttcattcacatggtggagcatgaggaagaaagagaagagggacgatgccacatacttttaaaaaccagatctcccgagaactcattcactatcatgagaacagcaaggggcagtccacctacatgattcagtcacctccttcaggcccgttgtccatgctggggagtacaattcacatgaggatttgg

SEQ ID NO: 490894 - DNA, 782 bp, Homo sapiens
  misc_feature (13)..(13): n is a, c, g, or t
  misc_feature (62)..(62): n is a, c, g, or t
  misc_feature (69)..(70): n is a, c, g, or t
  misc_feature (103)..(103): n is a, c, g, or t
  misc_feature (113)..(113): n is a, c, g, or t
  misc_feature (118)..(118): n is a, c, g, or t
  misc_feature (130)..(130): n is a, c, g, or t
  misc_feature (154)..(154): n is a, c, g, or t
  misc_feature (195)..(195): n is a, c, g, or t
  misc_feature (242)..(242): n is a, c, g, or t
  misc_feature (430)..(430): n is a, c, g, or t
  misc_feature (436)..(436): n is a, c, g, or t
  misc_feature (457)..(457): n is a, c, g, or t
  misc_feature (479)..(479): n is a, c, g, or t
  misc_feature (501)..(501): n is a, c, g, or t
  misc_feature (517)..(517): n is a, c, g, or t
  misc_feature (526)..(526): n is a, c, g, or t
  misc_feature (554)..(554): n is a, c, g, or t
  misc_feature (560)..(560): n is a, c, g, or t
  misc_feature (593)..(593): n is a, c, g, or t
  misc_feature (695)..(695): n is a, c, g, or t
  misc_feature (767)..(767): n is a, c, g, or t
cgcctcggctcgnagaccggaccgggcagagaggcgccgacatgcctcaacctgccttcacnaaggaanngggaatgaacagaaaagcttaaggcccaaaggncaaggaaagngggcngaggcctagatncagacagggaagccgaaccggaancggaccgtggctcgcgctgtccccgggacacagatcgaacnttagacacacacagataacacgtaagacagccggtggaacgcggganctggggcggcgcgcggactgggggccatggcgtctgtgcaggcgtcccgccgccagtggtgctacctgtgcgacctgcccaagatgccgtgggccatggtgtgggacttcagcgaggccgtgtgtcgcggctgcgtgaacttcgagggcgcggaccgcatcgaactgctcatcgatgccgcccgccanctcaancgcaccaccgtgctccccganggccgctcgcccgggcccccgnccttaagcacccggccaccaangacctggcggcggcancaccagggngccccagctgccgcccccgcaggcccanccccanccgtcagggaccggcggcggcgtgtcgggccangaccgctatgacagggccacatcatcagggcgcctccccctgccctcgcccgccctggagtacactctggggtcccgcctggccaatgggctgggccgtgangaggccgtggctgagggggcgcgaagggccttgcttggctccatgcctggcttgaatgccccctgggctgcntggcagctgcagtgt

SEQ ID NO: 490895 - DNA, 350 bp, Homo sapiens
cccttcataatatcaaaagtagacaaaataatgcaatggaatttgtgttcctcttgcccaggttcaacaatacgaatgcatgcccagcgaggtttcacctgttcccattggatcattttgaagcaaatcccaaatttcatcatttcatccacaagtgtttcagaatgtatttctaagaattctttaaaaaaaaacttaacacaatgcaattatcataccaaatacaacaattccttaacatcattacatttccccaactgtctaagaattttttttaatagtttgtttaaatgagaatccaagtaaggtctatgcgcggcaaatgacggattggtttcttaagctgcttt

SEQ ID NO: 490896 - DNA, 769 bp, Homo sapiens
  misc_feature (24)..(24): n is a, c, g, or t
  misc_feature (64)..(64): n is a, c, g, or t
  misc_feature (68)..(68): n is a, c, g, or t
  misc_feature (78)..(79): n is a, c, g, or t
  misc_feature (81)..(81): n is a, c, g, or t
  misc_feature (83)..(83): n is a, c, g, or t
  misc_feature (85)..(85): n is a, c, g, or t
  misc_feature (92)..(92): n is a, c, g, or t
  misc_feature (131)..(131): n is a, c, g, or t
  misc_feature (138)..(138): n is a, c, g, or t
  misc_feature (163)..(163): n is a, c, g, or t
  misc_feature (176)..(176): n is a, c, g, or t
  misc_feature (181)..(181): n is a, c, g, or t
  misc_feature (185)..(186): n is a, c, g, or t
  misc_feature (198)..(198): n is a, c, g, or t
  misc_feature (216)..(216): n is a, c, g, or t
  misc_feature (219)..(219): n is a, c, g, or t
  misc_feature (296)..(296): n is a, c, g, or t
  misc_feature (355)..(355): n is a, c, g, or t
  misc_feature (364)..(364): n is a, c, g, or t
  misc_feature (367)..(367): n is a, c, g, or t
  misc_feature (377)..(377): n is a, c, g, or t
  misc_feature (496)..(496): n is a, c, g, or t
ttgtttgtgtttttcaatggtccnggcgcagggaatagggactttaataggtaccgcgtttgtntggngtactatatnncncntntgttggngctgggcgcagtggctcgtgcctgttatcccagcacttnggggggnggaagtggggaggtcacttgtggtnaggggtttggggncaggntggnnggcatggtgtgnccgccgcctgttcttgangtncggagcttagccgggcatggtagtgggtgcctgtgatcccagctgctcaggggactgtggcgggagaatcgcttgancccaggaggcagaggttgctgtgtgccaaggtcgtcaccagtgcactccaacctggggntcagtgggngtnctctgtaacnaagatattaaaatgttggggccgggcgcggtagctcacgcctgttttcccagcgctttgggaggcccaggtgggggggtcgcttgggcccatgttggacaacgctgtctcttccaaaanattttagccgggtgtggtggcacacgcctgtggtctccgctaggaggctgaggtgggaggatcacctgagcccaggaagttgaggctgcagcgagctgtgatcgagccactgcactccaggctgggcgacagaatggggcccagtctcaaaaattacaaaataagaaaagtcccattgttcccaagatggtttcccgcctttaccccagatgtgtgaccctgagcaaaaaaacctttctgtacccaactgcctcatctataaaatgggggtaa

SEQ ID NO: 490897 - DNA, 422 bp, Homo sapiens
  misc_feature (396)..(396): n is a, c, g, or t
gaaaccctgattattgttagagagttatttccacgaagagtttgtcaggtagttggagatttgagacccgatgaaaggccgtttctggtaacgtaatcggcttgggtgtgatgtcaacaacgtggggtaggaatctttcagagcattacttagtcggagaccaggaaccttgggcctttaaaggtggtctagcatgagatgtacaggtctcaatatgagtttacaactgagttgacattctgtttgttttatgagaaaccttaagttgcgcattagatgggtggatggattggcatgaccaacgctgtctagtgccaaagtcaatatacttacatagctgggagtttaaatctaagtgtcctcatgtgtaacaagcatattttgaggcgatgctgngtgccacacacgccttggcgcatggg

SEQ ID NO: 490898 - DNA, 835 bp, Homo sapiens
gtggccatgctctgtgcgtttctgtccctgttgggctttttgtgacttgctattggtgtccccggtgcctgttatggggcgtctgctttttacagtgttttgccttggccagggggcgttgccactggccctccttgtggcctctttgtgggagtgagtgcgccctgagtcggtagtgtcatgagttgtgggcttgtctttttcgacgcttttttatggtctgggtttggtagatatgttatccacctttctccactcttcgtgtgagcacttctggggcgcgcttgcccctgggcggatatgagggtgtttttctctttgtctcttgtgatgtcctgagggcacgttgcaccaccacttatattgtgctcgttgttggtggagagtgtgctgtggcgccagaggagaggtgtgtctagggcctgttcgcctttgtccgcctctatctgccttcacggggaggaagtttcttattcttctagcgtttggtgtttccacccttgagggttgttttctgaggagagggcttgggacccagagagtgctgtcactgcttagttatagcccgggccacggaattcctatctataatcccgcttttgttttgtgagagtgtgtttggtccgctattgagttgttttatagatatgtccagtttagaatttccgaaaaacccttttttgttcttgagattacgttttggggtaatattttcaaatgacgagaccgttttgtagacccctgtgagaatacctatgggaagtatataccaattcccagtgtatacccaacgaaggccaattctttaatccaataaagcgccattataaaatga

SEQ ID NO: 490899 - DNA, 132 bp, Homo sapiens
  misc_feature (21)..(23): n is a, c, g, or t
tggggtcgtctagaggatccnnncgtatatgtacagggaaatatataagaagaaaaatatttttacattaaaccttttctaaaaatggtaaatagaaaaataattggttttttatcaagaacaacacttatc

SEQ ID NO: 490900 - DNA, 282 bp, Homo sapiens
  misc_feature (2)..(2): n is a, c, g, or t
  misc_feature (12)..(12): n is a, c, g, or t
  misc_feature (22)..(22): n is a, c, g, or t
  misc_feature (36)..(36): n is a, c, g, or t
  misc_feature (44)..(44): n is a, c, g, or t
  misc_feature (73)..(73): n is a, c, g, or t
  misc_feature (83)..(83): n is a, c, g, or t
  misc_feature (127)..(127): n is a, c, g, or t
  misc_feature (168)..(168): n is a, c, g, or t
  misc_feature (196)..(196): n is a, c, g, or t
  misc_feature (200)..(200): n is a, c, g, or t
  misc_feature (234)..(234): n is a, c, g, or t
  misc_feature (241)..(241): n is a, c, g, or t
  misc_feature (245)..(246): n is a, c, g, or t
  misc_feature (258)..(258): n is a, c, g, or t
  misc_feature (268)..(268): n is a, c, g, or t
cnttcgggtctntcagggttgnaaagaccaagccgnaggaccgngtgtccgttcatagctgatgtctttggcnagaacaccgngggctgttacttgctttgagatggaaggggtttgcatttacgcnggtaaatgtattcatccgtaatttatgtaaggttttttttntacgcgaattctcgattctttgtaaganatgnagaacgaaattttggttttctactgttatgtganaacattncccnncaacacgtcatntgtaaggagnataaaatctcccct

SEQ ID NO: 490901 - DNA, 968 bp, Homo sapiens
  misc_feature (384)..(384): n is a, c, g, or t
gcatgggccatgcatgccgggataacaaagagcccagatgcctcgcgaccccatgcagaagtcctcagcaaaggttaagttgtgtttcatactgctctatctggatagtggagggtgagaagcactcaggacctagctcacacaaataggtaaaatagtgctggttacgcctaggtatgttactgtacagatagtaccactcccctggccatgctataccgagttatcacagaggtcttcgtcgtgttcccaggtcgtaagtaatcgattgcctcgactgcttgaatgaagatgcgtgagtcattattatatttgccgatggatctatacgtagtgatcgacccaaggcttggagtggagtggcccaaatccccaggtcatggnatagcctccacagctcactgagtgcaagccagtgctcccgcctcgagcctccctgagtaggtgggtacttacaggcagcgcaccaccacggcccctgactacatgtctttccatcagtttcttggtagagacaagcaactcactaggttacccaggactgagtggatatgaactcctgagcttaatcacgttctcgtcctgccttgtgccgtcccaaaggtgctagtgattacatgacactgagccagttcacgcttggtcctgcgtgagtcaatctacaggtgtcagtcctatgctgtagacggatgccgcttattttttgccaaggccaaaaatccctagtccattttttctgcttccccttcaggagtctgagtacatccgtctcaagccatccctgttgctactggttggtgctctgtggtggggagtggggggggggctggaagggcatggtttgttcggaagtctgccttagagggctgggtcctggggggcccttgaggcctttacctggcggtggagcccctcgtgggttgccctcttgggggtgggggacgggtcccggggcctggggcccctgg

SEQ ID NO: 490902 - DNA, 771 bp, Homo sapiens
gggagctgatggctgcgccgagggcggggcggggtgcaggcctggagccttcgggcgatggcgggctttggggggcattcgctggtgggaggagaccccgtttgagccctgacctccggtgccctgcttgacgtcaggaacttctgacccccgggcccgagtgacttatgggacccccagtctctgggcccggttgtctgttggggtcacttgaaccccgtagctatgcctgacagtcgtggagaccccgggtccccgggcacaactgactgcgagtgagcccagataccaggacccgggaggcctcagagaactctggaacccgttcgcgcgcgtgtgctggcggtggcgctagggctgctcgggcggggcagtgctagtggttcgtacgtgggggcgggaggtcggggtcctccggccgtcctcgccgccgtccctagcccgacgaccgtttctccccggagtcagtacaatcttcatcgcaagatgtcggtggaagaagacggctacctgccgtcggtctatatcgagatccctggaccggaacccttttctttgggcctgcgaggtccctatctcgaagggctcaggattcgtggtggcttgccgatgggctcattgtcaccaaggcccatgtggtggctgatcggcgcagaagtccgtgttgagactgctaaggcggcgacacgtatgaggccgtggtcacagctgtgggatcccgtggcagacattcgcaacgctgagggattcagaactaaggagcctctccca

SEQ ID NO: 490903 - DNA, 330 bp, Homo sapiens
  misc_feature (62)..(62): n is a, c, g, or t
  misc_feature (72)..(72): n is a, c, g, or t
  misc_feature (89)..(89): n is a, c, g, or t
  misc_feature (97)..(97): n is a, c, g, or t
  misc_feature (137)..(137): n is a, c, g, or t
  misc_feature (149)..(149): n is a, c, g, or t
  misc_feature (157)..(157): n is a, c, g, or t
  misc_feature (170)..(170): n is a, c, g, or t
  misc_feature (192)..(192): n is a, c, g, or t
  misc_feature (202)..(202): n is a, c, g, or t
  misc_feature (206)..(206): n is a, c, g, or t
  misc_feature (220)..(220): n is a, c, g, or t
  misc_feature (224)..(224): n is a, c, g, or t
  misc_feature (238)..(238): n is a, c, g, or t
  misc_feature (244)..(244): n is a, c, g, or t
  misc_feature (250)..(250): n is a, c, g, or t
  misc_feature (256)..(256): n is a, c, g, or t
  misc_feature (259)..(259): n is a, c, g, or t
  misc_feature (265)..(266): n is a, c, g, or t
  misc_feature (270)..(270): n is a, c, g, or t
  misc_feature (277)..(277): n is a, c, g, or t
  misc_feature (303)..(303): n is a, c, g, or t
  misc_feature (307)..(309): n is a, c, g, or t
  misc_feature (312)..(312): n is a, c, g, or t
ggggggggggtcccccttgggaatttgggaatttggttttttctcccttgcttccttcagcnccatgtgatntttgggcacacaggggnatcctttngccctcccccagaagcagcagcagcctcagggatgagggnggtcctcagtgngggccccngcccagttttganccttccagccatcagaatttgngccaaatcancctnttcctttataaagncccngcctcgggtttttngtcagngcaacncaaaanggnctcggnngggntcaaatngggtttcccccccccccccaaaaaantttnnnttnaaatcctaacccccagca

SEQ ID NO: 490904 - DNA, 466 bp, Homo sapiens
agcttacccttactgtcaccttcactgtgcattcccttctcttacagatgccattaattttattaccacaattgttaacataagaccatctggtatagcccaaacaagacaccactttcatttttatattctatgtattaattgctatgtattaattgtcgctcccagtactttaagctataacaattgtgctaattaacatgttttctttgatcaagtgagagcgaagactcagtttcatatcaatatttattctgattcttagaaattacaaaaggatttattctaattttatgtagatttggaaaatttttgtttagcatattattcaggaaccaagataatcctttggctatatagaaataacatgagcaacaccatcagttggatttgtaggatatattgtatgagcatatcatacatttgccatagaaacagtcctagacacaatagcatacttcccatc

SEQ ID NO: 490905 - DNA, 828 bp, Homo sapiens
gatacagaaaaaagtaatggaactggagagtgaaaatctaaacctccagtccaaaatgaaacctcttatctttaccacacaatctctcatacagaaagttgaaacatatgaaaagcaacttaagaacctggttgaagaaaagagtactattcagtctaagttaagtaaaacagaagaagacagcaaagagtgtcttaaagaattttaaaaaaataattagtaaatataatgttctgcaaggccaaaataaaactctagaggaaaaaaatatacaatttctttagagaagcaacaaatgatggaagcattagatcaactaaaaagtaaggaacacaaaactcaaagtgatatggccattgtaaataatgaaaataatcgaatgagtatagaaatggaagcaatgaaaaccaatattctgttgatacaagatgaaaaagaaatgttagagaaaaaaacacaccagcttctaaaagaaaaaagctcacttggaaatgaactaaaagaaagccagctagagaataatgcagctaaaagagaaagaaagattggcaaaaaacggaacaagagacacttcttcaaataatagaaacagttaaagatgaaaactcagcttgaaacaacattacagaatctaaatgtgcaagaaaattttggcaggagaatttgggaatttcaaacctaacattattgcgaagagatttttggggaataaaatggatcagaggcggtttttagaatcttgttgaattggggggagtgatgtgtcacatggtgggacacaaattatttcttgaagaaagagcattgaaatattgagaggcgatttaa

SEQ ID NO: 490906 - DNA, 1954 bp, Homo sapiens
acaggccacaggccaagggcagcagtcaggcctgctctgtctgtgaacgctcccggcttggcctcggctgatgggccctcacgcctgaagcgggcaggaagctccgggatggatttcgggtctttggagaccgtggtggccaactctgccttcatcgccgcccgaggcagctttgacggcagcagctcccaaccctcccgggacaagaagtacctggccaagctcaagctgcccccgctgtccaagtgtgagtccctccgcgacagcctcagcctggagtttgagagtgtgtgcttggagcagcccatcggcaagaagctctttcagcagttcctacaatcggcagagaagcacctgccggccctggagctctggaaagacatcgaggactatgacacggcagacaatgacctccagccacagaaggcccagaccatcctggcccagtacctggacccccaggccaaactcttctgcagcttcctggatgaggggatagtggcgaagtttaaggaggggcctgtggagatccaggacgggctcttccagcccctgctgcaggccaccctggcacacctgggccaagcccccttccaggagtacctgggcagcctgtacttcctgaggttcctgcagtggaagtggctggaagcccagcccatgggggaggactggttcctggacttcagggtcctggggaaagggggcttcggggaggtgtcggcctgccagatgaaggcgaccggcaagctgtatgcctgcaagaagctgaacaagaagcggctgaagaagaggaagggctaccagggtgctatggtggagaagaagattctgatgaaagtacacagcaggttcatcgtgtctctggcctatgcgtttgaaaccaaagccgacctctgtctggtgatgaccatcatgaacggaggtgacatcaggtaccacatctacaacgtgaatgaggagaaccctggcttcccggagccgcgcgccctcttctacacggcgcagatcatctgcggcctggagcacctgcaccagaggcggatcgtctaccgcgacctcaagcccgagaacgtgctgctggacaatgacggcaatgtccggatctctgaccttgggctggccgtggagctgctggacggacagagcaagaccaagggctacgcagggaccccaggtttcatggcccccgagctcctgcagggcgaggagtacgacttctccgtggactactttgccctgggggtcaccctgtatgagatgattgcggccagaggacccttccgagcccgtggagagaaggtggagaacaaggagctgaagcaccggatcatctcagagcccgtgaagtaccctgataagttcagccaggccagcaaggacttctgcgaggcgctgctggagaaggacccggagaagcgcctggggttcagagatgagacctgcgacaagctccgtgcccaccccctcttcaaggaccttaactggaggcagctggaggctgggatgctgatgccccctttcatcccagactccaaaactgtctacgcaaaggatattcaggacgtgggtgccttttccaccgtcaaaggtgtggcctttgacaaaacagacacagaattctttcaggaatttgccactggcaactgccccatcccctggcaggaggagatgatcgagacgggcatctttggcgagctgaacgtgtggcgctcggacggtcagatgccggacgacatgaagggcatctccgggggctccagctcctcgtccaagtcagggatgtgtctggtttcctaggtgacgccccagagtccacgtggaggaaaaggacccatacggctcgatgggggccgcctgcctccgtggtgccagcctggggtctgctagcaaggggacacgtggttccctccacccaggtccccatcacgccatctccttgcggcccaaggag

SEQ ID NO: 490907 - DNA, 280 bp, Homo sapiens
aacatgatagtatcaatccataaattgctcttggggagttaccatcttaatgaaatagttttcaacctatggatgcaaaatgtcttttcatttatttacagttctttaatttctttcagcactgttttgtagttttcagtgcaaaaatcttgcaccaccatggttaaatttattactaagtaatttttacgctattgtaaatggaattgtttacttaatttcctttttggattgttcattgttatatagaaatacaactgatatttgtgtgttgatcttg

SEQ ID NO: 490908 - DNA, 149 bp, Homo sapiens
ctctatgatgtatcactcatgctgcagccatcgtgcaacgaagtagatcaattaacggagaaaaggcaggtatggaaattccaaggcccggtgcacgttgggtcactcctgtagtcccagacacttatgggaaagccgatgtagggcgg

SEQ ID NO: 490909 - DNA, 103 bp, Homo sapiens
tgaagcacctgcgcgaggcccggtgaccggcgggcgatctcgtctgtttcgatttcgaggccagcgcgtttctgcaccacatggtgcgcaacctggtaggcag

SEQ ID NO: 490910 - DNA, 180 bp, Homo sapiens
gacatcagagacagactcatcccaggcagatggagtctaccctctgatccaaccactgatattattattttactaacatggtgatgggctccctcccactaaccttggtgcctgactccatccccagtaccaggacagcagaccactcacgttcttcctaccaccatccttacatgataa

SEQ ID NO: 490911 - DNA, 347 bp, Homo sapiens
ccactcgcgtgtcgcatatccaaggggttgcacaaatattgaactagtacttttaacaaaagcattctatttaacataaaacaaattggttgtctataatattggttgaatgggttacatgctttgatcaatacgacaaccaataactatttactgaattcaaactatttacttttaaacatttgacatagcattatgagatctaaatacagtctttgacaatgttcaatcaaaataatgtcgtcatgtttaaaaaataccgctgatgagcaatatatcattctatatattgtctttcaacagttccagctagagaaatagcacagtatttattaaaaggacaacgc

SEQ ID NO: 490912 - DNA, 1499 bp, Homo sapiens
ccggaggctcccgcagccccggcgtcgccccgctgccccctcccccgggggccatgggggcgcccccggagctaccggcacctcagcttgggtgcatctcctcgcaccaggtgccccgaagccgacttccagcttcctgcccggtgcccatgcgtattcactgcgccccaatgagcaggaataccagcaggccttgcttgctcggatggcggccttgcgcagggcctgggctatgcggcctgacgccctcatattatcactcagcttgtcctaaccatcagtccgacttctgtctgcatgcctggcccctcctgagccccctccgtgtgttccacaggcagtccccgtcgcctcgcgtggtgacggcctgcgctctaccctgtgtcagctgtcattatgcttctgccccctttcttcagcccggtctgcaaccttggaccaacttttgcggcactcactggctatatcccataacatgtggctcacacccacagttcgcacgtaatcccacgctcgtacatcacgcgagcactgcatcgcaccaacgtagcttaccacctgtcaatacactgcacggccaatgcacaatagtcaacaccaggtctcaacatctacaataccacacaaaccataccaacttcaatacagccacgacaactaggaagcatcacaacacacataggagcataggcctacaggcggcaagcgcacccgccgcctacggcgcaactcgcacaggcgacccgtcgccgcggccagcaaacgtagctccagaccgacactgcactcggctggaatccccacggcgaatagcacactgcagaccccaagagacaccatatgcgagacaccagtcgctcactgtcggcttggggcacgtaccaggatacgagcactgcggcgaggcccacgctagcggctacgccacccattgcaagccctgtgcggcacactaggacccccagtcacacccacgcaaacgtcgcgccgaccactcactccagcacgccgcgccgccctcacgaatcgatccacggtgccattccctggactcttagtcaacgtggcaacctacccccaaccatcacatgacaactcgcgcctatcgctcgtgtcttgttcctatggtatgatactcactcactaccactgaccgacaccacacgcagctgtcaacgcattagtcttctaccctcatctgttacaagtgatctacaaccagccaattagtaccatacatgtactctgcacctccctatgggcaccgatagaccctcgtgctacgcatatcacgcccaatcactgcgatctgtcctcatagcctggcccaagtaaacccccaagtgcgctagcatgcgactcactgacagcccaccgaactcatgctcgacatctcgctctctacaccctgtcgcgccttcggccatatcaccacatggttctccacgaccatcactctcatgacctaacctagtctccactgcctcgttatctaacgc

SEQ ID NO: 490913 - DNA, 964 bp, Homo sapiens
gctgttttcctgcgcaggagccgcagggcctgtagtgcagccatggcgcccagcctggaatggcatggtcttgaagccccacttccacaatggactggcagcggctgcgtggccacgtggttcaaccagccggcccgtaatgatcctgcagacgtaagtgccctgtgcaatgccaatggctgcgcctgcatctgccccgctgcccccgcgtcgggtcccatcctgtgcccatcgtgcgctgccccacgggttctggtaccacactgaagtgtgcgctgcctggcctgcggcttcaagcctgtgaggacgctcatgtggtgtgcctggcattcacacagaacggtggcccggaccactcggcatttcatgtggatccgaggacggcgtgaacaaagtccacggacgtccctgcagtgccaactgtgcagcgagctgaacggagtaccgatccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagcagaagaactttcagagccttcgcttagtctccgtatggcccgtgccaaacgcccggctcttcggccatacgggcacacacagagccacaggaacgccgcagaaacacggatgttgacactgaaaacaatcaaagccctcctggggacttggaatcagtcgggagacaatgctgggtctacacgtgggtgtgtaacgaggggaacaactgggtctggggatgggggcttcactgcctgtgacttcctccttgccaggggaattgggggacttcttgaaagacaggtcaaaggcctggataatgctttactttctgtgatgaaggacatgatggcaggatggataagtgacttgatgtagaaa

SEQ ID NO: 490914 - DNA, 326 bp, Homo sapiens
tgctgggaccacaggcgtgagcactgcaccgagccagaagttttgaatttttacgaagtctaatgtgtctgtttttcttttgctgcccatgcttttggtatcgtatccaagagatgattgccacatccaatgtcatgaagcttctcccctgtgtttccttctaagagttttatagtcttagctctcacatttaggtcttttattttgagttaatttgtatacggtgttaggtaagagtccaactttatatttttgcaggtggatatccagttgttgtgacaccatttgttgaaagactgtcttttccccattgaatggtcttgaca

SEQ ID NO: 490915 - DNA, 296 bp, Homo sapiens
  misc_feature (195)..(195): n is a, c, g, or t
  misc_feature (270)..(270): n is a, c, g, or t
  misc_feature (287)..(287): n is a, c, g, or t
cagcccttccgccacggccgtctctggagagcagcagccatggccctacgctaccctatggccgtgggctcaacaagggccacaaagtgaccaagaacgtgagcaagccaggcacagcgaacgccgcgggtctgtaccaaacacaccaagttcgtgcgggacatgattcgggaaggttgtgtggcttttgccccntacgagcggcggccatggagttactgaaggtctccaaggacaaaccgggccctcaaatttatcaagaaaagggtnggggacgcacatccggngccaagagg

SEQ ID NO: 490916 - DNA, 1607 bp, Homo sapiens
ggggcaaatcagctgtgggagacgaggctatgcctctgaggaggccatgtccggcgggtatcagcgccatcacaaccggccatcatgacggtgggcgagagacagcacatgtatgctggcaggcatattcgtactgactagtgactgacgtgtgacatcgctgcaggtacggggccgggagtacttcatatggccaccgtatcaagggcgtataagaaccaaggcgtcatgcagactctctcgatcccgtctgttgaaccttgctgaatgaaggtaacagtagcagatcagagtcctgagacgacatctccaaaaatcgagaagacaggtaagggggcagatgatgagagtcgtaggtccgtccggtctggggtcgcgtgcattgcgagggcggacgtaaatcctaggatcgttcacagtgatcaagataagaagggggacccatgcacctcccctaaccgtattgacatgggatatttcgcctcggaaggtttccctttcgtattggcttggagatcctcgaccggggggcgagcctcgacgagggtagttcggagtccacggggccttgggcttgggcctatgatgggcacaattcgccgaggcctaggagggtggtataccccaattggcccacgcgaggaggggtcccttggccgtttggaaccttttcacttcgaggcccccagatcccggttcagggggggttgggggcttgggggctctattcacgcggagtccaagggtgttgatgggaacacacccgattcggacgtgaacatgcatgggttaactcgggtaataggcaagggcccagcacttagctaagggttcggattggaacaactaggccccaagttaatgcttgcccgggggagtgctttcgcgagtaccccccaatgaaaaagctcaaacccttgggggtccgattagagaggggagtcaccgtcccccccccagggccctaattgtggagcgccgaacggcgcaggacaatggcctgcattcccaaggggcatcttgcattgaggggccccgtcgcttgcccattgggttatttggagggaacccttcccctaaatggtgggttccccccccaaaataggggggaaatactccgccgcttggggccatggaacggggaacttacccaaaattggggcggcaatgtccccccttccccggggaaaattggagggaacgtcccatttcccctcctggggggaattggccggggggccccttccggtgttggaggacccgtgtggggcccacaacagcgagtttattcggggaccgttagcctcccgcggaaaaaaggcgccggagtgggccacagcaattaccgccacagggggcacccggtctaccccaccagaagccgggttagaaaacataaacaggcagggtggaacgcagggcgactctcaggcgacatgtggagaggggtcacacctagtaaagggagccccccgccaccgggaaaaagggctcccatgagagcggaagaaacacgtgtgccataccaaacacacgagggtcagcaagcggggagaacacgtaacaccacggcggacacagggaggacacctctacagaggaggaac

SEQ ID NO: 490917 - DNA, 828 bp, Homo sapiens
cgaggggcggacgggggcaccaactgcggtcgatggcgcctctcgtagtgctaccgcagtgagggtgtgttccgcgcttgttgtctcaccgaccgtcgttgtgtctccgaggcgctctcttcaagagcgcgcctttttgctgcgcccccattgtttaaaggccggttttggggcccgctctccaaataaagggtggccccccctgttggagacaatgtgtcttgtgggccgccacccgccccccctttgggttgattgcgttcacccccctccgggtaatttgccccccggggggctttttgagcctggttttccccccaaggaaaaagggccagcgctttccccgttggccccgcagttcgggacccaatgggccgcccacgcccgtggcggcccccatcagtcaattctcagattggtctgggacgcaacccagccccctcagaggtgagaaggttgccccgccccttgctccaatagcggggtctttagggctccccgagcgccttaatgcgagaaagaaccatcccctgtgctctttcgtatggcccaccaccgcttcccgagcggcttggctcctgccccgcccctttcaaggccccctaatcaccggcgggcgatcacttgcggtccctgcacccgaggcctcgattcccgcgctccctctcggggcccccctctggggtggccaagtatcgtcccacccccggcggccccggcgtgctccatttttctctatccctgggcctcgtgtcccttccattgagtgtttctttccccaagaaatgtgcccgggggataaacaccccgggcccacgaaaaacatac

SEQ ID NO: 490918 - DNA, 159 bp, Homo sapiens
cgcctacttcttactggcgatacctagtggctgctgtcttgtagttgctccacttttatttcatgcttctaatccatgtttctcacccttatactttttgctgctacacatcttcatctaccaggaggagtctgtaagtgttgtgggactgggcatgac

SEQ ID NO: 490919 - DNA, 150 bp, Homo sapiens
  misc_feature (108)..(108): n is a, c, g, or t
  misc_feature (128)..(128): n is a, c, g, or t
ggaatggagagctcgtgtgcagtgggtggacataacgcatctggagaagaacgccaccctgctcttccccgagagcataccgtgtggacacccgcgaccaggagctcnttcttctaccatgttcctcnaacatacggcgatgaccttcaa

SEQ ID NO: 490920 - DNA, 93 bp, Homo sapiens
ggatttgctggtgcagtacaactaggcttaatagggacatggcaccactgcactccagcctgggtgacagagcaaacgaaactctgtctcaaa

SEQ ID NO: 490921 - DNA, 1535 bp, Homo sapiens
  misc_feature (983)..(983): n is a, c, g, or t
tacacaaatagcattttttattggccactatttgtgaagttctgaactttaaacagatttctgggagctgggtggttcatattccatcagcctcgttcaacttttagccaccgtggtctcgtccccagtgtggcttttctccaaaactacgtgccttcaccagtgaaggcctccatgtgagcttctcccaatttacaaaccgtggggctctctttcaggcatttttatacttttctcataaccgagaaaacatctcatgtggagagagagaataaacatagagattgtggcaacgccttttctcatatgatcctatatctcacaaagtggcgtggtctgtggagaatcaaatatttttatgtggaccacacttctcttctctccagagtgtcataattgtggtcttgcgcacctctctctcggggtcaatgagattctccacactcaaaatctttcttctccggggatttggggcgggcaccgtgtgttgcgtgtgtgtctgggagcatataagagaaagtgttcatctcgcggtgtcttcgtgagtatgtgagtgagagggtggttttttaagatgtacaaaacacccaacccacagagacacacaagacagagaagacgcaagatgtaaaaccttatgcggggtagagtctctgttgggacatataccacagcgtgagagagtcttacaacaccctatgctgggtgtctggggcgcctattattttcgtggcaccctatgggggcacacccacactatttttgtgggtcgccaccggggggtaaacaagaatcccctatggggccctattggggcaaactgttaacagtcaccaggcggcaaacgtgtttttacaccccccttggggaaacacacttcccttcgccgaggattcacactcacacacgacctagtgagcacaatttttcttcataacacattgggccgaacctttctccaatcacaattttcctggggacanaaatcttccagaggacacacgaactcctccaactcttcttccaaagacgcaacaccggaaccccctttatggaaacacacatacttcaaggatgtggcacaattttgggggttgaccctgtggagggctccccggagtgtagaccaaaagaggtgatattttccccaaattatttttcctttattaattgggagacacttagagcagggatgttgcttattccatcaaatttaataacacccaattttttctctttacaacaactgtggggtgttcagccgacgatttttctttttgtgttagcaccccctattatggggacggcacttaggtaaagggggcggtgttagttttagcaaccgggccaggggtgtgttgggtgtaatagaagtcggcacaaatcagaagatacaacaacaaagcggggcggggagaagaacaaacaacgcaaggaggaggaagaaatgagcaaccaccatctgtagataagagctactcattcgagagcaacatatacgaatcgcgcgagtcacactagcgtgaggtcaggag

SEQ ID NO: 490922 - DNA, 1275 bp, Homo sapiens
  misc_feature (208)..(208): n is a, c, g, or t
aaccacctgaaggagtatcacatcaatgcacgaacatactctacttcacctcaccatacgccgacgagttacgccatcggactatctttcacataaatgctagtggattgtctccaatggacattcaaggtgcccaaggagcccgctacctgggctaacagtcaaggactacgagtgtgatgcgatcggctgactggaagatgtgagnctgaaatccccgctagtccgcctactagcgggaggcgtgtccgcaggatcatcaaggaagcgagcaaagagatcaatcaagaaggctgatttgagacggcaaaccatggccctagatccggcaaagggtccataccacggagggctctagcaatgcttcagaatgacgtgacctggtcgagtgctagaatcccttgttggacgcagccgtactcttgaggatgtcgaagacgacagggctgcgaaccgccgatcgggagatgcgcgacaggggaaaggcgcagcctgcaaagggaacctccggaacactagacatcattacacacatgcgcatccaaagaaaagcatgtatgagcacccagattgcgaacggtcgtcatacctccatggttgacctgtgggcacccttccgtaggaaggcccttgctaaaaaccaagatgtcagcgacggacgccctgtgaacttgaccctaacgaaagggctcaattcgcggcgttacaccccaattctgtagcccttgccatggacacccgagtgaacccgtgaacgacggggacctgtccagaaatgtcgccgttcttcgctaacagatttgaacgcgcaaggtaacagtccccaaattggtgggggcgcagagacccttgtataacgcagagagtggctaaccagaccaaaaacatgcaccgcgtaaaggttaccgaagctccccgtcaggggacaactcagcggagtgttcccctggcacggtgttgattgaccgaaagatgctcaccttggtggcaagaaaagattccgttcacgtaaagggttgacaaaggacctgtcccacaggaaaatgtggccaagcgcccttcaaatgtgtgagcgccacgccttaaggggacccccatacctatgtgaggcaccagtcaagaccccgtgttaacggctggcaaaatggtatactacccgagccgatcaggggaatcgcctgcaataactagcaggcccagatacaagggggaagaacacgtggggccccaacggtaactcgcgaatcatcagtgtagagagacaacagtaacgca

SEQ ID NO: 490923 - DNA, 214 bp, Homo sapiens
ccgcgaaagctagtgcgttagaagtcggatgcgtgtgactctacactctgtaatcccagcactttgggaggccctagtgcaggcggatcacttgtaggttaggatttcaagagcagcctggtcaatattgtgaaagcccgtctctactaaaaataccaaaagtagccgggcgtgttggcacgcacctgtaacccctcctactaagtttgccgcg

SEQ ID NO: 490924 - DNA, 706 bp, Homo sapiens
ctgtaatcacagcactttgagaggctgaggcaggaggatcacttgaggccaggagttggagcccagctggggcaacatagctagacgtcatctcaagaaagaaagagagagagagaaagaaagagagagagagagacagagaaagaaagaaggaaagaaggaaggaaagaaagaaaaagaaagaaagaaagaaagaaaagaaagaaatcagccaggcatggtagcgcccgcgcctgtagtcccagttactcctgaggctgaggcaggaggatcacttgaggccaggagttggaggccagcctgggcaacgtagctagaccgcatctctaccaaaaaaaaaaaaaacagaaagaaatttattcaggcattgggggcacacatgtgccgtgttgtgctcccagtttacctacagagcgctgagcgcacggaggctctccctttgatctcccagggagtttacgacggctgcagataagctattgattgattgccacttattacttccaaccttgggcgagagagtaagaccctgtctaaaaaaatcctaaaatggtgccaggcacgggggctcacgctggtaatcctagcacttggggaggcggaggcaggcggactcacagggacaggtcaggagtcaagaccagcttggccggcggggcatgatggctcatgccctgtaatccagcatttggggaggccgagtggt

SEQ ID NO: 490925 - DNA, 280 bp, Homo sapiens
ggttttttgaaacaaaaaagaaactgccaaaacctggtgtgttttaaactccccccccaggagccactccaattcctccgccccgtggtttggggggtgacaataccaaagcgccgagaccagggtgttgtgtccctcaaacccaaagtggtgggggcctttgaaaccaaacagccactcctggccccaaacattggtttgcatcccaggttcctggcccccctacccccgccacaccccgtttttttaaagatttttttaataaatcgggtaataagca

SEQ ID NO: 490926 - DNA, 535 bp, Homo sapiens
cagaaagaaagctgacttgttataccgggagagggccgtccaaatagttgttcctttggggggtccgaagcctttgatgattgcagtctttgttggtctagtgggctcgcctaatgagggcgatcgcctatattagacgtctcgcagtggcgcgtagcatctaacaacagctgtcgccttggggcaaacgttgggagccggggcagttttggggaaaggaactttatttgcggggcgtgcgagcaaatatctgggaagtacagtcactctaaagattgttacagcgtctctaggggaaagattattaatacttttatcacaggtgtatttaggggtgtctgtgacgacgcgaaggcgggcaatagggcgggggggcgtcggaacaatatggcgcccatggggatctttgaacttttagcaaagtcttttttacctcggggagcgatgtgaaaataaactcgcaagagcagctatgacctgggctacaccgccgcctacacctcctacgctccctatggaaccagtttcgtcccca

SEQ ID NO: 490927 - DNA, 350 bp, Homo sapiens
  misc_feature (4)..(4): n is a, c, g, or t
tganagtcgggtaggccaaggcttaataaatacttgtttcttaattgatacaaagaaaatcaaattggtcttggcgcggtggctcgtgcctgtagccctagcgcttggggaggtcaaagagggaagatacttggagccacgagttttaggctagcccgggcagcatagcgggaccctatctctacagaaaataaattggccgggcatggtggtatgtgggccagtggtcccagatacttggtaggttggggcagggggatcgcttgagcccaggagttgagttaaagtgagcttattcattgtgctgctgcgcttcagcttggaaaatcccatgatatactgtctctatt

SEQ ID NO: 490928 - DNA, 225 bp, Homo sapiens
agctcccccaattccattccagcgttgcgggtgcagcaggtcgggggtcaggttacagatctccaggcgggaatagtgcctcaggcaagtcactgaaagacatccagcaattctccatcttcatgccgtcgggtcagcctttccctctcctcggggtctatagtgttccagctggggcagtggtcattccaccgccctaggcgggaatggaatgggggtaccgag

SEQ ID NO: 490929 - DNA, 294 bp, Homo sapiens
tcgaggattaggcagctatcggttcaatggcaacattgtaaaccccgtctctactaaaaatacaaaacattagccaggcatggtggcaggtgctgtaatcccagctacttgggaggctgaggcaggagaattgcttgaacctgggaggcggaggttgcagtgagctgagatcacaccactgcactctaccctgggcaacagagccagactgggtcttgagaaaaaataaataaataaagctgggacaatggcataaatgaatctcacaaacataatattgaaccggatagcttg

SEQ ID NO: 490930 - DNA, 364 bp, Homo sapiens
  misc_feature (110)..(111): n is a, c, g, or t
  misc_feature (113)..(113): n is a, c, g, or t
  misc_feature (319)..(319): n is a, c, g, or t
agagaacccaggctgagaaggtcacatactgtgtagggttatatttatatggcattctggacgaggcaaaactctgggtgtggataacaggtcagtggctgccaggagtnngnggtcggggaggggtgagtacgaaggagcagatagaggggattcttgggagtactaaaaatttcaatatcttgtctaaaagtgaggttaacatgaatctttgtaaaaataattagaaaaatgatagctagagaatatgggcaatgattgtccttgaattttaaatgacacataaaaataggaatagatgagcatttccctaacatgntaaagtgtatctatcttggcccgcaagttgagtagcatgctgact

SEQ ID NO: 490931 - DNA, 726 bp, Homo sapiens
gggtcagcaatttccaaatcttagacttgacacaaatcaaaattacccaataaaaaagaacactgagtaatgatttaaacgtggaatcattacttgactaacagatgtcgcgtccacggcgatgtccgttaacacagccctcttcatggaacagtcagctgtgtaaatgcagtcttaggaaaagttattttcccactctgccctttacattctgactttcctttcctagttggttcctgccattcatgttaataagtggctacacttgccttctgaatgatcgaaagaaacttttacatcttttcttccaagaataaaagtaacaagctgactgtgattcttaaatggagaccagagcagctaaacgtctcacgtttaaattttggttttcttttcctttttttttcttgtttcttttagtttttttggggcgcaggggcagggtgggaataagttaatttcctaacttgaattttttcttcttgacactgttttttacagtggtgcgctaaatatttcccggaccggacgggcacctgtccacaaaatcagtggggtggtcttccacacgtagtccctctggagaattacacagtggtttgggccccccaaagaattcagtaataagcggcgccaaaacttgtggctggggcacaaatttttggccgaacttttgtaacccttgggcacaaaaccggcgcaagggccaaaaggacagctaaacgg

SEQ ID NO: 490932 - DNA, 132 bp, Homo sapiens
agaacaccggcaagttatagctgtgttaatgacaaaatgtgatatttactagttctaaattatagcagctagggagaatcccctataataaggacagacgagaaaatacatttataatacaagactagcatt

SEQ ID NO: 490933 - DNA, 471 bp, Homo sapiens
  misc_feature (280)..(280): n is a, c, g, or t
tgggttcggtggttctcttaaaaataatgcacagtacttactaatggcatccatttgaataaagtggcaataaagctagttgatgtcagtgacattaagccaactccaggattcgggagttttagcattaggatttagatttaccagctagagcgtggcttccttcctccctgtagcccatccctactgctgcctttcgtggtctgtctcgcaggtctgtcttgcggcctaccaaggctctctgacgagcctctgttctcctgcgccccgccccgttggnaaaccagctacatcagagtctagagaacacaaattttacttctgtggcggtgtacaaaagtggagtttttgtttttgaagtttttgtttctgatttctgggttttcttagttactagccgataatacagaaaaaggtctgacaggggctttattttccccaaatttattaatacctaaactagattaatgt

SEQ ID NO: 490934 - DNA, 375 bp, Homo sapiens
agaccactccatgcctggtgcataagagctactccagccttcaagttgtgcagctctccactgcttaccacagcgttacagagtcgttgtgcctcttttgtcattccagtgcggtttatagtaaagagattttgagtaatctaacttcatcttctctatccagatcatcaaggggcattttctgtcttatgggagcatcagggtcctgtaagaagaaaaaataagtcatcatcaaccataaatcctttgtacttacatacattttacacatcatcaagagatgataaacctatcctgagtttatacacaaataaattcattttttcttttttcttttccgagacggagtctagctcttattgcccaggctggagt

SEQ ID NO: 490935 - DNA, 143 bp, Homo sapiens
tgtaaattaatcatctgttggcgaaagaggaaagaaataggagctgagggtgtatgagagcaaaatcccggtattttaaatagttggttaaaaggaggtgaccacaaataaagaaagggagtaaaatcacaatttaacaaaat

SEQ ID NO: 490936 - DNA, 196 bp, Homo sapiens
cttaacctgccgcacgtcatctcaatccacaggtcttttgcacggactgctccaggtctctgagggcagtcactgagtcagcttgctccacactctgacaccagtgtaccgggaggctttgcctcatgggcttgggttaacttcagtgacctcagaacgagccacgggctgtaaccctgcccttccagcccatcca

SEQ ID NO: 490937 - DNA, 324 bp, Homo sapiens
tggcgcggtatttttgggcaagagtcccaattccccgcatattatttttgtggacctctccaagggttctcgggggtttctcgcccggagtttttctactgtcagacggcggttcgcacaaacaagggcggggtggtaacacaccgggggtgttgtaccctcggtttttcccacgttcttctgttgtgtcccccggattgtgggcagagttatgctcctcggcacacgccgccgcgcggttatggctcggagcgattgtgtggacgccggtccgttataacgaaagagtacaccgtcgggcccaccagcttccccaacaaaaag

SEQ ID NO: 490938 - DNA, 1557 bp, Homo sapiens
gacgggcccgaaccctcgtgtgcaagggtgcagtacctaagccggagcggggtagacggcgggccggcaaccccctttctgaccctccacgtgccgccggcctcaagactcacgaccatggcccagaacttgacacggaccttggcagagagaccgagcatgcaccagcccgaggaacacccagaggagacaatgagagcaacgagaaccaatgaacaggcatggctatgcatgagggagaccggagaaagaccacgagtggaccaataaccgggacaggatggccggccggaacaatcgtagacaggaataacaaacccgagggcccacaggggacaggggaccacccaggaaagacccaaagaacaaataacatagaccacacactcagggaaaatcagaagaagagaaagcatgccccacgaccacaagagggaaaacaaacacgtaaggaccgacgttgggggaacacccggaaacgcaggtgcgagcgaagagaccaacaccgatggaccaagggaggaaaagatgcgcccccggacggagagcgaaaactccgacaaaggagagaaaagagcaacaacaaagacagcaaaatccgaaataaacatggggcaacgacaacgtttaccacggagagggggcaccccaccggcgccacgcacccacattcaccgggcagagcacacgcaagacagtatccgaattacgtgccatattcacgccgcgcaccggtatacacggccaaggagggagccgatatcaacacaacaaaagatagtgaacacacgccacagatcaccccaacacgtcacactctgggcggatagggccaacaacgtaacgtatcggatatcaacacaccgatggggcacacggaaaaaacgaagcaggggagaccgcaagcggagacaccagtaccaggagaaacaacagcacgacgacaaaacaagtggaggacccataccaccaaaggcgaacacaggaccccagaaacgacacccccgaacgaaacgaggaaccaaacagctggggcaacaacagcagccaaaaagcaaaacggaacaaccaagaaaaagcgacgcggagagagacctcgtgagggaacgagacgttaacgcgcaagacaaaggaaggccacaacacccgagaaaaggccagtgaggcacagcgggaccacccggggactcgaccacaagatgaaggacaaccaacaaacaccatgacacagcgaggactgacggcccatccacaaaaagacacacgcacaggagtagggagcaaacaggagaccacacgaaaacgacacaatcacggacaagaacataggaccacgccagtaaccaggcaacaaaagacaaagatcaggaacagcataccgacagaagcaagcgcaaaagagaatcgagagcaaggaccaccagcaagacaggaggggagtcgacattccccccagcgagagaggaagataagggaaagaatcagagcgagcaacgacggacggggaaacgagccacagggaaaccgaacggagcacagcaaacagggagggaaacc

SEQ ID NO: 490939 - DNA, 105 bp, Homo sapiens
atggtctgcactctgttttggggcacggcacagggtgccaataccacagtcaccacacaggccagagaggagccaggacccaccaagcatcctgggggcacccct

SEQ ID NO: 490940 - DNA, 648 bp, Homo sapiens
tttcccacggcagttactcacagaaaaaaaaatttttgttccaccggagaatattttaggcattccaagccggacccttgtggaggggaatttggccccccgaattgttctcaacaagttggcccgggggtggaaaaccacggccccatgaagaatccctctagggggacccaaaaatttaggggactttggggcccaccccaaacaaattctttaaaatttttgggggggggcccaaactatagggggtaaaaaagggctccccaggaaaaactaacacacgtccccgtttaaaacccgccggaccttgggcccgcattctggagaaatcaaaaaaggtgtaaaaagagtttcacgcaaccccctattggggggggcccactggtctccctcaggggtgaaaggggtcctctttggccgccaatttaaaagctctgcgggccaaatctgtgggccaagcaccagcccaaacgtgtacgtctggtcaataatagaaacaaaaatcctcccgacccgcccaaaaatctccccgggaaaagaaaacccttgggagggtggaatatgttctctcgcttggatcccaaaccccgagggcccgtgttctcctattcacaatccccatgccaccacactttggcaccgtactcc

SEQ ID NO: 490941 - DNA, 154 bp, Homo sapiens
gagcagtgcggagtgcatataggaggtccttaactgggtgcacaactacctattcggggcagtatccaattcagggtttcagtgctcccttgtgtaaactgtgggctttggtgaagaccactttcaaacaagggagcactgaaacctgaattgg

SEQ ID NO: 490942 - DNA, 206 bp, Homo sapiens
tatttccacagggttccatatcaacaatagggtttaggacctcgatgtgggatcaggacatcccgatggtgcagccgctattaaggggttcgttggtcccaacagattaaagtcctacgttgatctagagttcagaccgggagtattccatgttgggtttctatctacttcaaatttcctcccgggggaaaagtagggaaccgagc

SEQ ID NO: 490943 - DNA, 153 bp, Homo sapiens
ggcggctgcggcacggatgcagaacatgagtttcatacgaagaccaccagcggctatgcaggtcgtctgagctcggcctatgtggggcctcgcatagccccggcctcagctacatgcctggcgctccagcctttgggctctggcgtcgggctc

SEQ ID NO: 490944 - DNA, 238 bp, Homo sapiens
gctcgacctttgccattgtgaacagcacaacaatgaacatatgagtccacatgtctttttggtataatgatctgttttccatactcagtaatgggattcctaagtcaagtggtagctctgttttaagttctctgagaaatctccagactgctttccacagtgtgtgaactatttgcattcccaacgacggtgtataagtgttctttattctctgcagcctccccagccttcagtcgac

SEQ ID NO: 490945 - DNA, 215 bp, Homo sapiens
gtccgactgaggggtactcgccaccggctgcgtccacccgagcggctgcgggagccaaggcccgagggggttgggcgttggcggccgcgaaacacaaccccctctgttccctctaatcgcggggcggccgggtagtttccatccgccagctgccatgagcgagcgcctccgtcccaggaaagggagagggcatggcaacgagaagacaaccatct

SEQ ID NO: 490946 - DNA, 356 bp, Homo sapiens
  misc_feature (94)..(94): n is a, c, g, or t
  misc_feature (251)..(251): n is a, c, g, or t
  misc_feature (253)..(253): n is a, c, g, or t
  misc_feature (280)..(280): n is a, c, g, or t
  misc_feature (339)..(339): n is a, c, g, or t
agatggccaagattctgttttcatcaagtcgacctggggatactgtggttgtgctggaagggctaacctaaggaaaattggtgtatcccccccncacaaagaaggcaccctgggtcttttgacgtggttccgtgaaaagatgccaatggcaacagcttttccactcgactttccaacatttttgttattggcaagggcaacaaaccatggattttttttccccgaggaaagggtatccgcctccccattgntnaaaaaaaagacaaaagactggcggccnaacaaaacagtgggtgaaatgggtccctgggtgacatgtcagatttttgtacgtaattnaaaatattgtggcagga

SEQ ID NO: 490947 - DNA, 105 bp, Homo sapiens
tcgggcttcagtgtgctgtatcctcagaagtgaggcatctcggtcattctgcccatggcacagggtgcagagaggcagcagtggctcatgcaatgctggcgaccc

SEQ ID NO: 490948 - DNA, 170 bp, Homo sapiens
  misc_feature (37)..(37): n is a, c, g, or t
caggatgagggggcagaggagtaccaagcgagggacnattggagaaaatcagatccacagatgaaaagcattacacggacaagaaccccaagaagaagttaagagcttcctggatcgcaagaagggatttaccgaagttaagtcgccgaatggagaattcatgacccccg

SEQ ID NO: 490949 - DNA, 362 bp, Homo sapiens
  misc_feature (23)..(23): n is a, c, g, or t
  misc_feature (54)..(54): n is a, c, g, or t
  misc_feature (56)..(56): n is a, c, g, or t
  misc_feature (90)..(90): n is a, c, g, or t
  misc_feature (109)..(109): n is a, c, g, or t
  misc_feature (146)..(147): n is a, c, g, or t
  misc_feature (189)..(189): n is a, c, g, or t
  misc_feature (207)..(207): n is a, c, g, or t
  misc_feature (257)..(257): n is a, c, g, or t
actttcgtggatttcaccagcantagctactagtttttttcctgtaagctcccntnattcttatgctaactaacaggctggaactgaccnctttgaagaacctcagtanagcccatcctgatgacattgcgagactcaaagagacnnagagagagctagggctttaaaaccctgagctttaagactccnactagccttcgtgctccntttggcatgcttaacgctgcctcagctttcctcactctgctactaactgngcggactactactgaaaggccaccacgctcctaaggctgaacactaagctgagactgacttcctagcttacagacctctagaacaatttccacgcacactacgct

SEQ ID NO: 490950 - DNA, 175 bp, Homo sapiens
  misc_feature (53)..(53): n is a, c, g, or t
  misc_feature (67)..(67): n is a, c, g, or t
  misc_feature (122)..(122): n is a, c, g, or t
  misc_feature (127)..(127): n is a, c, g, or t
gtatactgacccccgcttacctaaggatcacatcccggcatctgagttgcggngcgtttccatgtcngagttgaagaccgacgtcatccatcggggcgactgcttcgaggtgctgcgcgccntgccngacgcttcggtcgacatggtgttcgccgaccccccctataatctgcag

SEQ ID NO: 490951 - DNA, 946 bp, Homo sapiens
gatgttggccgtcagcattcaccaaataaacttgctctctgggccaaaaaaaaaaaaaaaaaaaaaaaaaaaacacttttgtggcgcggcttggccccgggaaaaagtttttaagacccattcgggtgggggcgcgcgggggcccaacaaggtatggcacagtggacacctggggcgcaaaagcgcgggtcccaaaggagaaacccggggggcacaagcagacaaagggggagcgagagatccctaccaaatataaaaaccgcccggggggggcaaaaccggggcgtggtctcgggaacaaaatctcccaaaataggggacagccacagggaggggcacctaacagggggcgtctccattcacaagcgggggatgcccaaacagcaggaggtctccaaatatcccaaaatttaaacgcccccaggccttggggtgggggaggcacaacagacacgacaatcacaacagcaagacgatcacccaagaaacgccacacgatcatcaagaaaatacaaatctcgagaacgagagaaaccaacaccagatagcaagcaagacgtccaaacctacccacagcagcataacacaacgagcacaagaaaaaacagcaagacaaagacagccaaacgacacgaagcccgtaatgcggagcgaggaacaggcgcgaggaggaggacaaagacgccccgccggcagggcggccaggacctgggagggcgagaggcgccaagatataatactaagaaacaaaaaaataaatcatacatcatcaaaaacaccaacaaccaacaaatacatgaaccatagatatcaaaaacgaagctcactgtaacattaatcaaatcaaacataatcacaacaaccacaacaccacacaaactccccacaccacacatataacaaacatccaccacaacaagacacacccataacatatacaaaaaaa

SEQ ID NO: 490952 - DNA, 186 bp, Homo sapiens
tgtgttatctcgtagagtctgactgctggcgtcaagcttgtgttctggcctgtctgttttaactcagtacacagttatgactggacgtcgttttaccctcaggaaacagttatgactgggcgtcgtttaacactcaggaaagagcaataccggggcgccgtataacactgaggaacgagcatataa

SEQ ID NO: 490953 - DNA, 591 bp, Homo sapiens
tggtcttgtttttggtgggttcctcggttcatcgtgtcggtctcttgggcgagctggcgcgaggtccctctctgcgtggttttgttgtgcccgtccctgctttgcttttgtgcttcccctgggcggcgctgactggtccaggccgggccctggtttggggcgtgagctctgtgggtgctcgcgtgcgttccgtgattgcgccgctgcgtgcccgcacgcacgtgtcgtgcaggtctactgggcccccgtgtacgtcccgctccgctggtatgtgcgctgtcctccgtattgtgctcgcatatcggtatatgtgcaggcggtttgactgcctcgtgtctgccttcccgctctccttttgttccctctggatttcattcgactccacctccttcccgtaccgtcgatcgatactccaacctgataatcacaagacataacttaacactataacagagaagacaagacacataaatccttaatacaaaatatacacacatcaaataacaacaaataatacataaacaataaaacatacaataaaataacaattccctcaacaaataataacaaaaacaatatgacataacatat

SEQ ID NO: 490954 - DNA, 750 bp, Homo sapiens
tgtttaagctggctgacgggacagtgagaagccagagctccagcggcgccgcggggcggccgtcaatgaccagagccggagccgtcactcacctctggattagcctgaagcggagactaccggctgcggagcggcgtgtggcgagacacttgctcgcccttttgacacccatcatgtcgcggggctccatctgagattcccctccgggacactgacgagcgtcattgaacttgattcgatcagttaccggagggagatgaagctatcagtattctgaacacaggaacacaacacaactgcacatatggatgcttgcgcgctggaatacctacaagcactggaaaaacagaagagttgcacaattcgtcggaagcagcacgtatagatgccattcggactatagcagaccatgaaaaaccaccagatgacttgcttggactacataggcagcgtattattgtaacaagcaggctcgcaacgaccatgaccttctccgtccattacacaacggatcttattcgcacagtgccacctttgttagtattacaagggggcgcactcacacatccttcatggtctgcacagcaacaatttgttggggaacgacacctgtgttcttgccctaactcgcacggtggaccaaccttggattccaggctgattgcacacgctgcactcttcttcctcagtcaagtcttccacatctatattcccgcccttctgtctccgttgcttaccaaccacagcccg

SEQ ID NO: 490955 - DNA, 255 bp, Homo sapiens
  misc_feature (3)..(3): n is a, c, g, or t
tgncagggccaaatatgagacagattggaacgatggagatcacccggagagcaagaagctggctacccagggaagactcaatcagttctcaacttggacccatccatcctcccccaaggactacaatgacagaagagtacacgggtcccagacggcatgggtgggcctgatcattggcagaggaggtgaacacattaacgaaatccaacaggattcaggctgcatagtacagacttctccagattgcggagtatg

SEQ ID NO: 490956 - DNA, 229 bp, Homo sapiens
tcggccgtcttaccttgcattaccacagagtacgagaattactgccagagctaacttttatgtcattacgtttcttaataaatgtaataaaatgtactaaccacatcccaaccaccaacccccagatgtagagtgccctaagagtaaaagaactgtaatgaggacaatctaggtatccacaattcattcaacgtgtgattactgcagctgttatagcacacacacatat

SEQ ID NO: 490957 - DNA, 684 bp, Homo sapiens
  misc_feature (12)..(12): n is a, c, g, or t
  misc_feature (65)..(65): n is a, c, g, or t
  misc_feature (87)..(87): n is a, c, g, or t
  misc_feature (89)..(89): n is a, c, g, or t
  misc_feature (116)..(116): n is a, c, g, or t
  misc_feature (120)..(121): n is a, c, g, or t
  misc_feature (125)..(125): n is a, c, g, or t
  misc_feature (146)..(146): n is a, c, g, or t
  misc_feature (153)..(155): n is a, c, g, or t
  misc_feature (164)..(164): n is a, c, g, or t
  misc_feature (166)..(166): n is a, c, g, or t
  misc_feature (172)..(172): n is a, c, g, or t
  misc_feature (176)..(176): n is a, c, g, or t
  misc_feature (184)..(184): n is a, c, g, or t
  misc_feature (200)..(200): n is a, c, g, or t
  misc_feature (221)..(221): n is a, c, g, or t
  misc_feature (223)..(223): n is a, c, g, or t
  misc_feature (243)..(243): n is a, c, g, or t
  misc_feature (248)..(248): n is a, c, g, or t
  misc_feature (257)..(257): n is a, c, g, or t
  misc_feature (260)..(260): n is a, c, g, or t
  misc_feature (286)..(286): n is a, c, g, or t
  misc_feature (316)..(316): n is a, c, g, or t
  misc_feature (322)..(322): n is a, c, g, or t
  misc_feature (331)..(331): n is a, c, g, or t
  misc_feature (356)..(356): n is a, c, g, or t
  misc_feature (360)..(360): n is a, c, g, or t
  misc_feature (368)..(369): n is a, c, g, or t
  misc_feature (377)..(377): n is a, c, g, or t
  misc_feature (382)..(382): n is a, c, g, or t
  misc_feature (384)..(384): n is a, c, g, or t
  misc_feature (391)..(391): n is a, c, g, or t
  misc_feature (407)..(407): n is a, c, g, or t
  misc_feature (409)..(409): n is a, c, g, or t
  misc_feature (427)..(427): n is a, c, g, or t
  misc_feature (450)..(450): n is a, c, g, or t
  misc_feature (547)..(547): n is a, c, g, or t
  misc_feature (668)..(668): n is a, c, g, or t
gctgctcgtgcncgtgccgctgctgccagctgctggcccaagggcccggagggcgaagggaaacnggcatgcggtgtactggaacancnccaaccagcacctgcggcgagagggcnacannaagnaggtgaacgtgaacgactatntggatannnaaagcacgnantaaaanagcncgggggtnggccccggggcgggancggggcccggaggcggggcanancagtacgtgctgtacatggngagcngcaacggcnacngcacctgcaacgccagcaagggcttnaagcgctgggagtgcaaccggccgcacgcnccgcanagccccatnaagttctcggagaagttccagcgcnaaancgccttcnntctgggcnacgantnccacgcnggccacgagtactacnanatctccacgcccactcanaacctgcactggaagtgtctgangatgaaggtgttcgtctgcagcgcctccacatcgcactccggggagaagccggtccccactctcccccagttcaccatgggccccaatgtgaagatnaacgtgctggaagactttgagggagagaaccctcaggtgcccaagcttgagaagagcatcagcgggaccagccccaaacgggaacacctgcccctggccgtgggcatcgccttcttcctcncgacgtatcttggcct

SEQ ID NO: 490958 - DNA, 118 bp, Homo sapiens
tccctgcaggtgcattgttatatttctaacctcaactctttgagagacgaagtcagtgagatcacttgatgccaggagtttgagaccagcctggacaacattgcaacacggtctctca

SEQ ID NO: 490959 - DNA, 186 bp, Homo sapiens
gtcgacataagcacactagattcttagtttccatgatcacaactatacctttgtagatgatgattccttggtcatctactctagagagattttactcatttttcgtggcttttgagaatttgaacaaaggattcattagagctatatgtattctttcatactcacaatgtgagttaaaatatctta

SEQ ID NO: 490960 - DNA, 486 bp, Homo sapiens
  misc_feature (438)..(438): n is a, c, g, or t
cctgtaggaaaaatataaaaatgttacatatcaataacctattaataacacctgatgtattattgagataacagacgttttcaaaaattttccaaatattcaagtaaatacaatgataaataaggtttataggtagctttactgccatatgaaacaaaaatatttataacatgtttataaggaccagtattaagtctggtcaatcatatccctccttatttaccagggttaaacgtcctggagttaacttcatttacttttttaaagatctttctgaaagggatattgctatgcttgtactcgaactgtactgtaacgtaagtaatttaattaaaaacccatttttctgatattacttttttaaacatttatctcaaaagaggtatttaagggcaaaatttttcatttaggtatttttacagtgtttggggcccccancaaataattctgaggattcggctaaaatttcttaactgtttttttaaa

SEQ ID NO: 490961 - DNA, 515 bp, Homo sapiens
gcggcagtgatgagcttgccgaccagactacaacgatcaagctgtaccagagcagatcttaaactactacagagctaatgaagtgcagcagttcagatactcccggccgtaccgaaaaggagacacggatccagacaatggatctgctacgctgtggcttgaccggaccccgtatacgactgcatataccttccctgggattctcaagtggtttgcagtcaaaccgatttcaacagaagagatcagtcctctggagcatgccatcgaaaccatggagctgaccaacgagaggatcagcaactgtgtacagcagcatgcctgggaacggtccctctctgtgcaccctctctccatgctgctcagtggcatcgtggacccggacgtcatggggggcttctccaactatgaaaaggttcgcttggtcccagaatcccctagggattcaaagacctgggtgtctgtgtgcctccctctgtgccatttgccactgacaaattcatttcctacagctgctc

SEQ ID NO: 490962 - DNA, 655 bp, Homo sapiens
gcgaagcggtatacagtacagagggtggggttgcgggcctgacagctctatgacagaggcgaggctctcacgagacaggctattagagccagccttctgaggggacatacactgctttctatttgcgaccgcccatcttctagagacgactggactaggatagcctggcgtgagttatgaaggagagcgtctatatgactgcgcaaagagactcgagtctagtggcacgtactttcagagcaccggtcctatggctctacgatgagagaggccatttattccctcgcagatgccactagcgacgcgcgctagagatatgtaatgagtgtctaccattccccaccttgcttaacagggggagggcaggttttttagaaaaggacaagcacccccaaccgaacccagtgggtgatggcaccttctcaaaatactggccaaagactcacaggtccaaaagaaggaatgttcttaaaccgattagaagagattttagatggtctttgacccatcacgaatttgtgaagatcatggaaccctctttccggcggtgggcaaatgtgttccggccaccctttcagtgggggaccgggctcttttactggatagggatcctccggggttaatcagggcaacccacgagattttgccctttttt

SEQ ID NO: 490963 - DNA, 1631 bp, Homo sapiens
  misc_feature (589)..(589): n is a, c, g, or t
  misc_feature (733)..(733): n is a, c, g, or t
  misc_feature (833)..(833): n is a, c, g, or t
  misc_feature (1631)..(1631): n is a, c, g, or t
gactcgttatcatgggccgagcaccttgatgctccttcgagactccttggcctcagtcattctacagcgcaacgcagcgcacctatctattaagcctagaccgtgggctgtcgcacgcgttatctggagcggtgcgcagactgaattatggcgcctttctgcgtcgtacgtcagttaatatacactgaccctggatggacactgtcgttacctaccaagtgtgcacacactagactcgccgttatcctgcagtagtatgctatataaggctgagaatgcgatgtcagcacatactcatgcaaccaaagtatgccgctggctcggtacgctcgtacacccgtgtcacactattttacatgcagtgcctaccttagatcagtgctcctgtacttgtcggaaagctaccacctggtagcccagtagttcctgcgccttttagtccattccccgtgctatgcaactgtagtaagtgctttgcatgaattatatctagactttcactatgctagagctattgcacatacgtacacatgtgcggcttgcatcgacgcgttatagatgcgcaatggccccctacccgtttatgttncaccaccatattgcgtaaggtttagaaggcccttctacaagctggttcaaccgaagaaaacccactagcacatggggaccccaattccaaattcaacattggcccttcatgcaataaatgtagtagagagatactccctaggtncccgatttggaacccctctagaatcccagggtggccccatacttcaatgtgggccttctctaaagattgaatcctcccgcggcctgatggggcattgttncggcgtttttcgaccgtttcgcgagcactctccaactagagccgtctctcggtcaagtacattaggggccccttaacatgagagcccataggaagggaattaaagccgagtaattaccccagggtggagttcgggcggccggattgttgagatcggcaggaaggaaaagaggcaacaattaccccaagagggcttcaccctagtaggtaggccaactgctttgttccccaaaagaaggggtcgtctcggaataccagggggagtacagtcgcgtaatgttaattagaccgtctagagagagtttggtccacatttcacgcggagagagatactggccttgaaggcccttttgcagctacgtcccagggcctaggtgccctatagccccccaagttattcggggggcactttggcgcgcccaagaaaggggcatatagccgcgggggaatatccccctatagaaaggtgcccaaatcgtagaaagcgatccgggcagttatacccgggttgaggggagcatacaactagcccgtggggtcccgatattaaattgaaacagacgaagaggacgatatctacacaggcggccacaaaagaaagggggctatgaaatactgcataaaacagagatgaggctcccaaatgtaagggaacaggggccaacaatatgagaaggccgaatgtaggtggaatacccacatcatgcggaaagttacaacagccgaggcgggtgtgtctggaagatttcgttggcatgactatatcatgctcgatctgcgcttcattgtgcgctctagn

SEQ ID NO: 490964 - DNA, 468 bp, Homo sapiens
  misc_feature (11)..(11): n is a, c, g, or t
  misc_feature (162)..(162): n is a, c, g, or t
tctagtcatancaggtcacactgataataatgtgctttcaaggtgtattactgccaacacaattcatgtctggactttcaggtttccacaagaaactggacttgcagattcatcggagaatgtcggctcccaggttccatcaagctgacatactgatatgtnacctccctcaaaggtatacccttctgcacatgacacagaaacttggctattcacactgaaatcgtccccatgaacaagtatatgtgttatgtggtcggggagaggacattctttaggactgcaggagattctctcagggaaccagcgaccatctttctgacaggtgaatgtatctgtatctgtatccatcgtataaccttccagacatctgagtttcacttcactttcataggtgtgtgcctctccagttgccactgcctcggcgacagagggtggggacccacaaggtataagggctcccgtggg

SEQ ID NO: 490965 - DNA, 677 bp, Homo sapiens
aaacttctgtgtacagagcagccaggccgagctgaaagaggcggtggaagagccatcatacaaagatgttatggagaacaagagaggaagaggaggaggaggaggaggccaccaacacccaccctccagacagcctccccagccagaaatacccaggcccacagcgccgagggggacagtgagggcctctctcagggctctggatgcgacagagagaagggcctgagctgcacagccagggatggcaggcaaacgcagagaagaggacggagcgagagaggcaggaggaggctgaggctggagaggaggctgatccccgaggaagaaggccccactgtagctgctagaacccccacccgagccttggctacaaggagatccggaacaggcgagagtcggtcggagagctctggctgtggactggagctgggaagcctggggctgaggaggctcaggaacccgaagggaagggagaacaggagcacatcccagcagaaacgagcgaggaggaggagatggcagtggatcccgcaaggaccatcttccaggggatgggaagagcggagagctggagacaggaggaggaagcggctctccaaggagtgagaggactccaaaagctggaacaagatggaaccagctgccaagggctgacggctgaaagcggtggagggcag

SEQ ID NO: 490966 - DNA, 411 bp, Homo sapiens
  misc_feature (8)..(8): n is a, c, g, or t
  misc_feature (20)..(20): n is a, c, g, or t
  misc_feature (39)..(39): n is a, c, g, or t
  misc_feature (58)..(58): n is a, c, g, or t
  misc_feature (96)..(96): n is a, c, g, or t
  misc_feature (114)..(114): n is a, c, g, or t
  misc_feature (133)..(134): n is a, c, g, or t
  misc_feature (257)..(257): n is a, c, g, or t
  misc_feature (305)..(305): n is a, c, g, or t
  misc_feature (378)..(378): n is a, c, g, or t
  misc_feature (383)..(383): n is a, c, g, or t
cctgatgntatacaaacccnagacactgaaatgcttacngattaaagaaaacactacngtctaaaatgccactcaccgcagaataaatctgcagcnggaaaatctgacctttanccctgaatctgcctctaannagctgtgtgatctggggctagttagtaagtcactctgaatcccaatttctttatcagcatttgggacttcctacttggggtgcctatctctcaataggcagaaagtgaggtagaatgagattnaggatgctgggcacagtggctcacgtctgtaatcccagcacttttggnaggcaagggtgggtagattgtttggagaccagcctgggtagacatggcaaaaccctgtctctacattttgttnaccanaaattaggccaggcattggtgggttgca

SEQ ID NO: 490967 - DNA, 682 bp, Homo sapiens
ggatttttgtgtccgcacgctcctgctcctgactcaccgctgttcgctcatcgccgaggaacaatgtcggtcatggaagcccgcgcgcaactagccatggctttctaaggataccggaaaaacacccgatggagccggacggtaggcaattcaccgacattcgaactcaccctaaccaagccgcacacgtacaaactcctctggacaccggtgtgtgcctgacctttgataacgacggcgcacacacagacccagaactctcaacagctgaacacggaccagctatcgaactgccctaccaacggacctctgacgcactcacctaccccacgaccacacaactcccttgcttggtcgacagggcttcctaaacgtaaccgctcggcgcactccgctatctcgccaggcactgcagcgaccattgcaccaaacgacggagcgtccacttcgccccttctgacactcagaatcaccttacttggacgcaacttcggcttacaacgccaacgaattaacactactcccccaataaccaacgctactttttggcctggcaccactgggaacggtttcagactgcgtgcagaaacgttacaaccccaatattggccgcgcatttgggctcttcgacgtgttcaaaccttactttcacctcacctccgacagtcccggacctcaaccc

SEQ ID NO: 490968 - DNA, 384 bp, Homo sapiens
  misc_feature (9)..(9): n is a, c, g, or t
attcgcggncgcgtcgacccgccagcaacatcgccaggcggttctgatccaggcccagggtgacacgacgcgggttggccaggtggctgtcgtccaccagcgcctgcacttccaccagcatcggccgggtgccttcccacgttgccatcaccacactgcctgggacttcttcctgggcacgggtaagaaaaatcgccgacgggttggagacttctttcaagccccggtcagtcatggcgaacactccgagctcgttgaccgcgccaaaacggttcttcaccgcccgcaacaaacgcaaccgcccatcggactcgccttcgaaatacagcacggtgtcgaccatgtgttccaacagtcgacgcggccgcgaatttagtagtagta

SEQ ID NO: 490969 - DNA, 328 bp, Homo sapiens
aggagttaacctcgagcgacatcggtctccagccatcagtacagtgaggcagttcttgaaaaccagacagaacagaaggtatcactgtgcaacgtcccttctgtggtcacggcgccctctgagtcaggataatgagagaacattcttaaaacatgacctaaccacgctctgtcctcaaacaaattcctggatgtgtgtggagtaagctctcccagcaagcctgagcacagacgtgcgggcgggcttgttagcactcttctgagttgctccctttacaaagccaccttcccagccagttcatttgtattaaagtaaacttttaaaaata

SEQ ID NO: 490970 - DNA, 161 bp, Homo sapiens
ctcgggcacgcgctgatcatgaggacgtaggcacagtggcctagcagccacctgctaggtacggccgagtgtctggcaacctggcggcggctcaggtccgagctaccttttcctgctggctttggacctaatctgaggccccgttgggcacctgggttaca

SEQ ID NO: 490971 - DNA, 143 bp, Homo sapiens
agccagaaactaaattacagggcccaaccaacattagaaaaatacttgctataacctggaatctttcactcaagttttatattggtgtgagacttgtgtaaattatatgctttgatcctctaacacacgagtatatcacaaat

SEQ ID NO: 490972 - DNA, 971 bp, Homo sapiens
  misc_feature (48)..(48): n is a, c, g, or t
  misc_feature (764)..(764): n is a, c, g, or t
ggcgggggggccgttaggggcgagagtttagtcttaagaaaagcctcncgtatgctggccaatattctgctcaggtctgtctttgggagagagaaagaatcttcatacacacccattgacaaaatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcacaggtctccttaaattgggcttgcttttgcttgtcctctctaattccccccctcttcgctcgcctcgtatttgtgcctccggattcctgtgcgcccgagccccccccagcgcgtctccggtgaattgcccgccgccgccgtcccctcctcttcccttttccccccttctcccaacccgctcccatctttcgtgtgctcgctgcttcttgtgccgcccggcgcccctttctcctctgtccggcccgcccctcgtcgggccccttcgcggggggccctcccgcccctgccgcctctcggcgctgcaccccgtatcttccccccccctgttcttccccctgcccccccccccgccggtccgtagtgtctccccccccccccgcccccccgtcgcgcccccccctcccttcccccctgcttgtaactctttcccccctcccgcgcgtgtccccccgccgccccggntgccccccgcgccgcgcggtccgccgcgcacgcgccttgcatcaccccccccgctctagtacatgccgcgtgttaacccccgcctcctcccttcgcctcctcgtgcccctcgccgcttccgcccgtgcgtctgcctagctcctctccgtctcgctttttcacttcgctcgctcgcccgccgtactgaataacattagaacaacaaac

SEQ ID NO: 490973 - DNA, 372 bp, Homo sapiens
tccagatgagcgtcccccacagagagagcgtcccccacagagagagcgtcgacgctctctctgtggggcctttgacatgctctcctctcctccaggagtccttgatactctctgtgctgtctcacaaccaggctagcttagggaaccttctctgaactccaccagcagtgtcacatgtacacacagacgtactgtgcggggagcatcggtggtgtcctcctgtcatgctctgttattctcatagcataggacttgccagacttgatattggctggttgacttgcttatttcccctcccagggtggggccatgttgtgagtttggtgagccccaggtacatttgccttcataggtcccccccagagagagcgt

SEQ ID NO: 490974 - DNA, 361 bp, Homo sapiens
gagcttacctcccactgggtggcaggtagactggttcccggcggtgagcgacacacagggaacggtgggtccctcaagctccatcctaaaaccctcggctcggtttcctatcttcttcctcacgtagtgtggagcggctgcatcacttcccctagtggggatgccaaaacggcctcacagcccttcccctctggtgggatattaaggtctctggcgattctcctctatggtaaacactggtgaaaaatggtctcattgcttggtccttctggcgggatttcaagaccccaaatccttcacataagtccttccaacagcgctctcctctccagaaggaaccttttggcaaccaagggggagg

SEQ ID NO: 490975 - DNA, 375 bp, Homo sapiens
  misc_feature (59)..(59): n is a, c, g, or t
  misc_feature (223)..(223): n is a, c, g, or t
ctaaaaatataaaaaattagccaggcgtggtggcgggcgctcgtagtcccagctactcntgggggctgaggcaggagaatggcgtgaacccgggagcggacttgcagtgagccgagatcacgccactgctctccagcctgggtgacagagcaagactccgtctcaaaaaaaaaaattaacatacaaaacccacccatttccagtttcacagccgtggcgaagnggtgtgaagcactgtagcctgccctctctggcgctttcccttctaagccgcagaaaggcaccgcttggagggagccccttcaggcccagacactggcagggacgagcagcagcagttggcccgaccgcccgcctgcacctgccttggcacct

SEQ ID NO: 490976 - DNA, 307 bp, Homo sapiens
  misc_feature (19)..(19): n is a, c, g, or t
  misc_feature (38)..(38): n is a, c, g, or t
  misc_feature (50)..(51): n is a, c, g, or t
  misc_feature (57)..(57): n is a, c, g, or t
  misc_feature (63)..(63): n is a, c, g, or t
  misc_feature (73)..(73): n is a, c, g, or t
  misc_feature (102)..(102): n is a, c, g, or t
  misc_feature (110)..(110): n is a, c, g, or t
  misc_feature (113)..(113): n is a, c, g, or t
  misc_feature (122)..(122): n is a, c, g, or t
  misc_feature (128)..(130): n is a, c, g, or t
  misc_feature (162)..(162): n is a, c, g, or t
  misc_feature (164)..(164): n is a, c, g, or t
  misc_feature (168)..(168): n is a, c, g, or t
  misc_feature (176)..(176): n is a, c, g, or t
  misc_feature (192)..(192): n is a, c, g, or t
  misc_feature (203)..(204): n is a, c, g, or t
  misc_feature (256)..(256): n is a, c, g, or t
  misc_feature (267)..(267): n is a, c, g, or t
  misc_feature (279)..(279): n is a, c, g, or t
  misc_feature (287)..(287): n is a, c, g, or t
  misc_feature (294)..(294): n is a, c, g, or t
  misc_feature (304)..(304): n is a, c, g, or t
ctaaagagatgcccaagcngcagtgcgaactccgcganggagacaaagcnnccgggngctggnaaccaagganggccccaccgacatcttacttctcggccntatgcccncgngttttgcgncaagcnnnttccagagcccttccacactcaaaacgcacangngatntcacaccngggagaagccataccngtgcaagaccnncggacggtgcttttcggtgcaaggaaacttacagaaacatgaacggatccanccggggttganggagtcgtctgncagtattncaacacngattcacttnaat

SEQ ID NO: 490977 - DNA, 738 bp, Homo sapiens
gctcgccgcggttccgcggcctggcgccggctgcgcagcagagcgcaccgggccgatcgggcgagtggccatggcgggcgccgaggactggtcgcgggccagacagctggagctggagctgaggacgaggctgtcctatgtttgcccgacataggtggctgcggcatgcaccgcgcggggacccgacgaagctggccatgcggcatcgtactgcgtccaaggtcaaagacagcgatccaagagagctgagatgcatcgtgatggaatcactggtagcgtatcaaggtcttcgagtacaggctccaacaataacgcgtgggatcgcgacttcgttcgcattggtctagtcgatagggtcccccaggcttttgtggcggaaagcggaacgaacaaagcgcgccccttcgggttccgaagtagcgtccagggtagggttttgggttagtcgaagggggaggccattcgtttccgaggtttggcacgttgaaccctgtctcgcttctgcttacccttggggtaccccgcttgggggtttaaccaaacccatttggggcgcgtttgttggccccttggagaacctaatcccaaagttggcggggggcgggaccaattccattggatttggaggaaaagccccgttggagcccttcgacatttttgcgttggcgcggagttaaccacgcggggccgtttgatacaaattgccccaggaaaaaccacgccgttgttcccccggac

SEQ ID NO: 490978 - DNA, 457 bp, Homo sapiens
  misc_feature (449)..(449): n is a, c, g, or t
gtaggacccccaaaccagaaaccaggagtgaagagccagggagcatgtgtggaagtgttctcgggagcccaccaacatttaagggttaggcgcaccaggtgtgatggctcatgcctgtaatcccagcactttgggaggccgaggcgggcgaatcgcttgagcccaggagtttgagaccctcctaggcaacatggtggaaccccgtctctacaaaaaatacagaaattaggccgggcgcggtggcttatgcctgtaatcccagcactttgggatgccgaggcgggcggatcgcgaggtcgggcgatcgagaccattctggctaacacagtgaaaccccgtctctactaaacatacaaaaaattatccgggcgtggtggcacgcgcctgtagtcccagctactcaggaggctgaggtgggaggatcgattgaacccaggaggcagaaggtntagggagc

SEQ ID NO: 490979 - DNA, 487 bp, Homo sapiens
  misc_feature (113)..(113): n is a, c, g, or t
  misc_feature (131)..(131): n is a, c, g, or t
ttagttacgaaattaactgttaatagccatatgttggcccttcatttactgtactttaaagtttttgagacagggtcttgctgtattgcccaggcaggaattcagtggtgtanccatggctcaccttcgantttcagcttcaaacctcatgggctcaagcgattttcctgcctcagcctcccaattagctaggactacaggtgcacacccctatgcctggctaattaaaaacatttttttgtagagactgggtctcactatgttgctcagactggtctgcgattcctgggctcaagtaatcctccaacctctactcctcaattttttttagttttggagacagggtcttgctgtgtttcccaggctggagtgtagtggcacagtcttggctcactacagcctcgaactcctgggctgagttgatcctcctgcctcagctttttgtgtagctagactacagtcctgtgcccaccacaatcagctaatt

SEQ ID NO: 490980 - DNA, 191 bp, Homo sapiens
tattgtcatgaaataccacaatctctcacgagataaggaaaatatctatttaatgaaaggtgggaggagtgactgcattcttcaacagtctcaatgtgcatcaaacaggacataaatgtcataagatttgtgtaaatgttcacaattaaaggagactatgccaagcatggtggtccacggcatcacgtggg

SEQ ID NO: 490981 - DNA, 252 bp, Homo sapiens
tatcgcacatccagccagccaccaagtcggcttgattcaaccagtgaagcatctctgcatctctctgttatgccccatccccactgcaactgttctagcccaataatggtctcttccagtatttactatttgcagaatactatgttagtcactttatatacatctttttatcctcagaacaattcctatttgcgagtgaggaaactgagtcacagggagacgaagtaactttcccaaggacacgaatgttca

SEQ ID NO: 490982 - DNA, 322 bp, Homo sapiens
aattaaaaaattggccttttaaaaaaccccaaaatttggccccgggttttaattttccaaaaattttctttttgaaaaggcaaattccaggggtcccgcccctcaaaaatttcccccttttttatttttccttaggccctaaaaaacggcctttggaaacctgtgtttccttattaaagcttaatttattttttaaataaaaaggatgggctttgggggcaaaaaaaattaaatgaattagtccccccaatgttggctggtgttaatgtgaaaattaaacccctggttcccctttttaaaaaaaaaagttttctttgaatta

SEQ ID NO: 490983 - DNA, 155 bp, Homo sapiens
accgacacctccagcgccgaccagcggaagtgactggagaggttcagacgtgaactccccactgtgtctctggtccccgtggaaatgaagaaggtgtagggccgttgttcggcaccctggagggactctgggcggatcctcctgctagccgagca

SEQ ID NO: 490984 - DNA, 176 bp, Homo sapiens
ctctttgccgaaattgcgcgtgaatgatagcggcttgacgagagggtctgatatcgcaattgagtttatgatcgcttccgttgcgtccttgcttccgtcattgatgaatactatctctacttcgtattgctgaaggtcttcaaactctctgacggttttgtaaaaaattggtatcg

SEQ ID NO: 490985 - DNA, 115 bp, Homo sapiens
taaaggatttgaagttagcttcagtatcaaccaagctctgcaatttacacgaccactgggaactgactcagccttgctgagtctatgtatcctcagtctgcaaagcagcgcaaaa

SEQ ID NO: 490986 - DNA, 278 bp, Homo sapiens
aatttaagaaagcttgtctagaaacaaggtgtggactatccccccatcgttatatatgccatgattggaaatgatgtttgcagtgggaaaagtgacccagtcccagccatgaccactcctgagaaactttactccaacgtcatgcagactttgaagcatttaaattcccccctgcccaatggcagccatgttattttgtatggcttaccaaatggaacctttttttgggataatttgcccaacagatatcatccctctactattttttaacccaatca

SEQ ID NO: 490987 - DNA, 696 bp, Homo sapiens
cgcgtctgtccgtgcggcccggtccggcccgaagcatggccggcgtcagcttcagcgggtcaccgcctggagctgctggcggcttacgaggaggtgatccgagaggagagcgcggccgagtgggctctgtacacatatgacagatgggtccgatgacctcaagcttgcagcatcaggagaagggggctatgcaggacgcttacgggacacttttgagaaccacgagaggtgatgtacggcttctgcagtgtcgcaggactcccaagctgctctgccagaatactgtgctcatcaactgggtgggcgaagatgtgcctgatgcccgcgaagtgcgctgtgccaggccaccgtggctaaggtggcagagtggcttaccagggtgtccgaccgtgatcgtgaaacgccagtcacgccgtggaagaccactagacgcgggtgccactcggggcagcgggagtctctaaaggggtcgttggcgcgactctccagccctggtgctgccaccgacatgcgtggctgtcagacgaggggctgcagaacgcagacgcccgtgggctccacctacacaggaaggcacggagtgcatcctgtggaaactgacagcggattaaccgacgagcaggatctggagagcaggacaaggagggacagaagagctgcggaacggaggcggagcggaagccggcctggatggag

SEQ ID NO: 490988 - DNA, 827 bp, Homo sapiens
tggtctaaatttaatgtatacgggtcctccaaatgtgtggaagggtggggggcatccatatatgtccccccaggttaatggagggttcctatctactaataagggactttatctgcttcgaatgcagaaaggcttctacaaatcatagaaaatttattaatataaactggctggtaaaagaagaaatagaatgagacgccatacaggatagataaaggatgtgtatccatggtgggtgtgtaatcgctatcggggagtaagccccggagtaaaacgtgctcggggagctattcctcggggaaaaagggccggagaaacgagtgggttgtgtggggcgcaaccaacaactgtatcaaaaatataacaccgcccgtattagacatcatcgtattaaggcggacaatgggaatataggcggcggcaaagtgtataggggccacgagcgggggtgaacaaccaggaaaaaataagggggggaaacacactgcgcgaggaatgaagaaaagctctcactcatacatggatggggggcaaaagataaccaacggactcactcaaatatagaggaaaacagggagaaccaataaatgcgtcgggcaagaagcgtagaaagccataaccaaacgcgagataagaaacagcgagatgaccgagggataagcaacacggaagtgactcatacagggtgaaagagacagataagtggcagaaaaaaacaccaagagtgtgtcccaacgctacgagtggcgccacacccaagacgggggggggaacaaaacgagaaaagagagatgaagacaccccaaaagggggaccaccaaaaaatc

SEQ ID NO: 490989 - DNA, 281 bp, Homo sapiens
aattaaagttcgggtgggggcccaattcttggcccgacttcctgggaagggtttgtttgaagaggggggttcttttcccgcttttttttcaaagggttaacggggcaaaaaggttaaactccggggggaactttttcttggttttttcccggggcaaagggaaaaaaatttgggaagggttgaaaaaaatttggttttccctttttggggggggatgaaaaaaaggggtggggggtttaaaaattgaaatggttctttttggggaaaaggtttttttccca

SEQ ID NO: 490990 - DNA, 633 bp, Homo sapiens
gccgggctcgggggcgcagccggactggacggcggctcctgtgggcacttggccgggtttgctggtttttcgggaaataaggccactggggacagtcactacgttttcaggaaccgctcagcccctctgagtgccccgcagatggacctggcggcgttcctggctacggctgactgggctcccggagctaggagcgcccctgcgggcccagcctgggccctgggcggtgggagggcctccgcccccttcccgcttccgccccgctggcgccggacccccgtcctcgtctgtgcctgccaggccgggcccttccctcccgtcacaggcggtccctgagcccacccttcgtctccgagcaggctggaccggcgtatagcgtttgccagctgagttccaggatgtccccgagtatcttaggaaagggccgtgttggacaaacgcggggctcggtgtttcttccgcgccgtccctcgctgctggcgccggggccgtcggaggctcagtgatggcccagcccgcccgtttccgagaattccccaaacgcgggcccctacacgctgagttcgcgctctcccgtgacggcgacagcccgcggaccctgctgacagcacactctgggctgcagagggtacc

SEQ ID NO: 490991 - DNA, 186 bp, Homo sapiens
agtactcattaatttatgaagcatacaactagacagtttcacttgcccaaccagtatgttctgtcctatacaatgagttatacaggaagccagctcacctgaaggttgagaacaagttggaatataacaaagacactttttttttttttttttatcactcgggtggcggaaaaataagagggggac

SEQ ID NO: 490992 - DNA, 351 bp, Homo sapiens
  misc_feature (177)..(177): n is a, c, g, or t
  misc_feature (181)..(181): n is a, c, g, or t
aagggaggggaaaaaaaaaaaaaaaaggaaaagcacctgtctttctctccctctcttttccctttttttggcacatcttttttttaaaacggtcagatcatttcagtatttcaaatccgaggaaaacagcccccctgctgctgtatttaaagttgtaatggggtcaaaaagtcccgnctgnctgccacccgccagtcccaaaggggctcattaaatcataaaaacttgccaaggaaaaaattgggcattgccaccaacttggcgccggtttaaacgtttttattttttttcattattagtcccccccattacgttcattaacaaattgcattaaacacctgttaagggcta

SEQ ID NO: 490993 - DNA, 185 bp, Homo sapiens
ccccttgccctgtccaaagcaaacttcacagcctggctctagtccacgacgaaattagtgccttcatgtagtacattgtagagggatccatatagcatccagtgtgtgatgagagtaggatagaggagcaggtggagactggcaggcacctgctcctcatcctactctcatcacacagtagcgaa

SEQ ID NO: 490994 - DNA, 128 bp, Homo sapiens
tggggcaaggtttggacaggcagggtggaaaggcctggggttgaataaggtgttttaaacccccaaaaaaaatggtaaggagtcaggtaaagactgatgattttcccttttaaactaataattttata

SEQ ID NO: 490995 - DNA, 1253 bp, Homo sapiens
tcccttaatacttctgtaaattttcctgcttataaaaaccgggcaacaatggccttatacaaggagaagggaaggaaatggctgggaaaaggtcctcaggagccctgagccaatgtcctcaaaaaaaaagtagaggcagctggggagatctgggagaggccaaagtccggggccagggcctcagctatccaaaaaccaggggtcttgtctctcccgcagaaaagacatgttacaagatgtgtggtgtgagatctcccatatagcgggacaggggtgtgttccacaacaccatgtgctcttgagaacacacctctctttcttctctctcagcccacaggggaagtctctcacaacgaggggacacgtgggggaccgtgcttactcaagactctcgagccgagagagaggacacgcgtggacacacgtggcgctgtgcgtgaacagaggggacacaagtggccacacacacaggccagtaggagacagagggagagactcccgctgtgtggagacacaagactgtggccacacactctccacacgaccccgacagcagggtgtggcccacacagaagtggggggctctcttcatcccacagcaggggaaaatagtagcgccgacacaggccggttgtggggaagagtctcaccagaggaggggaagttgggtaaagacatcccacaccccggggtactaccaaacgcacaacaaacacacacccctgtgggccgacaaacaacccaacttatacaacaatagtcgccgcagacattaaaggagagagaagtaggccaaaaagacaccccaccaggacagaaaaccggtgtcgacgtatcaatcatgtagaaccaacgtcggtgggcgtcgcccccatcatggtgagcaggattcacaccattccacttccacacaatataacacaccagcgcggtcgaggaggcaacgcaaaaccgaaggaaggcggtagatggccgacaccccacggcaggacgattgtagatcctccaatatataggagggggggcaacccaaacggccccccccaacaaagacagaagtaggacacagtagcaacaaagatcgatcatactaaaccaggatggggaacaaccacacagagggggggacatacatcgtcggagccaacaacaacatcgccaggaaaccacactacgatgcgatgttggcaagcccgatgatatgggagtaacccccgtcgccacactagtgtgggacgaaaaacaacaggcga

SEQ ID NO: 490996 - DNA, 381 bp, Homo sapiens
atggagtctcactctgttgcccaggctggagtgcagtggtgcgatctcggctcactgcaacctctgcctcccaggttcaagcatttcttccgtctcagccttccaagtagctgggattacaggtgcccaccatgccaccacgcctggccaatttttatatttttagtagagatggggtttcactattttgcccaggctagtctcaaactcctgacctcaagtgatccgcccgcctcagcctcccaaagtgctgggattacaggcatgagccaccgtgcccagcaattttttgctactttttgtttgtttttgttttgtttctgagacagagtcttgctctgttgtcgtggctgcgccccctccgcgctgtccgccgggggg

SEQ ID NO: 490997 - DNA, 323 bp, Homo sapiens
tctagaggatccagttccttctctaatacagcaaatactttttatatgaaagtaaaaagtacagggtcacaaggcagaattggtggttctccccagtacacaccggtgttggcacaatctctgggttggaaatggctttttggtccatagtttggcagtaggttcttccaaaaatgttttggtccgggtgggaggaagccagattggttttcccggggttctcccagtcggtagggcctttccctccaagcacacttcgttatggggggtgggaattttactccttaatgggaccagagaaaatcaggggctgcaccaatggg

SEQ ID NO: 490998 - DNA, 110 bp, Homo sapiens
agtcaccacaggagagctatctcccaaactccccgattcctgcgtagtccgcttaactcttgcagacacattctaaaggctatgatatattccaaatggatcaatgaggg

SEQ ID NO: 490999 - DNA, 124 bp, Homo sapiens
tcttaggattctcatgtgtcttaggatggtggaccggagcacattaatagtatgggtttgaagaaggcgtgggtacagatgtgcaggaatggtaggtgtgggtggttgatgcgattgtaatatt

SEQ ID NO: 491000 - DNA, 918 bp, Homo sapiens
  misc_feature (14)..(14): n is a, c, g, or t
  misc_feature (554)..(554): n is a, c, g, or t
  misc_feature (584)..(584): n is a, c, g, or t
  misc_feature (678)..(678): n is a, c, g, or t
  misc_feature (779)..(779): n is a, c, g, or t
  misc_feature (789)..(789): n is a, c, g, or t
  misc_feature (798)..(798): n is a, c, g, or t
  misc_feature (807)..(808): n is a, c, g, or t
  misc_feature (810)..(810): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (858)..(858): n is a, c, g, or t
  misc_feature (914)..(914): n is a, c, g, or t
agtgtgctggaaanccatgccgactgtgtatagggcgaaagtgtcacaatagggtaaccacagctagcatgcctgacctgaacaccaaccacagcgcatttcttgccttgtgtctctactccttaattttgcttcattttccctctcagtaccccattacttgatgatagatagttactgagtgctgctcacctttctgtgacctcggccatgatgaccgtaagaggcccacggtttccttgccagccctgtatcccacatcaggaacagagagccttgcttgcacttagcagaaggttaacaaatgtttgtaggatgagtagctgatctcatgtgagtcgatcattctgatgaaaggaagagtgatcacagattctgatcagttctgggatgttgacacagtttactgcaaagaagaagagcttgagccatactgagttaactaagaaaaatgccagcacccagcacgggcaaagctgccagccggctctcctcaggcattcctttctgtttcctagtgctcactgggtatacctccagtcacaaatataaancagtgacaacaaatgactacaaactgattnatactgacaccaactatagtaatgacagttactaagtactttctatgtgcaagaacatctccagagttggccatactgcgctgcaaaacatttnatcaataacaccccaccaacaagattccagaagacctgaaatctcacctgaatcagaatggctatcagcaagaaaaaaaaataaataacagatgctggcgnagatatgggnaacaaaggntgctttctnnanacnganaanaatgtaaactgtttctgctgctatgggaatcagtatggngattctcataaaaccaaagtaggactactgtacttgcattcttgggtgtatattcnaagg

SEQ ID NO: 491001 - DNA, 836 bp, Homo sapiens
ggaaaaacctcaaggttccacaaaaaaactattaaaactgataaattcagtaaagttgtaggataaaaaatcaacataaaaaatcagaagcatttctgtatgcaacagtgaacaatctgaaaaagaaataaaaaagtaatcccatttataatagccacaaataaaattacatacttaggaattaacgtaaccaaagaagtgaaagatctctgtaatgaaaactgtaaaacactgatgaaagaaattgaagaggataccaaaaaagtggaaagatattccatgttcatggattggaagaatcaacattgttaaaatgtccatactacccaaagcaatctacagatttcatgcaatccctatcaaaatatcaatgacattcttcatagaaatagaaaaaacaatactaaaatttatatggaaccataaaagacccagaatagccaaagctatactaagcaaaaggaacaaatctggaggaatcacattacctgacttcaaattatactgcagagctatagcaaccaaaccagcatggtactggcataaaaacagacacattgaccaatggaacagaatagagaacccagaaacaaatccacacactgagtggaactcatttttgacaaaggtgccaagaacagggaacaagacagtctctttcaatagatggtgctggggaaaaaactgggattatccatatggcgaaagactgaaaattagaacccctaatctcttgcttatataccaaaaatcaatcacacttgggtttaaccactttaattctagacatttaacttatggaacacttacagaaaacatggggggaaaaaatcctc

SEQ ID NO: 491002 - DNA, 298 bp, Homo sapiens
acatacaatcacgatgtaaaagaggcttagcaaaactattaccaaatcccacaactgttcagtctctaattagttgtgctcatcagctccttcttacatacgtctaacacaggcaatgggcaaccctctctcatggaagctaacatcatatggcacctctgtggttctttcatgacccaatttccaacatataatcaacccattactacactatgtacaaaggtaggacactatgactgacaactaacgagacaagaaaaatgatccaagacacccccatggactgatctacgactat

SEQ ID NO: 491003 - DNA, 179 bp, Homo sapiens
tcgtaccggactatgggctgtagctgatttcttattatttttttttttgagatggacttttgcccatcactcaggctggagtgcaatggtgtgatctccgatcactgcaacctccgcctcccaggttgaagtgattctcctgcctcagccttcctagtagctgggattacaggcttgtg

SEQ ID NO: 491004 - DNA, 165 bp, Homo sapiens
gcaagtacccagaagtttgatgttgtttcttgagaagaaagaaggaggaaccgagacatgtgtcattcccatgagagaaaatgaatcacaactcgtgtagttacttggaaatctctgaggtgctaccctcaccccatttcctcagccattccaagagaaagggtt

SEQ ID NO: 491005 - DNA, 233 bp, Homo sapiens
gtaatgaagttaaaatgaggtcattaggatgagtcctaatccaataggactggtgtttttatatgaaaaggaaatttgaacccagacccatatacaggaaagcccatgcgaagaagacacaaaaaggaaacggccatctccaatccaaggaaagaggcctcagaacaagccaaccctgcaaataccttgatttaggcatccaaaattgtatgaaaatacatttttgttattta

SEQ ID NO: 491006 - DNA, 1565 bp, Homo sapiens
ggagagaagcagtccttctagcgggcttatgcgtgaaggctctggtgctgatagtagcacgccaagtccaaaagcacaaatctactaacagggacaagtattcagagacagccacacaggctctctagcaagaaactgtacagcgccagtgacagaagaaaacgtgggacaccagccaggcatggagacaatgctgaaagcaagcaggaacaactcgcacgccctcacgacgacgctcgcttgcgcctgacagctactctagaaacaggacctcccaacgaacatggcacgcctggcaacggacaccaggacgtgctgcatatccagcacaacaacgcccattacactccacacaacatggcacgcgagcccgaggggccccccccggcatctcaagcatcaaagaaaccatagcccataagacacaacacggcaacgcatggcacaccgcggcagccaacacagcaccacaatgccccttacacaggtcgcacacgaccctggaagcgcacgtagcacacgaagaacctacagagcgacaagcacctacctagacacagtaacagacactaagagcgaagaacaccaccaaagaaaaagagaggaaacaaagagacatagacgaccaaagaaccaaataaggggacacgcggccaagcaacacaccaacacgaggccacagcaacaaggacccccactagcacccttaccacccacgcgacagagaaaaacatgcctaggcccaacaaacctaagccccagcttcagcccccgacgagacccaagcctcacgacaaaagagcagaaactccttaagggcgcaccccaacggcagcacgcctcaaattagacggacagcctatcaccacaactagcaccaatgcccaccgccgcccacttgccgaccctaaccccacagacacaaaagcaacatccagaataaaaatctcaccaacacacaatcaccccacatcgcctagggacaacacgcgaccctccagggcacacaccccctgggcaccacaaccacacacctcaactcacgcatcggacgcgaccactgcaacagacacaacacacaacagacaacagccccacaccatcccaccctctcaacactaagcaccacaccacacccaaacaagcagagcaagcactgcaccagaaaacacagtgagcaacgactcatacagcaacaagagaaaccgaaacaaacagaaacacaaccaccacgcagcacaaacagacaaggcacaacataacgcacaccgtccaccaacctctagtcgacgtcccatcgacacaacacatacgccacaaatagcaacatcatctataatatcattaagtctgatcagtagtgcagtaataccccatgcgtcacaatagctcagccaatagcaagtcgtatatcaataccaacactaataacaatgatatctacggcgctcatccacagtcccagattaatttcctgtataccaaacctgcatctctcactcaatactcggtaggtctatcgtaacacactattagatatactacacatcaacacaatactcatg

SEQ ID NO: 491007 - DNA, 321 bp, Homo sapiens
tagggccgcactaaccctgatactcaactcttgccgaggaaaactgcagacccatatcagcatgaatatacactttcaaacaactcccatcataataataacaaactgaactcagcagaatataaaaaacttacttgggtaaatcctgagaacataaggcttattaaactttttaaaatcaatcaatgtaattagctatagtaacagactacagaaaatccatatgattaaatatactggagaaaaaaaacatttaactggatttaacattgattcccaataaaaactcacagcagactatccacagaaagaacttcctca

SEQ ID NO: 491008 - DNA, 292 bp, Homo sapiens
aaataggctgggctcagtggctcatgtctgtaacctcagaaattttgggaggctgaggcaggcagattgcttgagcccatgagttcaaaccagccagaagcaacatggtaagaacccatctctaccaaaaaaaatacaaaaattatccaggcatggtggtgcacacctgtggtcctagctactttggaggttgaggtgggaggattacctgaacctgggacgtcaaggcagtggtgagctgtgattgcaccactgcacagcagcctggataacagagcaagaccctgtctca

SEQ ID NO: 491009 - DNA, 208 bp, Homo sapiens
atctttgccggtattatgaataatgcagaaatcacctttgttcttcagctggttggacttctagagcttgggcgtgggtgccctgcgtcctgcatctaccttctccacggcagctcttgatcggtggctttgagggaaccagtactcctctgtccagcacgggccagaactgcccgtgggggccttgctggctttctcaattgacggt

SEQ ID NO: 491010 - DNA, 442 bp, Homo sapiens
aataaaatttgtctttgatttcactggtggaagggtgcttatcccagcttttgcttcaccatgaggaggactctgtttttcagtttccgctttatttccctctaacgccacccctgcaagctttgcgcagctgtgagtgatgcgccttcttcacttccttgtcggccaatatcttctccagagcccgggtcaggaacatgttcttcgtcttcttcccttcatacatggacccagaaaggaggcggggctctttccgaccgcgggctcaaacggggtcgagggccgccgcgtcggggacccgttttctccgtgcccgggggtcggtcccggccgccaccttttactcgtcctccgtgccctggtggcggtgagggacgccggcccgggcggctgtctgccgggaactgagtgacgaggtggcggcggctctcagaggcaccgc

SEQ ID NO: 491011 - DNA, 126 bp, Homo sapiens
ccaagtgaggtctgttgcattgacagctgcagcctgggactgaccgggagtctctgattgtttacccaccacagttaggttgcgtcctgagtctcaggtccacaggtgaaggccacagcatccttg

SEQ ID NO: 491012 - DNA, 110 bp, Homo sapiens
cacacggcctaacaacaatagattaactggatatgaagcacatacacggccatgtacggaatatgttatgaatacacaggttctgggtgtagaggctcatgcctgtaatc

SEQ ID NO: 491013 - DNA, 1560 bp, Homo sapiens
  misc_feature (1272)..(1272): n is a, c, g, or t
  misc_feature (1339)..(1339): n is a, c, g, or t
ctgtagatgttgtagcacgcccactgtttgttgttatttcgtatccgtctcgtttggggtgttcttcctcgtcttctctgttctcgcgtgtggtctcttccatcgtttcttggttgtcctcctcccgcgcgtggttctgcgctcaccattgtcttctctggtctgccctcattatcaaccgggcttctcgcggcccccatggggtcgccccccccgtgtcttggagactcctttttagtaactctcggagtgggtgttgtggggccaccccactttttcctgtcgctcttttccgtgcaccatggttgtcccccttgtgtggcgcgtaacaccgcctaccctgtcgccctggcgccctcctttccttcggggaccccacacccgcctttgtaggggataataaccaaagggggtggtgaaacccacgagctttacgtcccgcagaatcccagggatgtggaaaggcgccccacccaccactttcacggggccaaataattctgggaaaatttctgaaaaagtgtgtgcctgataaatatctgcgtaaggcaaatttggctttccccagaaaaggtcaccacctcaaatttctggcctcctctagtgacccaaatggggagactttcgcgcccccgattgtaaaggggaaacttcctcaggggcgcccctctctttgtcgtctttaagtctcggataagcatattttaaattggaatatttctcccttcggaaaaatgttttcgcacacagagtgtggatatatcggggttatatgtgagcactcccacatattgttggggtgcccctgtgggttttaaaatagggttctcgacacacactcatcgtggagatttgttgtgacgtctctcacacatgtgtacacactcgtcgtgtacacacgtggtttccaccgcgtatatattgtatatgtaaccgcgcgcacattcacgcgcgcaccacacatatatgaaatccctcttatatcttagagaactctgcccacaatatatagaatatattgttataagaatagcgcttataggcgcttatatatatctccagcccacataatacccctcggatatgtatagagccccccacagacctcgtgagatatataaaacgctctcccacatatataatattaattaaggaagtgtctcatacatgtgtaaaaggggagataatatccatattgagtattatacaccgcggggagagggtgccacagggataagaacacgacacccttggacacgttctccacgtccncacatgttctcaccacgatctcgtttgtgtaagattctcttatttttaagccactacgcacctcgtntgtggaaggaaaaattatcctcgttcttggactcgccacacgtggtgtcatgcacttcttagaatgattttgaaacttcgctatagtgatgggatatttaaccccgaatagcaaatactgttttcctatctgaggccctggtggaattaaaaacccgtatattttactttgttcccacatagtcttgccccctcttggccaattgccaaaatggtggagct

SEQ ID NO: 491014 - DNA, 479 bp, Homo sapiens
gtaacacctagcacatccttttaaccacagttacagttattatctgcctgacaagtccagacctcccacagactcaaatcacaaaagaggaatgaacatactctagttcatgaggaaatacctgacatgtgatcaaattagtgtcacaactagaaatatgttttttggttacgttttgagacagagtcttgctctgtcacctaggctggagtgaagtggcacaatctcggctcactgaaacctccgcctcccaggtttagagtgattctcctgcctcagccccccaagtaggtaagactacaggtacacgccactactacccggctaatttttgtattttagatagagtcagagtttcactatattggccaggctggtctcgaactccagacttcaggtgatttgcctgccttagcttcccaaagtgctgggattacaagcatgagccaccatgcccagcctggtgccatggagtaaaa

SEQ ID NO: 491015 - DNA, 150 bp, Homo sapiens
ggcgcctagaggatcccgggtcggcaaaggagaggagggttcctcttaggtcagaaggaggtctcagagccaagtcctccctctctacggagtggaaggtctatggccaacaatcctttctgcccacttccccttcccgaattactattc

SEQ ID NO: 491016 - DNA, 463 bp, Homo sapiens
ccgttagccccaaagtactgggattacaggcgtaaaccgccgcgcaggccaggacatattcttatataggtatagtctcagactttgacaatagcagataaaagagagactgcatggaaagggaaagtggtgttgccaccatatcttattctgttaactcttacactcacttcaccttgggttcagtcaactcttctagcagttcaaagtatatctaagtaaatgtacttcaatagcacagataactgtgcgcctagatttaagcaaattggatatgccaaagtcagacattattacacatccaatttagggcttaaaattcctgcattatataattcacattccaaatggcctctttttaataggcgatgaaaatcgtgaaaagtagggataaccgtgatgcgcatttacaggggtaagataatttaaacattagtattagaaaactgaattttaatattcc

SEQ ID NO: 491017 - DNA, 133 bp, Homo sapiens
aaccaccggatctttgtcctactttcgtacctgctcgattgtagtctcgcagtcaagcacgcttatgccaatgcactatcgtcacgattccgaccgtaactagcgtaccttcgaactcctccgttacgctttg

SEQ ID NO: 491018 - DNA, 702 bp, Homo sapiens
  misc_feature (10)..(10): n is a, c, g, or t
  misc_feature (17)..(17): n is a, c, g, or t
  misc_feature (21)..(21): n is a, c, g, or t
  misc_feature (24)..(24): n is a, c, g, or t
  misc_feature (26)..(26): n is a, c, g, or t
  misc_feature (30)..(30): n is a, c, g, or t
  misc_feature (42)..(42): n is a, c, g, or t
  misc_feature (50)..(51): n is a, c, g, or t
  misc_feature (56)..(56): n is a, c, g, or t
  misc_feature (59)..(59): n is a, c, g, or t
  misc_feature (61)..(61): n is a, c, g, or t
  misc_feature (70)..(70): n is a, c, g, or t
  misc_feature (89)..(89): n is a, c, g, or t
  misc_feature (94)..(94): n is a, c, g, or t
  misc_feature (96)..(96): n is a, c, g, or t
  misc_feature (108)..(108): n is a, c, g, or t
  misc_feature (116)..(116): n is a, c, g, or t
  misc_feature (133)..(133): n is a, c, g, or t
  misc_feature (142)..(142): n is a, c, g, or t
  misc_feature (146)..(146): n is a, c, g, or t
  misc_feature (148)..(148): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (182)..(182): n is a, c, g, or t
  misc_feature (190)..(190): n is a, c, g, or t
  misc_feature (199)..(199): n is a, c, g, or t
  misc_feature (201)..(201): n is a, c, g, or t
  misc_feature (217)..(217): n is a, c, g, or t
  misc_feature (239)..(239): n is a, c, g, or t
  misc_feature (244)..(244): n is a, c, g, or t
  misc_feature (265)..(265): n is a, c, g, or t
  misc_feature (270)..(270): n is a, c, g, or t
  misc_feature (286)..(286): n is a, c, g, or t
  misc_feature (294)..(294): n is a, c, g, or t
  misc_feature (300)..(300): n is a, c, g, or t
  misc_feature (311)..(311): n is a, c, g, or t
  misc_feature (336)..(336): n is a, c, g, or t
  misc_feature (341)..(341): n is a, c, g, or t
  misc_feature (362)..(362): n is a, c, g, or t
  misc_feature (369)..(369): n is a, c, g, or t
  misc_feature (375)..(375): n is a, c, g, or t
  misc_feature (388)..(388): n is a, c, g, or t
  misc_feature (390)..(390): n is a, c, g, or t
  misc_feature (397)..(397): n is a, c, g, or t
  misc_feature (409)..(409): n is a, c, g, or t
  misc_feature (411)..(411): n is a, c, g, or t
  misc_feature (429)..(429): n is a, c, g, or t
  misc_feature (431)..(431): n is a, c, g, or t
  misc_feature (433)..(433): n is a, c, g, or t
  misc_feature (435)..(435): n is a, c, g, or t
  misc_feature (444)..(444): n is a, c, g, or t
  misc_feature (446)..(446): n is a, c, g, or t
  misc_feature (448)..(448): n is a, c, g, or t
  misc_feature (450)..(450): n is a, c, g, or t
  misc_feature (457)..(457): n is a, c, g, or t
  misc_feature (461)..(461): n is a, c, g, or t
  misc_feature (465)..(465): n is a, c, g, or t
  misc_feature (474)..(474): n is a, c, g, or t
  misc_feature (478)..(478): n is a, c, g, or t
  misc_feature (509)..(509): n is a, c, g, or t
  misc_feature (531)..(531): n is a, c, g, or t
  misc_feature (533)..(533): n is a, c, g, or t
  misc_feature (547)..(547): n is a, c, g, or t
  misc_feature (561)..(561): n is a, c, g, or t
  misc_feature (593)..(593): n is a, c, g, or t
  misc_feature (689)..(689): n is a, c, g, or t
tgtttcttanctcaaanaaanatnangtanctttatttaaanttgcaaannaaaanaananaaatttcangtaagttttaaaaaaaaantcccnancccctgccccantaaaaccnaaccaagccagcctganaggttaaancaananagggagccggagtgggagccaagggnggngtnanaaaggggnggggtacanancaagggggcctggganactcagtgactggaagtctctnccccncactcttggtgagtagctaanttcancagccggcttcaaaangaggagtnaggggngggtggaggcnccccccaattccaaaaccacttccncttcnccttctgtctcctggacactnaggtctnactganaaggttttcccanantaaaaanaggggggggcanantactaagggtcaggagtntnantntttcccatnantnangcctctntgcnaaangtgaccctnaaangaaggagaaaccccaaaacctttagccaatnagtggtggggtcatcataccananagccagcttgactntgggcaggcaccancacaggcacagcacccatgcggctcaagccanaggaagaaaccccaccagggatgggggatattggttgagggtgggccccaacttttgtgggcagttttggtgagggcagggcctggctggagaaantgggcgtgggggt

SEQ ID NO: 491019 - DNA, 370 bp, Homo sapiens
tgaaaatcattccaaaacagatgttttctgtttaaaacagctaaaagtgatcctgtacatgagccagattgtgtaataataaagaaaaccagaacatgtctatcccaccccaaaaagggaacctgtcagctttagttttctccagcagtcttggattggcatattactcatcttaggttcccctctcccttgttatttaaagctgttttgaagttcgtttggctattaatatcaatgcagaaatcagggaaggaaacccttgtggatcatatcatgtcactcagaaactatcctctcaacaaacagagtgaatcaattaaaatgggcagcttgatgactggcccttgatttcttgagttcaacagatgag

SEQ ID NO: 491020 - DNA, 352 bp, Homo sapiens
aggaatctgcattcacccccagtattctgtgcccaactaaccgttttaaggaaatactagtccttgggagatgagtttagatggtgaattaggtgttcagagatacggaatcattgtccatagctgttaccggtattgataatgcagggtatcatctgccactcctggtgttcaatacattgagtcactgcctagacggttctcttggtcttattcccagtcctggccaatgcttaaatactatttgttgaaaataattctttgagacagatttcagctacctcccttccaggttcgatttaacttggttgtaattgtcaatttgttgttataggtcttacctgtgtgaaag

SEQ ID NO: 491021 - DNA, 634 bp, Homo sapiens
gctccgcaaggaggctggtggcggcctgtgtggtgctcgactgccggcctatctgtcctgcgctagctcgaacgtgcgcggctcgctcacgtcaacctcaactcggtggtgctgcgggggcccgggcgtggcggtgtcggcgcgctacgtgctgcccgaggaggcgggcgcgcgcggtcctgcggagggcggcgggggtcgcggcgtggtggtgctggaccaggcagccgccactgggcaagaaagctgcgagaggagaagcgccgcgcgtgtcgtcctcacctcgctactcgcttgcctacccgccggcccgcggtctacttcctcaaagggggatatgagactttctatcggaatatccttgagtgtagcgtggattgtaaaacccatttcacaatgagaagattgagagtgagagagccctcatcagccagtgtggaaaaccagctggtaatgtcagctacaggccagtttatgaccaggtgggccagttgaaatcctccccttcctctaccttggaagtgcctaccatgcatcaagtgcgagttctcgccaattgcacatcacagcctgcttgaatgtctcccgacaggacctcggaggtctgatgaaccaactaaatacaatggatcct

SEQ ID NO: 491022 - DNA, 152 bp, Homo sapiens
ctgatcggcctgatcttcctcggtttcatggccgcgggttcctctacttcctgttgaccgggcaatcgcgtgccgggcgccggcgactggcgatcgctgaccgggctttcaagggctattcggaccgatcgggcttacaatggaaccaccga

SEQ ID NO: 491023 - DNA, 440 bp, Homo sapiens
  misc_feature (377)..(377): n is a, c, g, or t
  misc_feature (392)..(392): n is a, c, g, or t
  misc_feature (403)..(403): n is a, c, g, or t
  misc_feature (426)..(426): n is a, c, g, or t
  misc_feature (431)..(431): n is a, c, g, or t
tcataggggtttgttgtacagattatttcatcactcaggtattaagccttggacccattaattattttttctgattctctctctcctcccaccctccaataggccccagtgtgtgttgttcccctccatgtgttcacatgttctcatcatttagctcctatttgtaagtgagaacatgcggtatttggttttctgttcctgtgttattttgctaaggataatggcttccagctccatccatgtccctgcaaaggacacgatctcattcttttttgtggttacttgatgttatttctacatcataaaaaaagtaatttttattgaaattagttttcataaaagttgtaccagtattgagtcccattaggcctcatctncatctcaggtctctncctcgggttantcttttagggccacagtggggcnggccntgttaggtt

SEQ ID NO: 491024 - DNA, 558 bp, Homo sapiens
  misc_feature (434)..(434): n is a, c, g, or t
  misc_feature (490)..(490): n is a, c, g, or t
  misc_feature (511)..(511): n is a, c, g, or t
  misc_feature (524)..(524): n is a, c, g, or t
  misc_feature (558)..(558): n is a, c, g, or t
gtgacatgaccaatgaggaattcaggcaggtggtgaatggctaccgcaccagaagcacaagaaggggaggctttttcaggaaccgctgatgcttaagatccccaagtctgtggactggagagaaaagggttgtgtgactcctgtgaagaaccagggccagtgcgggtcttgttgggcgtttagcgcatcgggttgcctagaaggacagatgttccttaagaccggcaaactgatctcactgagtgaacagaaccttgtggactgttctcacgctcaaggcaatcagggctgtaacggaggcctgatggatttttgctttccagtacatttaaggaaaatggaggtctgggactccggaggagtcttacccctatgaagcgaaggaccggatcttgtaaaatacagagccgagttcgctgtggctaatgacacanggttcgttggatatccctcagcaagagaaaaccctcatgaaggctgttggcgactngtgggggcctattccggttgntaatggacgcaanccatccgtctctccagttctaatagttcaggcan

SEQ ID NO: 491025 - DNA, 432 bp, Homo sapiens
aagtttagaagcattttgtatgctactttggtatttcttaagtatagtcagcaggaaagggtaacctgttttatgcaaaatttttttaatttgtcaaatgtttttagtgtgtcctactttctgcaatagaataaacaacacaagacccccacaccccaacaaacaaaacaaacaccacaccaagatagaaaagaaaagtatttgaggaaatcttaaattccataagaaagtaattcttgcaagaatgttggctacatatttttttttctgtcctgaataaattacatcattaggtctgttgaagcttttgaagctaccactattctttctgggataaaggctaattactgatttatctgccctcaaaatcccagagttaattctaattgagtactaaattaacagtaagtagttaacacagagaacgagaaa

SEQ ID NO: 491026 - DNA, 969 bp, Homo sapiens
  misc_feature (953)..(953): n is a, c, g, or t
ctctgatgcctctaagatgatgtagccctgcactgttgtgtcgtctggttgatctgtcctgttgttaatactttgatttgtgagcactggtccattgctcggcaagcgtgttcacttgggggatgcgcactcgtccgagtcatgccgtgcatttcatcctgtacacgaatgtcagtctaggccccgggctcgtgcgggttaagctgttagctttatgggatcggcgtactttaaactcttatacgtccattacctttcgaatcttcataaagtactgacatgtttgtcaggtccactggtctccactatttattggatctattcgggctttctagtggttactgaccgcgcgcctgaatgttgtgggtatttaagtaaaatttggggaagatacaatcagcagaagtatgcagaagatgggcctccagatactccttggtttagtcatggaggacacactgctaagatttcagattttagctggaaccccaatgatgccttgggtcatttgctcaagtgtctgaggatacctaatcatgcaggtattatggcaaatggctgttaatatttactatatgatgatagagtctagatgtcacgacatccgtaactggaggggtaatcaaggatctttaaccctatagtacgagaaatgtttctgttgaatgtaatgctacatgaatgcttgatttatcaagcgccaaaaaggcattgtatagtaggatatgtaagtggggtggcccatggcttctttatcctctgattctagcactttcaagtgagctgttgcgtactgtatcatattgtagctattagggaagagaagaatgttgcttaagaaagaacatcaccattgatttgaaatacaagtagcagggtaccccccttgattcaactgttttaagtcactcagtatctcaaactaagtgcttgctgttcccaaataagttaangactaacgattacact

SEQ ID NO: 491027 - DNA, 275 bp, Homo sapiens
  misc_feature (6)..(6): n is a, c, g, or t
  misc_feature (11)..(11): n is a, c, g, or t
  misc_feature (48)..(48): n is a, c, g, or t
  misc_feature (88)..(88): n is a, c, g, or t
  misc_feature (145)..(145): n is a, c, g, or t
  misc_feature (204)..(204): n is a, c, g, or t
  misc_feature (207)..(207): n is a, c, g, or t
aacccnaaaanctgcccacttgtggaacctcggtggcccctgcccctngaaaacccttgcctggtggtccttgaaagcctcctaaaanaccctgccatggcaaatgaggcccaaccttctcccgcttgaatccgtttacaggctnctggtccgctactgcatcgtgtgccttctgtcccaagaggcagagagactgaaactatnctntgccgccctggattctcccagagattgcccggaacacccagctcgggtcctcgcacaccatccctggt

SEQ ID NO: 491028 - DNA, 265 bp, Homo sapiens
aaaccttttatacttacagactcgcacttagggcagcacgctctatctgtatacgatactattcaacttgatactttgtttctgacgttcagcaatgtaatgcttttttgcctctgcgttagctgcgaatacatgctcctttaatgccacctaaaacgtttttaaccttcttaggttgccacaagtgttgtaataccataggtgaatcaacatcgctctgaccacattgagcgcacgaatcattaattaatttagcgcgttctag

SEQ ID NO: 491029 - DNA, 240 bp, Homo sapiens
gagctgtcccagctgcgcgtcgccaagtgacaggcggtgcggctccaagctctctaagatccgagtcgtccggacaatcatttgccgtgttctcacagtattaccagactcaaaagaaacctcaggaaatctacgagggcaagatgtacacgcgcctggacctgcgggctaagaagacacgtgccatgcgccgccgggtcaacaagcacgagtagaacctgaagaccaacaagcgcctgg

SEQ ID NO: 491030 - DNA, 837 bp, Homo sapiens
gccagcaattatggccggcgcctgagcaggatgagccgggtgcgccggacgatctctgcatggcccgcgaggtaacctgggccgttagccgtcagtccagcgctcgcgtccccacggacgcatgactcgactcatgagaaggagctgccggcgtgtgggttctccctcgtagttatgtgcaacgtgtagatgagagatctgacccatgatgtgttaccaggtgaggcatcgattgatgtacacttgaagacgattgtagctcttaggcggacagaacgcttggtactcgtattttcgagatacaccatgctgcgtcgacgcacccttcgtaaatgatctcatagacagagatgagacaggattgcccgagcacctttcctacatcggtacacacagaagtacataggggccctttcacacagtaacgacactatacgccgtgtaggatgcccttcgtaggcgatattgggcctaggtacagacgatcgcccttagaaagacaccccacaggactaggttggcccctggtgagggagaaacgcggggtggaacggtccacgggattcttggcaggtccattgtaacgagcgtttcgtgtagacatgcgcgtcgcaccccttcgaggcgcttgtattaccgacacagaagcctaaccgcaccacgtgtgctttgtcgccattcaggtcacaagagcaattgtactatcgggggccgcataagttgccagcacctctagtaatcttggcgatacgttatcgcgcatagtgaaacaccaagccagatgtagtataaactcacgtaagcttccctcatggaatgtatacttgtcgccggcca

SEQ ID NO: 491031 - DNA, 272 bp, Homo sapiens
attcttttcttattgtcttcatcaaatcttttcacatcaaaaaacacgattcttacaacgtggggtccacacatttggggagagaggagaagcagacggcgagacgacagctgaacaataaacactgacacagagaacacacacgatgacagacagacagctacatcacaaaagaactatataaacataatataagatgaatatgatatgatatgaaaacatgacagcacaccatgaacaccacatatgacaaacacacatatatgtacata

SEQ ID NO: 491032 - DNA, 764 bp, Homo sapiens
gccctctggcaccgggcgccccccgtccccctccgttcccgagagggccctccgttgagccattatgggaaactgccctttcaacctgggctactacccagaggttctggccctcttctacctgcttgaccccctggctttctgacccgtttttccgcccacttccccccgctccatgagaagctatgtcccgctcttcggagactatacgcctgtctccctgtatccctctccacatcccggcccaggagagcatcccgcgagtcctgcaggctgtggataaagcccatggatactgtttcggagccccagagcagcgaagcttggagagccctgatgtctgcccccatgggagccgacttccctttcttgttcccaccactgggcatcccggagaagtacctggccaccctcgaaccccagtccgtggacccggagagccactgcagctgtagcaacaaggtggacccctggagagccggatgcataatcccgccctggggaaagtggaggctcctgatggcaggctgcagaccccagagcaagtgcctcccagccagagctggcgggctggcaaggggatattcagctctcccaaggacttctggccccaaagcccgacatggtgcccagcgagaaccaccccccatactgttcagatggtgtccgtgagctttgggccccgccccccagaaatcggagcactggtcctattcaggctgttgatgtaaatttgcataccaatacaagagtttattttttta

SEQ ID NO: 491033 - DNA, 466 bp, Homo sapiens
gatcagcagtatcgccgtattgtccatgatgatctcatgcccatgcatcactcaaaatagagtctcatcactcttgtctgcagagcttctcgagttccgagctacgcacacgtgttcaatggatgcgtgaacccatggcagtgggttcatcaaggtcacttccattcatgagaatatagccgtctccctctcatgctggacagtcgcctcgagcccgtgctcagggtctgagagcaggttcactggctgctgacggtgtctggggtccacacagatgcgctccacactctgctcagtcagtggctggatggcagagtgagcctgtattaggactggggtctgggttgtcatggttgtttcttccatgttcctattcatgtacacgatgcgcaggtggttcagaatgttaggtgtctggtggtgctgcagcagtccagatggccacacgtcgaaacgcgtggtaaac

SEQ ID NO: 491034 - DNA, 89 bp, Homo sapiens
agctcgagcagccaaccccgggcgcgtctggggccatggacggcctgaggcagcgctgtggagcacttcctggagcaaatggaacctgg

SEQ ID NO: 491035 - DNA, 88 bp, Homo sapiens
  misc_feature (17)..(17): n is a, c, g, or t
  misc_feature (27)..(27): n is a, c, g, or t
gagaaaccgccccagancatcaccctnctctagcccagcctcatcccgctcccagacacctgtagaggccagcaactttaacaagcgg

SEQ ID NO: 491036 - DNA, 353 bp, Homo sapiens
agcttttaccgctgcataccactgctctccagcctgagtgatagtgagaccctgtttcaaaaaaaaaaaaaacaaaaaaaaccagtaaaacaattttcatttaaatttagcttcaaagaggaaaaagtctttttagattaaaaacaaaagaagtgtgcaaaacttaaaaaacatttacaacattgtgctaaaagttaaagaaaacccttaaattaaatgtggaaagacattcccagtgttccattagattcaacaacagtttactattgtgtttagattggcaattacagggccgagccacagttggcccagcgccttattaatctcccagaactttggaggggcgcccaggg

SEQ ID NO: 491037 - DNA, 461 bp, Homo sapiens
gcatccagtctcgttcagccacggggagcagtttcagggccaggagtccctcagcatctggaggcaggataagccctgcctgctccccaaacacacgtctccccactgggcttcagggccagcttgggctgctcagggaagcgtctcaggaggagacgttgcagcagcaccgggtacgggtgtaagacggtggccaggccgtgacatcgagggtagcacccgccgtggccagggtgaggctctggtggaggagaggaggcggagggctgaccttttgatcttgataaacctatagctttccgcacagcttgtggctgagtgcggcttccttaaaaaaaaaaataaaagcgctgttgagtggctctcacctatcagcattacccagaggcaggtggctcttcatcgatcgcctggtgggcttaggaattgacccaggagggaaaagcagctcgcagcacacc

SEQ ID NO: 491038 - DNA, 103 bp, Homo sapiens
catgatgagacccctactttacataaattcataagttagttaggccttgtggcatgtgcctatagttcagattctaagtgagcctgagcttcgctgaatagct

SEQ ID NO: 491039 - DNA, 101 bp, Homo sapiens
atcatcattatggatttgctggcgcagtacaactaggcttaatagggactcgaattcgaggctcgaattcgagaaaaaacgttagaagcttgaattcgagc

SEQ ID NO: 491040 - DNA, 135 bp, Homo sapiens
ggggcagggtcaggcgcgccaaggcgacgagagccactcaccccctggccccgcagcggcagtgtctggagctcctaacccaagagctgccttgacctggtcctgaaattgttgttgccgaagagcagcggcccc

SEQ ID NO: 491041 - DNA, 98 bp, Homo sapiens
acctcaacacagggatcttcgagacagtcagtgtaggcgacctgactgaggtcaaagggcagaccagcggcagtgtctggagctcctaccgcaagagc

SEQ ID NO: 491042 - DNA, 828 bp, Homo sapiens
ggaggtttcaatgatggcggtagctgaggtggttgaccgagagacccagttgaacggcctttacgaagtgaaagaggccgggagtcgccccctacccgcttcgtcgtagctcctgggagcacagcagaagtgtttttcttgtatttataatgaacaatgtaaagcatacaaatggtcaacatgggacggagatctacatcatccaccagagatgtggaaaatttatgaacgcctcactagatcctaagctccgtaaaggaaagcccggaatgacgagaattagagaagaacaaaaaaacagcgcatgatggttcgagctgcagtcttgtaatgtatgaatggatccaagacagataatccgagacatggagaaattggatgaaatggagtttaactcgctagtggaacagccactaattatagatgacgaagagtactgaagagacaagcgtaaaaagctgtgtgaaatctttgaacgtattctacgactcgtatgaaaaagagaatccagatatttacagaagaattgagaaagctagaagtagaatatgaacagaagagggctcaagttagccaatattttgatgcttgtcaagaatgctcagtgatgtggaagtggaggagtattcctttggcagatatgcgcacatgctccttcgaaccatttgatccaggacattccacttccatgagtgcccaagcaaccgtcgtatcctaaagaaaaacgctcagcctatggaccttcaaaatcgggcagttctaatacgttactcttcttggacatggtgctcacggtttgggccctggagaaaaacctcctggactacc

SEQ ID NO: 491043 - DNA, 234 bp, Homo sapiens
accacctcagcctcccgagtagctgggattacgggcgcccgccaccacgcccggctaattatttgtattttagtaaagacggggtttcaccatgttatccaggatgatctcgatcccctgacctcgtaatccgcccgcctcggcctcccaaagtttgggattacaggcatgacccatagtgctctgccaaacatacataatttgagtttgctaagaactattggtttaacacaa

SEQ ID NO: 491044 - DNA, 811 bp, Homo sapiens
agcggagaacccagccccccaccccgctcccatttcctcattcttaggggtggctgcagctggcccctccagctgggatctggactagggaacggagcaatgatgtgcggggtcgagctgaagactttggcagagctgcacagcaggccaggagaggctggcgccccttctcccaagaatactgtcagatgctgatcctgacaccacctgttacagatgtacgagctaaaacgactgaaggatgcttgtcaagaggacctgtggactctcatattacatgggccagcactgcttcatccgggaagtgcttggggatggagtgcctccaaaggtatgctgaggtgatttacttgtctttgggtggaacatccaaagggctgcacttcaattaatgttaactagttggcactttgtcctccttacaagaggcacagcatgacagacgacaccgcacaatacattgctagtctaaacccaaggtgacatctgggaaactatgtaatacgggaaggaaatggaacagaatgccccacgtggtggataatacaagtcccagatacactcagggaagtgtttctcagagggtgaaaaggtaaacatatgacaacgtttagcaacttggcttgtactagacaaagatgctgaaactggggctcgtcgaatgggctaacaagtctgaaaagtggcgaaaatgaaacccaccacagaatgaaagatgaaaaaacacaaagtactaaccaaacgcaggactgaaaacacgacaaagggaagaaaacaagagtcaagaacatgagaaacagaaaggaaaagg

SEQ ID NO: 491045 - DNA, 397 bp, Homo sapiens
gagacagggtgtcgctctgttgcccagtctggagtgcagtggggccatctccgctcactgcaccctccacctcctggtttcaagtgattcccctgactcagcctcccaagtagctgggattaaaggcgcccgccaccatgcccggctagtttttgtatttatagtagagactgggtttctccatgttggccaggctcgtcttaaactcctgacctcaggtgatccaccgccttggcctctcaaagtgctggaattacaggcatgagccacctcgcctggcctagatactttttcaattgtgaaggacaaattttttattttaagcaaatatttattaagtgccagatactagcccatgtgctggagatacaacagttaaagtatttattgaaaaaaa

SEQ ID NO: 491046 - DNA, 401 bp, Homo sapiens
atagactagggtccccaaccccgggctacagaccggtaccagaaccgggccacacagcaggaggtgagcagcaggcgagcaagggaagcttcatctgtatttacagccacctccccattgatcccacagcagcctgacgtccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgt

SEQ ID NO: 491047 - DNA, 433 bp, Homo sapiens
  misc_feature (15)..(15): n is a, c, g, or t
  misc_feature (46)..(46): n is a, c, g, or t
  misc_feature (172)..(172): n is a, c, g, or t
  misc_feature (186)..(186): n is a, c, g, or t
  misc_feature (190)..(190): n is a, c, g, or t
  misc_feature (415)..(415): n is a, c, g, or t
  misc_feature (422)..(422): n is a, c, g, or t
tgaggcgaaacccanagagtaagcttagtgatgtgtgtcaagaccnctgaagccccaagcaaagcccatcatatcccctgtgacctgcatgtatacatcccagatggcctgaagcaagtgaagaatcacaaaagaagtgaaaagggccggttcctgccttaactgatgacantccaccattgtganttgntcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaanaagacanttatctcacgc

SEQ ID NO: 491048 - DNA, 140 bp, Homo sapiens
tgcatatgtctgcgaccctccgctccttcatgaccgtccactgtgcttcgggcgtcctttcacttgcttgctcacgttgaattttatacgcttcgagagccttatttctccccgacccctcctaacacggctccttggca

SEQ ID NO: 491049 - DNA, 689 bp, Homo sapiens
ctctctttcactgcaaggtttcactggaagaggttgtgaggctagtttgtgtaagtcgttcagtgacatcatcgagggtgaagcgacacacgctatcgacgcaggcatgactgagcagatgacctttcgaggtacccttaagggccacaatgaatgggtaacccagatggctactacagagcagttctaggacatgatcctctgcgactatcgtgataagatcatgagcatggggcaactgaccagggatgcgaccaactatggagttccacagtgtgctctgagagggcactctgactttgctagcgaagtgggtatgtgctgagatgatcagcttggcctgtcaggctgctgtgatagaaccctgcgcctgtgcgatgtgacatcgggcactaacacgaggcgatatgaggagcataccaaggatgcgctgagagtgtgcttctactgtgacaaccggcagattgaatctggatctcgagatagaaccatgaagctatggcataccgtgattgagtgcgacactgtgcaggatgagagccacatatagtggccgcttagagtgcgcttctcgcgcaacagtagcaaccatatgatcgactcctgtgactgggacaagctgctcaaggaattgtgactaggtctgcacgctgtagaccgacgccagtggccacacagactatctagac

SEQ ID NO: 491050 - DNA, 146 bp, Homo sapiens
cgcgctgaactgtctgttgatgccctttctgactgtgtctctgttttctctgtctgctgtctaaccctgtgccttgccttgggataaggacaatgatgaggttactggtttggatagtaagtagaggacttttattaattggttaa

SEQ ID NO: 491051 - DNA, 141 bp, Homo sapiens
gaattattgccccttctgggcataaatattggggtgaatcgtatgaagttgacgggcttttttgatagttcaaaagtggttgacttcgccgggcatggtggcgtgttgctgtggtcctggctactcgggaggttgaggtgg

SEQ ID NO: 491052 - DNA, 329 bp, Homo sapiens
cccggctcctgccatgttggagtgagtggcataatctcagctccctgcactccatctcccaggttcaattgattctcctgcctcagcctcctgagtagtcggcaccacaggcatgcaccaccacacctggcaaatttttagtagagacggggtttcaccactgtttggccagactggtctcgaactcctgaccttaggcaacccacccgccttgtgctcccaaagtgctgggatttcaggcgtgagccactgcatccgaccttctctttttttaaaaaactaatttcaacttttattttagattcagtgggtacatgtgcagatttgtt

SEQ ID NO: 491053 - DNA, 208 bp, Homo sapiens
acatttttttttaattaaacatggttgatttacctagttcttcaatttctgggtcacagcaaagtgacccagtcatacatacacatacattctttttttcatactttgttccatcatgttctatcccaagaaactggctagagctccctgagctgcacagcaggacctcattgcttatcctttctaaatgccatcgtttgctgcatct

SEQ ID NO: 491054 - DNA, 361 bp, Homo sapiens
gagctctctcggtggggcgtagtcatccccggtttaatggacacaggggctacccactccacattaccttcttttcaagggccggtttccctggcctccataacggtggtgggtatggatggccaggctccgggaccccttaaaacttcccaattgggtgccaactggaacaatattcttttatgcactcctttttagttatccccaccggcccagttcccttattaggcggagacattttaaccaaattaccggcttccctgactattccgggactacagccacatctcatggccgcccttcttcccaacccaaagcctacttcacgtcttcctcttgtatccccccacagagagagcgt

SEQ ID NO: 491055 - DNA, 468 bp, Homo sapiens
gtagcccatgaggtggcaagaaatgggctacattttcaacaaaaaaaaaaaaaaaaaaaaaaaaaactttgttggcgcgcgccctcggcggcccctctaagaaaaagtttcttggaagaaccattgtcgttgtggggcggcgcgggcgccgcccagatgaggttaggtggaacaactgtggtctcataagcgggtgttcccctagggaagacgctcgcgggttcaatggaagcaagaggtgctggcggatttttctctcacccccatatataaaaaaaaagagcgccgcggggggggggaaaaacccgcgaaagcgcttttctggaaacaatattcccccagaaaggagaaattctcgcgagagacgctccaattaagacggggatatcccttataccaccggggggatttcaccaaaggagaagtccgagatatttctaaatttagacgccccgcgctgtgggagta

SEQ ID NO: 491056 - DNA, 203 bp, Homo sapiens
gagcgggcgctttttacttttgtttattattattttttgtaggaatactcatcacaaataccttgttaaacattataggcttaagaacccagggcatcggaaacatttttccctgtgatcttaacttctgtttccaaagcaccctgcaaagggctttgcatgacgttagtgctaatgctaatataataaatgaacgtttattg

SEQ ID NO: 491057 - DNA, 396 bp, Homo sapiens
acgatggtctcagctaattttctagagcattaatagacacagctagatttattacattctgatgaacaaactgttattttatcgatttcagctgttactttccataacctaagagcattgaaataagagctccttgtctactttccttttagcattcattaaaatgtattcagtggtttaatacatgttaagtgatattggttttttctctgattaatggctcatattaccactgtcctcagaatctagaagattatcttgactaaatgaatttttacttaaggtttaaatggcatatggaaactgtggatgatataataaaataatagtgttttggctgacactaggaaaccatggatgatatcatagagtaatagaattttgcagctgaggacc

SEQ ID NO: 491058 - DNA, 313 bp, Homo sapiens
atgataatcagctcggtacggctagcggattagtgaacgatgcagtggatcatgcagcttgattgaatgcagttgattccatggagcgtggcccaatgcatcccgattaaatgcagtggattttatgcagcatggcccaaagcatcccgattgaaggtagtgcattccatgcagcatcactgaatgcagtggattccatgcagcatggtaaaatgcatcccgattgaatgaagtgtattccatgaagcatggctaaatggatcccgattgaatgaggtggattccatgcagcgttcacttaatgccgctagcg

SEQ ID NO: 491059 - DNA, 237 bp, Homo sapiens
cagaacgtctcccaggggaaggtttactccatttatatagaagctgcaaccagatatagcttgagcatccctaatctgaaaatctgaaatgctccaaatgctccaaaatctgaaactttttttttctttttatttttttggaaagggattcaaatggcaaccataatggctttaaccccatagttagtggccaacaaacgtgaaacctgtgtggtgccttataaaaaacaaaaaaaa

SEQ ID NO: 491060 - DNA, 140 bp, Homo sapiens
ccgcgtttacgctgatccgaagctgcctcgttagcgtattgcagctgtgatatagtccagctcttaccctactgtggaccagagccgtccccacagctccgtgtctgacgtagcaccggacccacgaagtataaagacca

SEQ ID NO: 491061 - DNA, 132 bp, Homo sapiens
tcacctcggcacactcacgggtgctgtgctcgatgtgtgtgctgtgttcatgcgtgtgctgtgtgttgtgtgtgtgtagctgcgggatgcataaagtatgagtgcttttataggatgggacttgagatgtaa

SEQ ID NO: 491062 - DNA, 684 bp, Homo sapiens
tgcaggaattcggcactagcgggacatgtttacaggaggttgtgcttgcatggagctgggtgtccagagagcaactgtctttgtttcttgcgtgctacaatccagcgaaagttccttggaccccgtgataaacacttgctttcatgggatcaatgaccgagagaaggccttggtatcaccttgaggctttggagacccaactgcctttgtcgaaggtatgatacagtcattacacagagccttctcctacacataatcaccagtgacccgatctgagatggcccatacgtgttactacaggtccatgctgtaaagcaggtgtttatgcatcagctgatgccacccctgctgctgatgagcacgtgcctgctgcaggtccagacacagcatacagcgctttgcattgcctaaggagagatgatgatttgtgagcactgaatgattagattttgaaggatgacgtcgataccagtgtgacacactgatgcacttgtgttgtcacacttagacagtgaactcttgctctcttctgtcatacgggtgtacctaccgctgccgtggaggcgaccacagagttcctggggtcgactgagtccacacagatgctcttggcgtgcattgccatcccacagggttccctttcctgcttgcacgtgtacagccagtggcttttgttcctttttc

SEQ ID NO: 491063 - DNA, 1784 bp, Homo sapiens
  misc_feature (1238)..(1238): n is a, c, g, or t
  misc_feature (1442)..(1442): n is a, c, g, or t
  misc_feature (1666)..(1666): n is a, c, g, or t
  misc_feature (1784)..(1784): n is a, c, g, or t
ggaggctccgtaggatggtgaagaggttgagatgctgtccagcccacagaggccccggaaagccagtgccgcccgtcagaggggtctcctgagtgcgtgtgggtggctggattctgcatactgggttatcttaaccccggctgtgaaaactggatgaagtagcaatcctttcaaccccaagagtctgtgattcagccagagttacaagatgtctcttcatcctctgaggtttacaaggttctcagaaaacctgtgaagagctgcgcggatcctctcctgccccggcccagcggcagggctgccgcctccctctcccctgggcctgagtgggtggatttcccctcccctcctccttcccaggagaagcacagagggagcggccaagcgagccgtgtctgcaaaccccgcttccctctgcggcggcctctgccatcgtgtcatggggccggaggtccctggtccagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggngtgtgggcgtcggccaccagcctgggttcctcaccttgggaaataaaatcttctcccctaaaaaaaagatagaaaatgcggctcgatggcctgatcgggggagcccgggcggccgcttgcctttggctacggggggatgactggacgcctggtcggtgggtggggcgggcgcgcggccggcgccgtcggtggtagcgacgggcntcacgcctacgagggggggagaccggtcataacccacaaacggcgcggtcgcccgcggagagaagatccgaggcgcaaggccggccaacatccgcctaagcggccaggagcgcggagagtagacgcgatatcaccgcccctggcggcgtggggactcgtataataacggctcgccgaagacggggggcgggccgtggagctagagcggaggagcgcggacccgngaggcgcccggagggagtcagggagaagtaagcgccacccagtactagcggacgcttggtgacagaggagggacgggctagggcaggagggaggagctaggagaggcggggcgcgcgn

SEQ ID NO: 491064 - DNA, 84 bp, Homo sapiens
ggagctcacagctgcagtgagccgcgagtcccaccagtgcactccagacctgggagacagagggagaccctatcccctgccacc

SEQ ID NO: 491065 - DNA, 1605 bp, Homo sapiens
  misc_feature (1059)..(1059): n is a, c, g, or t
  misc_feature (1263)..(1263): n is a, c, g, or t
  misc_feature (1487)..(1487): n is a, c, g, or t
  misc_feature (1605)..(1605): n is a, c, g, or t
gctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggngtgtgggcgtcggccaccagcctgggttcctcaccttgggaaataaaatcttctcccctaaaaaaaagatagaaaatgcggctcgatggcctgatcgggggagcccgggcggccgcttgcctttggctacggggggatgactggacgcctggtcggtgggtggggcgggcgcgcggccggcgccgtcggtggtagcgacgggcntcacgcctacgagggggggagaccggtcataacccacaaacggcgcggtcgcccgcggagagaagatccgaggcgcaaggccggccaacatccgcctaagcggccaggagcgcggagagtagacgcgatatcaccgcccctggcggcgtggggactcgtataataacggctcgccgaagacggggggcgggccgtggagctagagcggaggagcgcggacccgngaggcgcccggagggagtcagggagaagtaagcgccacccagtactagcggacgcttggtgacagaggagggacgggctagggcaggagggaggagctaggagaggcggggcgcgcgn

SEQ ID NO: 491066 - DNA, 111 bp, Homo sapiens
tatcatggtaatcaggaacatagcaaagcacctcgaataaatttagaaataaccaccaaagcccgggaacaaactgtgacatgctgcaaggagcattacaagtctaggccc

SEQ ID NO: 491067 - DNA, 974 bp, Homo sapiens
  misc_feature (9)..(10): n is a, c, g, or t
  misc_feature (13)..(13): n is a, c, g, or t
  misc_feature (48)..(48): n is a, c, g, or t
  misc_feature (428)..(428): n is a, c, g, or t
  misc_feature (632)..(632): n is a, c, g, or t
  misc_feature (856)..(856): n is a, c, g, or t
  misc_feature (974)..(974): n is a, c, g, or t
cggaggggnncgncccggggcccggaggggttaagttttaggaaaagngcttcgttttccacaacccttgtttttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggngtgtgggcgtcggccaccagcctgggttcctcaccttgggaaataaaatcttctcccctaaaaaaaagatagaaaatgcggctcgatggcctgatcgggggagcccgggcggccgcttgcctttggctacggggggatgactggacgcctggtcggtgggtggggcgggcgcgcggccggcgccgtcggtggtagcgacgggcntcacgcctacgagggggggagaccggtcataacccacaaacggcgcggtcgcccgcggagagaagatccgaggcgcaaggccggccaacatccgcctaagcggccaggagcgcggagagtagacgcgatatcaccgcccctggcggcgtggggactcgtataataacggctcgccgaagacggggggcgggccgtggagctagagcggaggagcgcggacccgngaggcgcccggagggagtcagggagaagtaagcgccacccagtactagcggacgcttggtgacagaggagggacgggctagggcaggagggaggagctaggagaggcggggcgcgcgn

SEQ ID NO: 491068 - DNA, 322 bp, Homo sapiens
  misc_feature (174)..(174): n is a, c, g, or t
  misc_feature (176)..(177): n is a, c, g, or t
gtacacagaggtaaactgaccgcaggtgtcacttccgcccctttactcttgttcactcttaagtccctttagggcatgcagagaatatataggtaatatatttatagatataaaattaggcctctaccagtgataggcgcaggagagattgctgccaccaaacaatgtttcttntnntcacacctcttcccagcctccctcacttgacctatttagggggtgatgggatgaagagaagagagtgaaggatatgtaatcaagtgcaaaatactgtggtaagcacagagaatgtataaggtggaaaggaaagtgaagagtgtgg

SEQ ID NO: 491069 - DNA, 1223 bp, Homo sapiens
  misc_feature (677)..(677): n is a, c, g, or t
  misc_feature (881)..(881): n is a, c, g, or t
  misc_feature (1105)..(1105): n is a, c, g, or t
  misc_feature (1223)..(1223): n is a, c, g, or t
cgcgcgtgcaccttatgctgcacgtcgctctacacggagccctgggccaacgcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggngtgtgggcgtcggccaccagcctgggttcctcaccttgggaaataaaatcttctcccctaaaaaaaagatagaaaatgcggctcgatggcctgatcgggggagcccgggcggccgcttgcctttggctacggggggatgactggacgcctggtcggtgggtggggcgggcgcgcggccggcgccgtcggtggtagcgacgggcntcacgcctacgagggggggagaccggtcataacccacaaacggcgcggtcgcccgcggagagaagatccgaggcgcaaggccggccaacatccgcctaagcggccaggagcgcggagagtagacgcgatatcaccgcccctggcggcgtggggactcgtataataacggctcgccgaagacggggggcgggccgtggagctagagcggaggagcgcggacccgngaggcgcccggagggagtcagggagaagtaagcgccacccagtactagcggacgcttggtgacagaggagggacgggctagggcaggagggaggagctaggagaggcggggcgcgcgn

SEQ ID NO: 491070 - DNA, 974 bp, Homo sapiens
  misc_feature (713)..(713): n is a, c, g, or t
ctcaatgcacgttgtatattagtcaccctaacgtggaagtgtgacttgacgtagtcacaagtatactctcgagatcctaattatctgaatggttcattatcgtaatggagaatagaaatctccacagtcctgaatatctggaaatggcttgccattatttgcaaaggcgatgagcaagctaccccttgcagcccaaggaaaacatgatcagactgtggtctaaaatacagagtgcagacacagggattcggagaatgatggagaccattgtcacgctagacttattacttataaagtcataagcagagtgaattctaagcagtcgaaatctagtgaatgatgagtgagtgccattgagctgcttcgaggtgcttgaaaatggtgtacctatgcaagatgtcgtgggaggggaagtggacacgaatcacaagtgaagaagatgatgaagagcccatccctgagtccagcgagcggacacttcagagaactttcgggagaagaaagaagatacaagaaaggtcctcgagtgggaccccctggaaactgagcttggtgttaaaaccctggattgtcgaaaaccacttatccctttgaagagtttattaatgaaccactgaatgaggttctagacctggtccagattatacttccagagtagaaacagagaacaatctctttatgacatgtccctttatatgatgctgtccaagatngctgtaattttggcctgatcggctgtcggacgaaatcctgtccacaggtagtcacggacgcgtgatccatttggaaccacagtactggcctctaaagatggctgccggaaaaatcctggaaaccgcacttaaaacgtttggctgcgggacgggggggggtcccaatccggggggaactcccaagggccacaacacacggggcaccaaagggacacgggggggcaaggccccagaagaccccaaggaagctaagaatacact

SEQ ID NO: 491071 - DNA, 224 bp, Homo sapiens
  misc_feature (78)..(78): n is a, c, g, or t
gacgatctcacgcacttaacgcttgaaaaggcagtttctgatcagcagctcggtggacttctggtagcggcgagtggncgcggagagccactgtaccaggccgatagcgatggggcttcttgacaccgccggtggccggagcgctcttccgagccgccttggtggccagctgcttgcgcggagccttgccgccggtggacttgcgcacagtgactgatagtggc

SEQ ID NO: 491072 - DNA, 372 bp, Homo sapiens
  misc_feature (304)..(304): n is a, c, g, or t
  misc_feature (312)..(312): n is a, c, g, or t
gggcggatcacgaggtcaggagatccagaccatcctagctaacatggtgaaaccccgtctctactaaaaatacaaaaaattagccggatgtggtggtgggcgcctgtagcctccctagtagctgggattataggcgccccccaccacgcccaagtaacttttgtatttttagtagagatggggttttgccttgttggccagggctggtcttgaactcccagcctgaaatgatccacccacgtccaccttaccaaagtgctgggaattgcagggcattgagccaccactcccgggcctgcttttnagtttttngaaggacagggatttagggtctccttcctcccggaattcttaaacctggcgtgtgttggc

SEQ ID NO: 491073 - DNA, 1706 bp, Homo sapiens
  misc_feature (518)..(518): n is a, c, g, or t
  misc_feature (1503)..(1503): n is a, c, g, or t
  misc_feature (1706)..(1706): n is a, c, g, or t
tggagtggggtccattttaataggggggatcaggcctaaaaggataagcaccgggtcagcatgtgttgggcgtgcaccactctgtgccgactcctttctcgtggtgagccaccttctgtgttgaaagagtcataaattcagcccaagaaaatcgggactcaaaaaggggtaaaaagccggggaccacatgtggccaacctccggtcgtgtattcatacgaccttaccagtctcacgtgaacagcctgtgcccagaggtggtgagtggctttccagtgccaggaagaacccagaggtgggcttcgtgcatagggagaaagtgacctttatttataccttagaggcttatttataatttctcctcaaagagtgtggggggaaaaaagaggggcgtgggttccttagaaacacgagaagtggtgcgaattgtgaagaaagtgttcccagagggggagcttagagtgttatatagagaggaacttaatctcacgaaaagcgtgtggtttatctctcccgaanacaaagccactcgcgtgaaatctccattctcctgtggcgcaccgcattcgaccaacatattttctcgagtggcatttccacgcaacgtgtgtgtctctccataagaaagactctccgagaaaagcccaggcggagtatacgctgtctatactccagcgtctcctgtgagaggcgacctcaatatatttccccccacaagaacaaaagcccccgcccgtgtccacccaagggccctgtttctctctccatagaaaagtctcccgtgggaggaaaccgttggaaggattaccttccccttcccgaggaagaggtgcgttgggagagggcattacccggaatgacagaggaaagtgatttgtgtgacacccactgtggtgtgggttacggacagcccgccattttgagttagtctgaccgtcgaacaactgcttccccccgcactgtgtggtggctctgaagattacctcccccgaattcacacaaggcggtgtcccaacgtttacttccccccaaggtctgtatgggggcaatttggtgcggccatccactaggagattagtttactccaaccaaaaagggctttgtctcatgagccaagagaacacacctcggagaagcgtctggggcgcatcaattcacggaaaggtgtgtcccgccagcattatttctccttgttaaccccactggtggtcccccggaaaatgatcagcgcatgggaccgttcacgggcagagatgatgtgctgtggcaaagagcactgtattcattaaccacggggagagccgccgtcgaaagatatcccagaagcatatcaggagaggggcgtgcaatgctgggtcgtacacaaagagtatgcatccccttctctagataaaaaaacgcctccatatgtcattcacacgactgtttgttctaatgctcaatcccacttctgtgcgggaggggaaagcggccagaatcatatcttctatggctaatcggtatnaaccaccaacgacacgagggaattctcgacacgaagcaaacgattaagacgacagcgtcccctccgcagatgagtagtattcaaagaagtaatgagtgtatgctcactactataaatactacctagtgaggaggaaagcaacgcaaaacgtcgtacagactacgagtcacaggtcgcgcagtaatatatttcaatctcatggn

SEQ ID NO: 491074 - DNA, 186 bp, Homo sapiens
cggatccggactttgctataaatattattttttatttcaacccagagtgtctctatgttttcccctgcagtggaactaccgtcccgatcactgcatgaacagacacaccttcatgctcagcctgtctggacggtgcttccgtacatgcagtgatcggtacggtagatccactgcaggggaatacat

SEQ ID NO: 491075 - DNA, 476 bp, Homo sapiens
gggagaagggcttccatgtgaacagcagttgaacatgggtgtgaggcgtcctgatgcggtcgacatgtggttctgtttttttattgtgttctttgttttcgggagaaaacggcggggcaagggaaggccggggtggagcggggacaagagaggaggacaacaaggggggaaacagggcggtcaaacacaacgagagaggggagtgtcccccgcggaggacaagggagggcgtcaaagaggggccagaggtggggaggggtgagaggggcaccccccagaggggagggcgtggacacaaacaatgcatagcgagcggggacaaatgaggggcgtgggaacatcgcagagcgtgagggcccccccggaaaaaagaacagagaaaaagcgggactaagtcgcacccacggagaaaaaaggggggtgcaccacaaccaacgaagagagaccccccccgagaacggtacacaaaggggcgg

SEQ ID NO: 491076 - DNA, 235 bp, Homo sapiens
tccggcactgtatgcctggtcatgactgaatgcctggtcagtgcactgaatgccttggtaggataatgaatataaacttcagtggtgacctgaaaaatcagaataggtgttggtatagaatgggtgtctcctcctcctgcggggtcgaagaaggtgtgttgttgagtgttgctgtgtctgatagtagtatagttatgccatgcagcagtgcttcagttgccttgacctgggtacc

SEQ ID NO: 491077 - DNA, 1113 bp, Homo sapiens
  misc_feature (327)..(327): n is a, c, g, or t
  misc_feature (329)..(329): n is a, c, g, or t
  misc_feature (424)..(424): n is a, c, g, or t
  misc_feature (456)..(456): n is a, c, g, or t
  misc_feature (461)..(461): n is a, c, g, or t
gccgggtgggaatgttgagggcgccacgcagtctctggcggagcacatgatacagatcgcctaggagtccgaggggcgctctgatgaacagatggagtcggataactgttcacgaggagatgatgactggacccatctgtcttcagatcaagtggacccggctacaggtgatcttgagtccctacagatgccactatcctgatggccacactctctgcacccctcccaagatggacccacagggctgaaggaagctgccttgtacccacatatcccgccataggctgacccgcaactgattgtgtccctctaccagatgctgcccangngctctgatgaaggcggctggctcaccaggctcctgcagaccaagaactatgacatcggagcggctctggacaccatccagtattcaaagcatccnccgccgttgtgaccacttttgcccacctcttntgcgngcccctcttctgtctcatagttgtgttaagcttgcgtagaattgcaggtctctgtacgggccagtttctctgccttcttcccaggatcaggggttagggtgcaagaagcccatttagggcagccaaaccaagtgacatgaagggagggtccctgtgtgtgtgtgtgctgatgtttccctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctcgaacatttaagttgattatttttctgctacagacctggtacactctgattttagataaagtaagcctatggtgttgtcagccaggcaggctggggaggccagtgttgtgggcttcctgctgggactgagaaggctcaccgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaatcaaaaaaa

SEQ ID NO: 491078 - DNA, 384 bp, Homo sapiens
aaaacaaaacatttttctatggatactgaaatttgaatttatataatttgcatgtgtcccaaaatattatttatttttattttctaaatccattttaaaatgtgaacattattttgagcttgaaggctatacaaaaacagggacccacgtttagatatgtgaattttcacataaaaaaaacacggccgggcgcagcggctcatgcatgtaatcccagtactttgcgaggccaaggtgggcagatcacccaggagttcgagaccagcctggacaacatgacgagaccccgtctcgaccaaaaatttaaaagccgggcaccgtgacccgtgcctgtgatcccagctactgggatgttcacttgagcctaggagccgtaatagcacc

SEQ ID NO: 491079 - DNA, 1057 bp, Homo sapiens
  misc_feature (327)..(327): n is a, c, g, or t
  misc_feature (329)..(329): n is a, c, g, or t
  misc_feature (424)..(424): n is a, c, g, or t
  misc_feature (456)..(456): n is a, c, g, or t
  misc_feature (461)..(461): n is a, c, g, or t
gccgggtgggaatgttgagggcgccacgcagtctctggcggagcacatgatacagatcgcctaggagtccgaggggcgctctgatgaacagatggagtcggataactgttcacgaggagatgatgactggacccatctgtcttcagatcaagtggacccggctacaggtgatcttgagtccctacagatgccactatcctgatggccacactctctgcacccctcccaagatggacccacagggctgaaggaagctgccttgtacccacatatcccgccataggctgacccgcaactgattgtgtccctctaccagatgctgcccangngctctgatgaaggcggctggctcaccaggctcctgcagaccaagaactatgacatcggagcggctctggacaccatccagtattcaaagcatccnccgccgttgtgaccacttttgcccacctcttntgcgngcccctcttctgtctcatagttgtgttaagcttgcgtagaattgcaggtctctgtacgggccagtttctctgccttcttcccaggatcaggggttagggtgcaagaagcccatttagggcagcgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctcgaacatttaagttgattatttttctgctacagacctggtacactctgattttagataaagtaagcctatggtgttgtcagccaggcaggctggggaggccagtgttgtgggcttcctgctgggactgagaaggctcaccgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaatcaaaaaaa

SEQ ID NO: 491080 - DNA, 205 bp, Homo sapiens
  misc_feature (29)..(29): n is a, c, g, or t
  misc_feature (33)..(33): n is a, c, g, or t
  misc_feature (76)..(76): n is a, c, g, or t
  misc_feature (82)..(82): n is a, c, g, or t
  misc_feature (184)..(184): n is a, c, g, or t
cagcaatctgggaggccaaggcgggaggnctgnttgaacccaagagttaaaggccagcctgggcaacagaggaccntatctntacaaaaaatttttaaaaaatagataggcatggtggtgcacacctatagtcccagctacacaggaggctgaggtgggagaatagctttagcccaggtgtttnaggctgcagtgaaccatgatt

SEQ ID NO: 491081 - DNA, 1731 bp, Homo sapiens
gccctgtgaccgtggccgtctcctgaggaatggctgaggaggcggcaccgaaaagctcactccgcaagccgtattcatgagcccccatcgggacaatgccactatggaatcagtgaagcttatcttcaatggcgatgaagcactcaggatgcagaccgccgtgtgcacactgtaacgggcaagggtattgtggagctctctcgaatatggttgacagtttagccatccgcatgaggcgagccttcaatcgtgcgctgatcgccgggggtatcgagacgactgtgagcacgagatgctggcctatggagtgctgcgcatctgcgagagaagccaggatcagagtatcaggcgccatgggtcgagcagatccagcaccttgagactgatcgcgtcatctatgcgcgacacagatgtagcgctaggacctcagagagatcccgcactggcacttcagagaggtcctgggcgagctggaacttcgcgtaccgtctgtgacgctaactatgcgatagatacacagcgcgaccgcgcagatcgctttgccgtctcaacgagagttatagcgaatagcctcatcgtggcccacattgttgcacctacgtaaggtaatatagcgaacagggcgcatttaccaaggaaacgtaacgagctccgtgctgctcaggagtgtgatcctggcgataccctgagattgggcggctttccaacggaagtcggttacccaaacgggggaggaaccgtggactgggttcctcatttggcagccaacgtattacatacgtcacggaggattaccccgttgtcggcgcacgagcgccattaaagcagtggcggccccattggagggtaccagttcatccataagcaagcgcaccggtccaaccttctgtagggaccggcaactcacgtatttggaatcgcataacttgggcgaccccaccgttgtgaacggtggcaaccgccatgttattcctcggttccgaatagccagttaaccattaaccatagggcatatggtctacggtttgggggacaacaacgggccatgcgccaatctggtggcggtggtcggcgtcctatccccccctggggcacaaacttttccctttagcactagacagcagaatttccgccctgtcccaagtgtgggcggacaactagcacagcgacaaagtgtggggggtacagcacacacgcccgcatcagcaacgtgtggcccgtaacgcccccaacatatacagggcgcccagcgaaccagccatctagaggttggggacaaacgcgccgccacatgcggtaaccccgtccgtaaataacgcaggtgacgcccacaacggggcggagcaaagtctctcccagggacgacctccccttaaaacaaagccgccccgccacaggaacgcagaagcccacttcggtgcgcgaaatctctcacaactggagcaccataacgctctctgcacaagcgacgggccaaatcaacaggcgagcgcgccaacgacgaaccacccgcaaagagtcactctgcgcagcacgaaccaccacaaacatgtcggtacacaccgccacagaggacggacaggtgaccctcatcgagcggcccagccgaccgagggtggagcacactcacaccactctagcccccagcggcggtacgccaacacgaacaccagatctccactccacaaacacggtccacgccacaccatcacggaccgggtagtacacccc

SEQ ID NO: 491082 - DNA, 349 bp, Homo sapiens
gatcccccgggcggcaggaattcggcacgaaataaaaaaaaggttctctaaaggactgctaaattagtaggactaatcttcaaagggattaaaaattggtcccattagtttgagattgaaaattttcacaagcggtgaacaagatagttctaaaaaactaaaggtaaaattacaaaaggtccggtaaaaaaaaaaaaagcaatcggaagtaagactgaaataattgaaaaaaatcaaagttaatctcaaccccccctcaagccttttatctaattaaaaagggaagcatggaacttgtatttgaattccaataattgaaaaaattgttactaaaaattttcccaaggca

SEQ ID NO: 491083 - DNA, 399 bp, Homo sapiens
  misc_feature (89)..(89): n is a, c, g, or t
ttacactgggtacaggacaaacctggtagtctatcaactgcctacatcagttgccttggcaacacactgcccttgccccctagcagttnaagatttatttcagccggtagccctggtaacttgagtggctccccagggacaggaagtggcagaacctcaactctgcctctcctgacctgaggggttcacttttcatccctgtcagggacggggcactgcgttctcagcccatatggaagaatgttatgggtttgggggaatccacggggaggagactaggctgttccagcgtgcccctccttcctcagcctgaggccttgctcctccgtggaaggcaacacagggacagagccacacattcagcccctaccctcagccctgctccagagtcctccccag

SEQ ID NO: 491084 - DNA, 202 bp, Homo sapiens
ttcccactgagcgactttgattccacggatacattggaggctcatagatgttttcaatctgcaccagctccaacagtgctccgttgtgaatctgggaacgtcttgctgattatgcttagaaaggtagaaacacctttttgtggagaggcggctgggccactcaccttgcaagaaacaaaatgtgctgtgaagcaggaaagta

SEQ ID NO: 491085 - DNA, 103 bp, Homo sapiens
aaaaagagaaaacaataactacatgtttgaagcgttgttcaaatgtcgcctctcccccatgtgagctccttgtgggtcccgcagtgcagccattgcactccgg

SEQ ID NO: 491086 - DNA, 163 bp, Homo sapiens
tgctgcattaccagcctcccccagtttaaattcagacccgcgtctagctctgatcctgggcatcaatacccagacatcgtaccagtgatcatccaagccactgtggcaatatattcaagacacataagctccaagcccctaagggtaactgcagctcgcaatt

SEQ ID NO: 491087 - DNA, 424 bp, Homo sapiens
aatgtacctttcttactcaaagaaaatccagcaaattggccgggcgcagtggtgcatgcctgtaattccagcacttgggaggccaaggcaagcaaatcacgaggtcaagagatcgagaccatcctgaccaacatggtgaaaccccgtctctactaaaaatacaaaaattagctgggcgtggtggcatgtgcctgtagacccagctactcgggaggctgaggcaggataatcacttgaacccgggaggcgaaagttgcagtgagcccaatattcgcaccactggactcaaaactggcgacagagtgaaactgtcttaacaaaaaaaaataatagatttccgccaattttgtttgctcataactttggtggaaatggttcgctttacaactgaaaatgaatgggggtgtaacaattgataaattaa

SEQ ID NO: 491088 - DNA, 205 bp, Homo sapiens
gctcagcatatgttgtttacactataatgtctcaacttttataagctctctatctagcgctctggtagttgaggattatattgtaacagagagagtatagggtactgtgtatgcgaatcatcatatacagtcggcgatatcctgtacgagaagacctacctgtccgtatgggatgtagtctgactcggacagcgagagctccttg

SEQ ID NO: 491089 - DNA, 498 bp, Homo sapiens
  misc_feature (6)..(6): n is a, c, g, or t
  misc_feature (13)..(13): n is a, c, g, or t
  misc_feature (19)..(19): n is a, c, g, or t
  misc_feature (26)..(27): n is a, c, g, or t
  misc_feature (31)..(31): n is a, c, g, or t
  misc_feature (47)..(47): n is a, c, g, or t
  misc_feature (49)..(49): n is a, c, g, or t
  misc_feature (73)..(73): n is a, c, g, or t
  misc_feature (75)..(75): n is a, c, g, or t
  misc_feature (108)..(108): n is a, c, g, or t
  misc_feature (114)..(114): n is a, c, g, or t
  misc_feature (119)..(119): n is a, c, g, or t
  misc_feature (121)..(121): n is a, c, g, or t
  misc_feature (136)..(136): n is a, c, g, or t
  misc_feature (152)..(152): n is a, c, g, or t
  misc_feature (154)..(154): n is a, c, g, or t
  misc_feature (177)..(177): n is a, c, g, or t
  misc_feature (229)..(229): n is a, c, g, or t
  misc_feature (280)..(280): n is a, c, g, or t
  misc_feature (324)..(324): n is a, c, g, or t
  misc_feature (340)..(340): n is a, c, g, or t
  misc_feature (369)..(369): n is a, c, g, or t
  misc_feature (381)..(381): n is a, c, g, or t
  misc_feature (390)..(390): n is a, c, g, or t
  misc_feature (403)..(403): n is a, c, g, or t
  misc_feature (430)..(430): n is a, c, g, or t
  misc_feature (446)..(446): n is a, c, g, or t
tagcangcctgangttccntctttannaaangacggagtaggatgtngngattacagtggaaggcgacgggtnanaaaggacaggggcatgaaggcagaaagtgcccncagacncggcncncgaaccggggcaggngggaacaaggggagcngngcagcccacaggacgggcgggcnggggggacacagccccccaagttggccaagccgagtctctgggcgagtggcncccaggagaggcctggctgagcaggcagagcaccccgggaccccagggcanaaggacccccgccccccagtccccaagacccaggcccgtctccnctcaaacacgccaccnacatgtgacgtcagccctgaaaaggtaanaggaaagttcanaacaaaaanaaaaccccaaaantaaaaaggctacgtgtagcagagtaanaccggaaacgttatanacacaggcggggatggccccctcggaagtgtccgggtcacttagggggcact

SEQ ID NO: 491090 - DNA, 184 bp, Homo sapiens
caacagcaccgggtgtctgcgctacgaacaagagggctgagagggtctggtcctgaaacaggctcccccttaggctcaacacgaaagggctttcaatgaattaagtgaaaactttttccttaattacaaaaatgcaaaactcaacaaagctccaaacctattggaaatcaaatatgaacttgca

SEQ ID NO: 491091 - DNA, 379 bp, Homo sapiens
gctgctcgctctgctacagcatactcctagagtagtacaggcagggagatcttaactattggaggaatcctaaacactattcagggtaagaattctggctagtcccaaaagggtccttcttttaagggttttgagaaactagacactgcaatttattagtatcggcgacgtttgtatggggcaaattcagctcccggagctgcacggttgaatgcaggaggagttccaccacattgcccccattccttccattgtagcagcctgaccaaagcgttcagttgttggtggggtctatcccaaagttccatccggcatcatagtggcaggtcctggaggagctggggtaccagctggcacaggagcagggggtgtgcgtggt

SEQ ID NO: 491092 - DNA, 1060 bp, Homo sapiens
gacgggataggcggcggttgatcccaggtgcgagtggcggcgacgatgcggcgattcggtggcccgtcgccgaccctgagtgctgcctgagccgccctcgctgcgcgcgcgctccccggacgggcccactcgccgtgcgcccatgccatgaatctggcgagccagtagcggggaggccggcgccgtccagactgctcttcgccaacttcaaccatggacaacacgtccctatctgttggatacgtaagtccggttataaatttttctccctttcttctgtggataagctggaacagatctatgaatgcaccgatacggaagatgtgtgcattgtagagagattgttctccagcagcctagtggccatcgtgagccttaaagcaccaaggcaagctaaaggtttgccactattaagaagggaactgagatctgcgaactacagctactccaacacgattctggctgtgaagctcaaccaggcagaggctgactagtatgcctggaggagatccctgtacatccacaacattacggggacatgaaggttgctgcattacgatcagggagacgcctcgaaacccttgcagtgccctgtgttgcgctggtcaattcaacaaggaaaacttgctacttggcgttaccccaagggaagcggcgacccatcggacgaggtgcaggtcttcagaaacccattaatttgaagaagctggaaaccatgattccccgggtcaccgagagctccatttaaacgggcgctggccctttgcacgcacgtgtgggaactaaacacttggccactggcaatcggaagaaacggggaccggtgattaggcggtaagttgtgccattcccaaaacgggaaccgaacaagttcattaggaggttatcgagcaacaggaactttacagcaaggttgcgtatgagcattagtagctcccccgtggccaattacgcgaattgacggggcacatgtacccatcaatctgcggatccaagacaacacatgagtaaccgtggaaaaattatcaaacgtcgagaactggtagaagaaaaagacccc

SEQ ID NO: 491093 - DNA, 136 bp, Homo sapiens
  misc_feature (110)..(110): n is a, c, g, or t
aggagtacaggtagactaacccaggtcggaggcttataaacattagctgtcagctcagcttgtccaaggtatgtgcccccaaaaaagcacaacccaggagaagtccaggnagcaggggactttagggcttgctcaa

SEQ ID NO: 491094 - DNA, 350 bp, Homo sapiens
  misc_feature (13)..(13): n is a, c, g, or t
caaccctttttcnccccccccccaacgccagggggggggggtacttggccccaaggaactggggggggggattttaaaacccagccccccttttcgggtgggttgggggcgaagaaaccccccgcctcccgcccccccccccccctaaagggaatctttttttatcccggggggggccccgaaaattcttttttttaaaaaacccccccccccagagaaggccccccggccaggggttggggccccccccttccggtttgccccccggggtttgggttcccaaaaaaaccaaggggggcccttgggtgggttcccccatgggcccttctaaaaaacccccttttttttta

SEQ ID NO: 491095 - DNA, 417 bp, Homo sapiens
  misc_feature (39)..(39): n is a, c, g, or t
  misc_feature (144)..(144): n is a, c, g, or t
  misc_feature (157)..(158): n is a, c, g, or t
  misc_feature (199)..(199): n is a, c, g, or t
  misc_feature (224)..(224): n is a, c, g, or t
  misc_feature (246)..(246): n is a, c, g, or t
  misc_feature (284)..(284): n is a, c, g, or t
  misc_feature (295)..(296): n is a, c, g, or t
  misc_feature (322)..(322): n is a, c, g, or t
  misc_feature (329)..(329): n is a, c, g, or t
  misc_feature (331)..(331): n is a, c, g, or t
  misc_feature (336)..(336): n is a, c, g, or t
gactttttgggtcgtcaggaacctggtattagaaatcgntcgttacagagattaacgagaacctacgaacgagtcgggtacggtggtgtacgttcacaacttcagtatcccaggggtcgaggtcggaggactatcagaggctangagcctgagagtnnttcggttaatacagcaaaattttgctcgcatcaaaacatanaaactagttggatgcggcggcgtgngttcgcaactttagtcatccgnggagttcgaggtacgagggctatccgaattcgggaggnggaggtcgtanngagtcgcaaccgcgtaatcgtatctnagtccgngngatanagcgagatatcgctcccacatacacactccgcaggggggtttggcattaacctgtcttcacagcgagcctgtccatccttt

SEQ ID NO: 491096 - DNA, 477 bp, Homo sapiens
cgccatggggtgggacccgggaaattcggccataatggccgggaaggaagatgagtttgaagatcaggccttttttccaacagaattagtcccaattccgtaaattttggttcttcggaatgggacaccattttggaccataaggtaatgggaattttctttaatccataatattcctttaaaactttaaggcaaacgtaagggggacttttggaaaaaggtttaggataaattccattaaattagcccaggatttcctttggtttccttaattcctctggttaaccaggaggtaccaaaggtttagtttggccagagtgggggtcaataattcaagttttagtggatggcaagaattttcaattagggaaaaggggcctttaatcctggccgaaggaaacccatgacggaagggaaaaactgaggttaaaaagtccactttaaaacctatattaattaaggtaggaccggccaagg

SEQ ID NO: 491097 - DNA, 1161 bp, Homo sapiens
gatctaatgaaataggttggcatggctatccacgagggcaggtcccgaaggccagcgtacagctgaggtgtggacacggaaaggtttgctacacacagtgtgatgtctcttgaggttagagaaccctgtgcctctttgggaggatgtatgttttgccctaggcctggatttcggtagaactgatgcaagagttagccttgaagatcctgttcaggtgggcaccacgtcatatgcaccatgtacacagaatgagctagatgtgacgatgccgagagtggcttcgaagggaagagagcccggaccttgcttcccgtcaggccttccaggatgctcaactgctcgggccagaaccatccatgatgcggacagatacatcgcgcctgacttagtacctcgatgaaagtaacagacacgcacggaagggccagttgcgtagaagtgagcctcagcggcactagttaaggtccccaagcgcacatttcgggcgagaggcctgaagatgccgcgcgtatgccgcactacaacggttatgaccgcaattcaagccatggggaccaaagcgacatggggctgaacaaacctcccggtccctccttaagcctaccacaaaactaaacaactcgaatactctcaagcccaagcgacattgcgatgggccgtgaggcaatacctcagtacgatacctacgtcccggaacctctcgggacgcacacggccttcgacacgcggacacgcgcaggaaactacccacccttctcggaaacccccccaacgggggcaagatgctcagcgacagcgcggtatgggaccacatccggacacgcccttgacgctccatacgacaccactcctgcaacctagacggcctctcccgaagaccaccttggctaaggccacaaccaaaagggaacggcaaaaaaaacaccccccccaattcctcccaaacaaaaaatactaacagcaagcacccatcaccattcagcatacaaccaacactccaagcaatgcaaccaaacaatctaatacacttaccatgcaaccatccgagcccaccaacacacatactactcccaatccctccaccaccacagctagacacacacacttgttggctattaacaataccaagttcaacaacacacacccgacaacaccaacttt

SEQ ID NO: 491098 - DNA, 1047 bp, Homo sapiens
  misc_feature (494)..(494): n is a, c, g, or t
ggccctcctgtgcgtgcccggcgggtctcactatccaggtccctgtttgctgaaccgactgcaggtccagtatgccatcggaagggtggtgaaagcccaagcgggactccccttggtggcggagcaaaggctaccgctgcatctggacgggtcctcatacaagagggtatcgtgcgcaaagcaacgctacctccaaagatccatccggcacatgcccacatggtgatgcagtggcaggatgtgcccctcctgcgtcacatggccggcttggattcctagccatggcagacatgtagaccctgttctcctgagctcaggccgaggtcatctgcaagccggacatgcacgtgagccagtcactcacggcaagagcagtcgtgtcacggcgacagtggaagaaccgagtgaacggatgtagctgaacatgtaactagcataccacggcttcgtgcatggatgacaagtcgctggtgaatgctgctgtccccgaaggnatcctacgggatctccggcagaacaggtggccagtggatgcctcacgatgggtaactgtcgcatggggctatccttgccgaacggaaataccgcgtatcgcgagaacttgccctcgattcatcccctgaccatgtggtccgagaggacgaaagcattgcacaggatgtttgcgtccgtgacgttcgcatgtaaaggggcaatcgtggactacgcgagaacacgtgaaccttgtactccgtaatagacgcaactggttggtaccgttggtcccgcggccaaagggcacggcaggggtacttggacatgacgtaaacttcttcccttccaaaaagggccttaacttggtagcccccctcgttggtttggccacagatggtaggcaaaacgtgaataggaaaaacctaagaatagccttgtccttgtgagccgcccacgaaactttattgcccccaggcatgggtggggtggcaggttgtgccccccggatagggacgtcacacaatagtaggcaccagaaattagtctgccctaatccgcttaaccactgggaaa

SEQ ID NO: 491099 - DNA, 956 bp, Homo sapiens
aacagctaaggactgcaaaagcccactctgcatacaagctgaacgcaggaatcagccactttgaattaggagctaagtcccttactagaccaagtgggaactgtaatagcccaacgaaaccacgttagttaaagagctaagcaacccttatatctaactgcgctttccagtcgtacttcctccgcgccgtcgggagaaaaaggcgtggcaagtaatgccccggcaggtttgaagctgcttcttcgcaatttgcaattcaatatcgaaagatcacctcggagctggtaaaaatagaggcctaacgccctgtcgttctagcatcttacaagtcccaatgcttcactcagcgcattgttcacgctgcaccgccgaataaagccaacctaacaaaggatcaaaagacaaggtccatgtggtggggcgcactggctccggggaaagcgttttgcaggacaagaccatgtgtgaggccaccctggccccgcgttgaattggactccctagatgttgcacgcacacttgcaccctcatggagacgcgtgcgcattgccaaagggttgccagtggctctttcgacctagaaatagactcgcgccacggggcgcaagactcgtgctttttcccaatcaacttggcactgcagttgtcctggagcgtccatcaagggcgccttcctaacaaggtcccttacccagaggccatcttgatactattccccccgggcgggtggatggtctgaatgaatcgccagaattgagtccatatgtatgactaacctatctgtatactcattttatcagaagcctcaagctccaaagtatgtgtcagcaatgacgtctgtgtcacaacgcaatccttcacttccccaaatattaatcaaaactagcgcatggacccggcagtatatgatgaaatgacaagactctgactattaacactacaaacaactcaaccgc

SEQ ID NO: 491100 - DNA, 627 bp, Homo sapiens
ggcattaccattcaggacataggtacaggcaaagatttcatgacaaaaacaccaaaagcaattgcaacaaaagctacgattgacaaatgggatctaattaaactaaagagcttctgcacagcaaaagaaactatcatcagagtgaacaggcaacctacagaatgggggaaagttttgcaatctatccatctgacaaagctctaatatccagaatctacaaggaacttaaacaaatttacaaaaaaaaaaaaaacccccattaaaaggtgcccagggttttgaccggacctttctcaaaagaagacttttgggcggccaagcaacccatgattaagaaaaattctcaaccattcaccgtgattcggttgagaagaaaacggtgcagaattcaaaaacccaccaattgaagtattacccattcttcagcgcccagttcagaactggggctgatttattcaccaacggtttacacgacaacaaattagattgcgggggtgagctcgggaagaaacacgggaaattggctttacaccttggtggggggcaaggtgtcaactttagttccatccctttgggtggccacaaacagctggtggttgcttcccctcagggaatttcttagaacca

SEQ ID NO: 491101 - DNA, 298 bp, Homo sapiens
aaaaaaaaaaaaaaaaaaaaaaaaagcacgagggcctgtaatctctgaactttgggaggctaaggcaggaggattgctggagcccaggagttccagagcagcctgggcaacacagcaagacccatcttacaaaaaaataaaataaaagctaggtgtaggggtgcatgcttatagtactagctacttggcaggttgaagtgggaggatcacttgagctcaggaggttaacgttgctgtgagttgtgatcacaacactgcactccaggctgagcaacccagccaggccctgtctcaaaaa

SEQ ID NO: 491102 - DNA, 338 bp, Homo sapiens
tactggagtgcatgtgatcaatttgactacaggcttgatgctctgagtaccatgattgacacaacatatgtgcaatgcaataaatgttacacaaccacactagtatccttcttcctgaagagcaacagatacctgctccttggcagtgtggtgggaacttgcttttcctttgataccctacttcaacccccatacagtcacattagacctttcttccttaagtgctgggcagtacggactggactaatattcaggacccactaacgtcagcacaatcaagttttccacaaataggatgaccctctagctatagataacatgacactcctcctttcccc

SEQ ID NO: 491103 - DNA, 286 bp, Homo sapiens
atatgtttataattgttatatctttatgctggatttacacttttattgggggggacaggatctcactctgttgcccaggttacagtgcagtggcataatcatggctcactgcagtgttgagcttcccaggctcaggtaatcctcctacctcagcctcctgagtagctgggactacaaaagtgtgccactatgctcgtctaattttttatttttatttttattttattattattttttgagatggagtctctgttgcctaggctggagtgtagtggtgcagtctcag

SEQ ID NO: 491104 - DNA, 966 bp, Homo sapiens
ggggtgggagtgcgagtgggggggtcgtggggggtgggtgtgtgggtggcggcgcctggattttgtggccggtaggggttgatggggttgggcaagcaggggcgactttgttgctctgggtgggtgagatgttggtggttgggttgtgcgccacggcgtggggtgtcgagggtttgtttgggtgggctggctgccgcagtacaggatcgttggtgggggggcagctctgtgtgtgtgtgggttgttgttggcgccgagtggggtgtgtgggccgctggaggtgggttgtacgtcgtgtgtttgtgttgtccacgctgcgggggtcggctggggcggcgccgttttgtggtgcgtcgggcgtggttcgctagttagtcgttgctggtgtgcgtcgtggcgggcgggtttggtgctgtctggtggagctgggtggtctcccgtatgtggtctcctgttccgattgagggggagcgcggtttcttgtctcgcagtagaatggggggggggggttctgtttgctcgctgtgtgtctcgcgccactattgtcgttcgggtgcgccgcgcctttggcgccgcatgcctgtggcggccgcagagtcgtcctttgtctcgttggattgtttcctgttgggcggatgatcatgattttttttgtcgcgcgcgacacagttgttctgggcgtgttctgggagctatccgcccgtcgtgttttttggtggcgtttcccctggtgagcgtctccgcctccatttgtgccatcctctggttgctctttgtgggggttgcctttcattttcttttccacgacggccggtggttgtgttaaatagatgtttttgagtatttgggcacccctcgtcttttagggaaattttttttttttggaggacacccccctacccggggggggaaaagtggggggcccctccccccccccccttaacgacataaccctcttttccccca

SEQ ID NO: 491105 - DNA, 600 bp, Homo sapiens
gccagtattaatttaggattaagacaaataggtgcttgtccctcttagtcgttaaaatcgctactagggtgtcactatagaaagcaagacatagcattagaatataccagcagagagtcttttgagcagctgaaacctgcgagagcttgcaaagatatgtctctatcactgtagctgcttttggaagtagagtttccatcctttcagtattttattttaaaatgtaaatagtatttcatgtatggaaaagaagcctgctatttttctttgctaaaaaaaattttaaatctaaaataatgatatagtgtcacagcaaattagtgatgtttcatactactacattaatggattattttagaaacaaagataaaaaaaccttactgagccacttaatgaaagtaaattatttaaagtacacactttatagagtgctttcaggccttggagatgtcatctggagtcatagaattacattttaacactttattttcagagacttatttgtgaggttatccttaggttatcagtctgaatttttgctcttactggcaaattgtttgtaggtttatgaaccacatgaaacatccttggaacttgaga

SEQ ID NO: 491106 - DNA, 315 bp, Homo sapiens
caaactgcacgggcctggtgctggtggcacgtggttgggcctggccttgggcttgtgctggcttggctgggtctgcgcagcggcagtggcggctggccttcttcttcgctgcttcggccggcggcacggcactgaacaggaacaacgcagcaatggcagcggccagcacgcggggggaatacggcatcaagaagcttccgtggaacacagaccgtggagcttgcacgatccgcgcgcgtacggccagcgtgaaggcgcagtcagcttggtggcgctggggcttcagtcagccgcggcggcgtgcccgcagcgcgg

SEQ ID NO: 491107 - DNA, 981 bp, Homo sapiens
  misc_feature (676)..(676): n is a, c, g, or t
cgactggaggggcgggggagtcacctgcgagcggtgcgctggggccagcccgcccaccgcgtcttggaatcgcgccgtgttgctgcggggcttgggacaggacaacaacctcttggaagggccccgggggggagacacgggggcaagaaaggttcgagcagccccttggagagttccggagaaccaagggaaggaatcgggaaccttttaggccttcgggattggttcgccgggacctgtgctgggccggccacgggggacagggaacgggggcctaaataaaggtggaaaaggaattgggggggacagtccgctttgtgtgcaaacaccatgtgttgaacagctcaatatttactattaaggacgggtttataagcggtaatatagggtgtggacacaacctgtgttgtagggaagcaccagggcttgggattccaaaaccttttttaatattttatttacgcctgtggggacgagaaggttctcattaattttggggagagacagcggtgactttaattgggaccaaaccggtattggtgttggagaggagaaaaagtaggcgccccaaaaatggtgcatagaggacaacgagttcttatcgaccccggtgggggattgaaaagaagtgggaatttatttcacgttgggttatatttggtgggcgaccaaatanttgggttagtactttcccaagtggaaaagaggacacacatgaagttttattacagcacgaaagcgaaacgaattaagtttatatttccccacgctggtgtgaaaaatagatgtggtgttcatcgttaagtttgggaattgcacccaaatactacaatgaattgtgcagcgcgtgacaagacaatttataaagggtcgaagattggggacttgggcacataaagtttcagatggggtaatagcccaagtggattcagaactctgttctaggaggcagaggtatataatggcacgtggcgcaactgt

SEQ ID NO: 491108 - DNA, 464 bp, Homo sapiens
aatcgagctcggtccgggttccttgtcttgaaaagtactgatttgtccagatgtggtggctcatgcccgcaatcccagcacttcgggaggcagaggcgggtgggacacaaggtgaggagtccaagaccagccctaccaacacggtgaaaccctgtctctactaaaaccacaaaaattagtaggccgggtgtggtggctcatgcctgtaatcccagcactttgggagtctgaggcaggcggatcacctgaggtcaggtgtttgagaccagcctgaccagtatgatgaaaccctatctccactaaaaatacaaaaattagctgagaatggtggcatgcgcctgtaatcccagctactagggaagctgaggcaggagaatcgtttgaagccgggaggcagaggttgcagtgagcggagatcacaccattgcgctccagcctgggccacaagagcgaaactccatctc

SEQ ID NO: 491109 - DNA, 996 bp, Homo sapiens
tctagcatcaccactatcagaggcacgtctgaccagtgacacatgttgatagggcctgggtaccctaagcgtgcaccgggtaggataatcacgtagtaccttaaatagggacctgtatgcagtggctgcaggagggttcagacgtctcttgactgttgaaccagtgagaactggacctggccgtgaagatggcgcggcatagacaagcgagccagagacgaggaagaccctatggagctctatttggatagaatgcaaacagtagctaacaaagctgacaggtccataatactagcaaatcgtgctatgtatgaaatttctggtatggggcgacctcggatgatgaacccgaaccggccgagtcagtcacatgctaagacttcagcagtcgagagcgaaatactatactcacatggatccgataagttgaccaaggaacgagttacgctagggataacagtgcgatcctattctagagtccatatctaacaaatgagggttaaacagaatctcgatgttggatccggacattcccatatggttgtgatgccgctgcttgaaaggtgcgtatgaccaatcgaataaacgtcctacgtgatctgaggttcagacggagtaataccaggtgcggcctctaatgtacgtcacattcctccctgtacgaaaggacggagaaataaggcctacttttacagaaagcgcgtttcccctgtgcatgatctcatcgtccagctttagtattaatggcccaacccaatcccacgaaccaggggttggaactagcttccggaagatggagacgtcagtaaaactaacatgtgcggcgcaccccaagatgcgcatcgaaaaccaaaggaggcacaccatcaagagaaaaggggcaaaaccgggggataacaaagcaaaggcccgttataacgtcaagaaaaaaatgtatatgcagagcccggtgcgtaatgaacaaccaacatctaccaaagactatgaccttcggca

SEQ ID NO: 491110 - DNA, 216 bp, Homo sapiens
gggggggggggggggggaaccccccccccgggcctttgggggcttttttttttttcccctttttggggccccttttgtccccccccccccccgggggggaaaaaaacccccccctttcccccccccccgggggcgggggggggaagggggggggtttttttttttttttttttgggggggttttttcccccccctttaaaccctccccccggggca

SEQ ID NO: 491111 - DNA, 161 bp, Homo sapiens
  misc_feature (4)..(4): n is a, c, g, or t
  misc_feature (6)..(6): n is a, c, g, or t
  misc_feature (78)..(78): n is a, c, g, or t
  misc_feature (111)..(111): n is a, c, g, or t
  misc_feature (123)..(123): n is a, c, g, or t
  misc_feature (145)..(145): n is a, c, g, or t
cccngnaacacccacatcccctcccccccccccggccggggtgtgctcagggaatgtggattcgctcaaatgccggantgagccctgagtgtttggaaaggggagactccncctttttaatcncaaatgtagcctacaagcaagnggctttggattgttta

SEQ ID NO: 491112 - DNA, 828 bp, Homo sapiens
ggctcgcctggtgagtggctggacaggcagcgaggcaatcgtctcccagcggtatttcgcgctcctggctggaaacgctggctgctaaagtggctgtgatctgatgcacgcataccccaggtctcgggaacggaggaagaggaatggcgtcgttcaccgtgtcccgagatcgctgtccttttgtcgcgacatgaatgctgatgtggctccgctggcacctcaagagagtggcgtgctggagacctagtcacgaagacagcagtctgcatccatcgtctgggtgcgcgcatgacaactttcacttggacaactcacggctttacttttgatagctggaacgcatggatgagaagacgtgggagtccggattgaattgggtggagccttgaaaattggttagacagtttagtcgagttgaataagagagagttgtgacatggaactcaagtgtcatcgtctgaattgtacctacagggaaagtgggacgtctatttgaagaatatgaatggattctgtaggtgctgagagatgattgttagaccggacgatattctagttagtaacctaatgctagtacaacgcataggccagccctagaggctatcggtctgataaggttacttctctggtgcacacgtgtgctggagaaaggacttttcacatgtcctctgcctggtgagtaaccacaaatgtattttccttttaagcgagagatgaatccatccgtggataaccttcaggacttcaaaaagtgagcatcactatcctttcagagaagtgtgcccaggatactgatataagaatggcaatggaatcttcgtcagtcga

SEQ ID NO: 491113 - DNA, 118 bp, Homo sapiens
aggctccagctacgatatatggaggcagcacggtactcacgtagtcgactgaacttgtacagtggaggcatagcaccgcatagtaaatacacgtacgacctggctaccatatataacg

SEQ ID NO: 491114 - DNA, 285 bp, Homo sapiens
tagcaggaccttatgctgaccatcactgcaatctcctttcaatcaacaatacaagcctcccagacagatcatcagccctcttagaacttgaacaaaataggagtaattaaagttggtcattggacactgaaaacctctggcatgacaaagacccctgatcctccgtggactcactccaacagctttctataacttggacgatgaccagggggtttgggaagaatgaagctggagaagatgaaccgggggcaggtgaggcttttaattcaaaatttggaaagaggc

SEQ ID NO: 491115 - DNA, 200 bp, Homo sapiens
ggcgagtggcacggtagatgatgagtatgactgtataatgagtatagcggtatatgagtatgggccgtataatgagttggcagtatagatgagtatgggtggcatagatgagtatcggttggcgttgatgagtatcggctggcattgatgagtatcggctggcgttgatgagtatcggctggcattgatgagtttggctg

SEQ ID NO: 491116 - DNA, 1196 bp, Homo sapiens
  misc_feature (16)..(16): n is a, c, g, or t
  misc_feature (19)..(19): n is a, c, g, or t
  misc_feature (127)..(127): n is a, c, g, or t
  misc_feature (129)..(129): n is a, c, g, or t
tgactcagaggatgcnttngcgggcttttcccctctctcccactccactcctggctcagtcttagagatttctatgccctcatggattctacccctgccttcctggcctcttgattctgggcttgcntntcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtaccaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctcca

SEQ ID NO: 491117 - DNA, 316 bp, Homo sapiens
  misc_feature (34)..(34): n is a, c, g, or t
  misc_feature (47)..(47): n is a, c, g, or t
  misc_feature (58)..(58): n is a, c, g, or t
  misc_feature (127)..(127): n is a, c, g, or t
  misc_feature (203)..(203): n is a, c, g, or t
ccgtaccacagcattttcatgggatgatccttantgtgctcacgggnctgctcttcgncagtgatggctactacgtggccctggcctggacatcatctgcgcttatgtacttcattgtacgatcttngcggactgcagcttcaggccctgacagcatggggggcccagcccctcggcagcgtctccagctctacctgaccctnggagcagctgccttccagcccctcatcatatactggctgaccttccacctggtccggtgatccctggtccttaggtggcactcatttttccataccctgaagattgtggctgg

SEQ ID NO: 491118 - DNA, 1276 bp, Homo sapiens
  misc_feature (16)..(16): n is a, c, g, or t
  misc_feature (19)..(19): n is a, c, g, or t
  misc_feature (127)..(127): n is a, c, g, or t
  misc_feature (129)..(129): n is a, c, g, or t
tgactcagaggatgcnttngcgggcttttcccctctctcccactccactcctggctcagtcttagagatttctatgccctcatggattctacccctgccttcctggcctcttgattctgggcttgcntntcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctcca

SEQ ID NO: 491119 - DNA, 338 bp, Homo sapiens
ttggggctccattcgagggcagaggcagagaacaggaagtggatgattcagcaaatcaacaggaccatcgggtatctggggggagccacggagaaagcacagccggcagagcacctcagcgtcatcatcacatgagaccaggggatgaccacggtgaagaagagacccaaggtcaacaagatcccttgtccaactacatcaagttcagggacggtgtcaagttggatatggtgggctacggtggcttggggatgcccctaaccaaatgggggcaagaggaagccctttaccaggcactggaagatggtgaccctgacctccaggtctaccctggatgg

SEQ ID NO: 491120 - DNA, 552 bp, Homo sapiens
cttgtttaaaggactgcagaccaaggagcgagctttctctcagagcagttgcagttcttagccaagggtatgaagtcgcaaatagaaaaaaaaatcaagggtggcagctgaagagccgtaagggggccatattgaagcctggttgggggacgtaggaggcaccggaatgaggtgaggtccgtctaactaagtttatttcgcaactgtggcaggtagatatttaaatagactgcgagagactatggggaaaaactggaataagcgtgggggacatcttggtagaaggaacctgtagaatatactgtgtgaggttgttgaacaataattggggatcagaactatatggctacaggagaagtgtaacaaagactttctaagagggttcagaattactataaagttttatagaacggtggtatagagggtggtaaaaagtaggctgacatagtgggcttgaagagcagttgaagaagtgtgagagacttaaagtggaatagtgaatatattgaacagtgattagtagaacacagagagtgtagtgtgaaaaacgag

SEQ ID NO: 491121 - DNA, 145 bp, Homo sapiens
acgaaatgtaacaactatccaatgttggaataagtgtcatgagtgtctatataatttgctaatatttaaaatatttatagtaaatatactataacaatcactagtagctattgtctttaacacttacatgttgatatactcccct

SEQ ID NO: 491122 - DNA, 181 bp, Homo sapiens
atccgcctgcctcgacctcccaaagttgctgggattgcagatgttagccaccgatcctggcccccccaaaaaaaggattttaagaaaaacttctcttgcgccgggcgcagtggctcacgcctgcctcgacctcccaaagttgctgggattgcagatgttagccaccgatcctggacccccc

SEQ ID NO: 491123 - DNA, 115 bp, Homo sapiens
tcaaagatttttaggggaatcatctcaggcagcatgggccatgcaaactgtggtttgctcccacagcatttccagagcattgaccgtagtatacccccggtcgtgtagtacgatg

SEQ ID NO: 491124 - DNA, 340 bp, Homo sapiens
  misc_feature (1)..(1): n is a, c, g, or t
ncccaccagcagagatttctccttgacctggcttgggctagagtgatctttcactggtttcctaaccataccttctctataaagcatgtaccactgacatgtcactgagggagcatagttctaggtgttaattctctcaaccggctactccactaaggcgtgatcaacggatgcgcaacgatggaacccttttggtacacaatacaatcccttctacccgagtttagacgctgttaagaggttatagaggaatgttaaagtatctaagatatctcaacaaagaactgagcatgggagagcaaattgctctggaacagataggcccgcttcacagtgtgcg

SEQ ID NO: 491125 - DNA, 748 bp, Homo sapiens
  misc_feature (663)..(663): n is a, c, g, or t
  misc_feature (665)..(665): n is a, c, g, or t
  misc_feature (708)..(708): n is a, c, g, or t
tgagacagagtctcactttgttgcccaggctggagtgcagtggcatgatcttggctcactgcaagctccgcctcacgggttcatgccattctcctgcctctgcctcccaagtgggactacaggcgcccaccaccacacccggctaattttttgtattttttagtattttttagtagagacggcgggggggggggcgggtttcaccatgttagccagggtggtctcgatctcctgacctcgtgatccgcccacctcggcctcccaaagtgctgggattacaggcatgagccaccgtgcccagcctggagctggttttttgaaaaaaaaaaaaaaaaattaataaaataggctactagctagactataaagaagaaaagagagaagaatcaaataaacacaatcagaaatgataagggggatatcttcactgaccttaaagaaatacaaacaacgatcaagaatgctttaaacagttctatgcacataaactagaaaatctggaagaaatgaataaaatactggacacatacaccctctcaagactgaatcaggaagaaattaaatccctgaatagaccaataacaagtcctgaaattgaggcagtaataaagtagcctaccaatgaaaaaaagcccaggaccagacatattccagcttgaattncnccaaaagtacaaaaaaaaactggtactatttctactgaaagtnttcaaaaaaaatcgaaaaaggaggggactcctccctaact

SEQ ID NO: 491126 - DNA, 124 bp, Homo sapiens
ggggcagagagaacggagttatctcagagcaggagaagccactggaaaggtgtttttttggtttttctgttttgagacagagtctagctctgtcacccaggcagactgcagtggtgcaactctt

SEQ ID NO: 491127 - DNA, 126 bp, Homo sapiens
acttacatagacccatttggtattgtccttgcaaaaatcctccagaggtttcacagagttgtacaggtaacgtgtcaacagtagatagtgaaccttcccagggcccctgtgcccccaaacttttgt

SEQ ID NO: 491128 - DNA, 133 bp, Homo sapiens
tgtcagaaacgattataggatcagaaaccatgaaacgcttcaagaatagtatctttaagtacgctactgaataactcagtgaacgctgttttgaagcttacatggacgaatgtttaggacttcaagatcacac

SEQ ID NO: 491129 - DNA, 174 bp, Homo sapiens
aaaattcccaaaaatataattggactcctcccccccaatggggccattttttccccctatagaagaattattgttggtttaagtaacatgaaaactttttcctccgcataggccggggtcagattaaaaccctgaattgccaattaacggcccaatttttcccttcccccccca

SEQ ID NO: 491130 - DNA, 213 bp, Homo sapiens
  misc_feature (169)..(169): n is a, c, g, or t
  misc_feature (177)..(177): n is a, c, g, or t
gaagatgccagcttttgatttgttatgagaaacattgtacttgaaagaaagaattgtttcatcgttcaaatactgtaccaatactggtagtttcgctctgaggagcttcttccgatgcacactgtttgaaggatgacctctaggaagaaagtgttgctgaaggttatcnatcctggnagattctggagtcgggaagacatcactcatgaacca

SEQ ID NO: 491131 - DNA, 107 bp, Homo sapiens
aatgatactaacagctctctctcttgtttacctttctcttcagccgtgctctactgtccttcgtctctttcttagacacttcttcagctgcatgtgctcaaaatgcc

SEQ ID NO: 491132 - DNA, 779 bp, Homo sapiens
gcttccaacgccttaacggaggaggcaggaaccggagcgcgagcagtatgctggtgtgggcaccatggtctgtggatcaccagccatcgatggcgtgtgacgcgcaagatccaggttctgcagcagcaggcgagatgatgctacgaggatgcggtagctgatctgcctccaggcgagaagttgagtggagaaaggcgggcccgggaacaggctgaggctgagtgtggcctccttgaaccgtaggatccagtctggttgatacgaagagctggatccgtgctcaggaggcgcctggccatctgccctgcatgaagctggacagaagctgaggaatgctgctgatgagagtgagagaggtatgaggtgttattgaagaccgggccttagaagatgaagaacagatggaactccatgggatatccagctcaacagaagctaagcacattgcgcgaagaggcagataggaagtatgaagaggtggctcgtacagtcggtgatcattgcaggaggacttgtgaacgcacagaggaacgagactgagcttggctgagtcccgttgcccgagacgactgggatgacgcaagattaagactgggatggaccaagaacctggaaagctgtcatgagttgctgcgtgaaaaaaaaaggtacttctcacacatagacggatagactaatgagcgaccccaacatcaagatttctactggctaactcatgggtggcagaagacccgtgcttgggttgctgagagactggtaccagcttgagggccatggtc

SEQ ID NO: 491133 - DNA, 258 bp, Homo sapiens
cgccaggtcggaaacggcgcaggtcacaactcccgtgctgatcagtcgtgggctctgcgcctgtgaatagccactagcactccagctctgagcaacatagcgagaccccgtctctactaaaaatacaaaacttagctgggcgtggtggcgagcgcctgtaatcccacctacttggagaggctgacggcaggagaatcacttgaacccgggcaggcgacaggttgcagtgagccgagatcgcaccaattcatttcagcc

SEQ ID NO: 491134 - DNA, 194 bp, Homo sapiens
cccaaaagccataaacccacctagaaaaaaaaaaggttttccaaaatgaaaggaaggaaaaaaaaaaaaggcccccacccccattagaagtcttggccctttggaacggaacggggactaccctttatcttaattcttaatttaaaaacaggtttccaagttccaaccaacttctatgaaaagttgaaaagcca

SEQ ID NO: 491135 - DNA, 304 bp, Homo sapiens
  misc_feature (43)..(43): n is a, c, g, or t
  misc_feature (45)..(45): n is a, c, g, or t
cagagcaggggaggcattaaaaaaaaaatgtaggtgccaggcnanttggctcacgcctgtaatcccagtactttgggaggccgaggcaggaggatcacgatgtcaggagtttgagaccagcctgaccaacgtggtgaaacccaaaaattagccgggtgtggtggcacatgcctgtaatcccagcttctcaggaggctgaggcaggagaatcgcttgaacccgggaggcggagggtgcagtgagcttgagatcgcaccacttgcacttccagcctggggttgacagagttgagattccatcttca

SEQ ID NO: 491136 - DNA, 122 bp, Homo sapiens
tcgcgggaacataccgctaatgagccaagggcttgtggcggcactactccttgctgaggatgtaactgggctccacttctggtggggcttgatggaacctggcttgaccatgaccaggcccc

SEQ ID NO: 491137 - DNA, 314 bp, Homo sapiens
ggtacacaacctagggtcagttttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 491138 - DNA, 104 bp, Homo sapiens
gtaaataccaggatgtagaagaaaatgaaaatggagaatttcaggccaaatattgtggtgacctggctgtgatgcttttgaggaggatacctgggatgaactcc

SEQ ID NO: 491139 - DNA, 202 bp, Homo sapiens
gagtgtctaacaagagtgatggcatcacttccatattgcccacgcccatctggcacctgtttgtggccacgggagcagcagtgcattactacgccattgggaaataccttgaccgaagtcctacggactttatgcgtgcattttatgacctagtctgtaccataactactccaaaccagtataatttcatttatggcactgg

SEQ ID NO: 491140 - DNA, 412 bp, Homo sapiens
  misc_feature (10)..(10): n is a, c, g, or t
  misc_feature (27)..(27): n is a, c, g, or t
  misc_feature (36)..(36): n is a, c, g, or t
  misc_feature (84)..(84): n is a, c, g, or t
  misc_feature (103)..(103): n is a, c, g, or t
  misc_feature (157)..(157): n is a, c, g, or t
  misc_feature (183)..(183): n is a, c, g, or t
cctccccaantcccactacggcctggnagggcccantccggccaaggggtcctgtcctaatggtccaaggccacttcccccacntcccccttttcccccatcnctggcgcttgccataatccaaaattttgcctggctctcctgcctaggttttccnataaccttaccctaccattattaggnatatggtcacataacaaggaagatgacccaatttatccaatcattttattgttatttttaaaaacagaaaatgacgtagctaaattaaaaccaggttagaagaatatggtattccaagactagaaatggatatcataaatagattatataatttatgaaaatcctcaagagtaattttggaattggatatactatcttaatatacatgtcctattacatcaaatcacaa

SEQ ID NO: 491141 - DNA, 85 bp, Homo sapiens
  misc_feature (2)..(2): n is a, c, g, or t
  misc_feature (14)..(14): n is a, c, g, or t
tntcaataatggtnaacatttagttgagttctttgtaaagcctggtacgtatgttaaacgagttgctgagtgattacatggtcgt

SEQ ID NO: 491142 - DNA, 158 bp, Homo sapiens
tctccacagaatcacccttagcgctagggatatggagatgaagggtgcatccttcatacatctcatcacagttgcgacaatacagtaacgacggagaggtaagggcaacagaatataacgacagcggcgttgacatatatggtggcgtcgggcagata

SEQ ID NO: 491143 - DNA, 573 bp, Homo sapiens
ttcgggggtacagccaaatttcatgcgcaaacagttattattccagccgtttctgtcaagggcaaccgtcagtcaaatctgaaacaattgcaatcttaagagtgtggatattaaagaacaatgatcaggggtgaacataattggcaatatgcataaatcataccagtggcatcgtcaagacgagtagagaagaagacaagcaatcgcggatcgtcaagcggtattcaaataagtaaattaaggagtaaacaaataagagtatggaaataaacaaagaagcaataaagcacactactatcgattggaaaggagattaaagatggcaagataaataagtaatgggcaataatactagcccgttggaatctaccacgtagtgtgtgaacaagtagaaggcatgaaacagagatcaaaacaagaaagagaagggcaacacagaggacagaagacggggcgggtaaagcggggcacgtcacacgaggcagacgacaagaatcgaggagtaggacaggagacaaagtaacaagacgaggaaagaagagaagaagcagaaccaaacaaagacacaacaaa

SEQ ID NO: 491144 - DNA, 219 bp, Homo sapiens
agtgtaggcccatatgcacagtgattgccttgtgtctaagctccgtccttgatagcagagcacagcctatatcttggccaagtctgtcataattgattactatccatactggatctcctgttctgttgtcaaagtgaggcccagtgtatttcaacatgcgcttcaggggcgctgactgcctctctctcattgtgtatgccccggatactgtcataagct

SEQ ID NO: 491145 - DNA, 359 bp, Homo sapiens
  misc_feature (11)..(11): n is a, c, g, or t
  misc_feature (44)..(44): n is a, c, g, or t
  misc_feature (72)..(72): n is a, c, g, or t
  misc_feature (95)..(95): n is a, c, g, or t
  misc_feature (105)..(105): n is a, c, g, or t
  misc_feature (144)..(144): n is a, c, g, or t
  misc_feature (149)..(149): n is a, c, g, or t
  misc_feature (190)..(190): n is a, c, g, or t
  misc_feature (273)..(273): n is a, c, g, or t
  misc_feature (335)..(335): n is a, c, g, or t
tacgttctttnaaaaactacggggaatggggtcgtctttgcccnaagtcccgaaaaaacttgttccctgaancccctcagggatggcccccaaantgtccccctnctctggcaccccctttcattggttccatccatcccccanaaaancctgcccaatcgaaacccgtccctgcatcccaggatggtanccagtcccgcccctcgccccccacctccacaggtgccttaaagggccctcgttcacccaaggtgggggcaggggccctcactntccggccctggtgtgggggaaagagtgaggggttgggggatcggcagttgggaggggcgctntgagattaaagagttttacctctg

SEQ ID NO: 491146 - DNA, 810 bp, Homo sapiens
ggcgcccttttttttgtttttccctgaaatgtaaatggttttaatatatttaagagcacacagaagtctgtgatttataaaaaaataaatatataacatgacaaatttacggatgatcctggagctctgaggtcaaactcttataaatgatcagggaaaactataaaacatccatgatctggttaacacacacgggagctattatcccagtggtaaaaaacaaattccttgagggctcagaacgaacaaaaatcagtctttatggggcagaaagcacaatccaaagctaggcaatgaagttcagccggggccacgtgaacctttcaccagccagcctataacctatggagccaggacaggaaagcatgatccttcagctcatgacgccacccaggcttccagacaactgcagaatgaaagagtccctcagaggctccccagccccggctgccatcataaagcagcgggagggatggttggtcctaaggggctctgtcctaaattggagagcaggagactgagaaggttatgctcataaatatggtcatggtaaccgggatcgggaaacttcatgggatcttggccccaggggcactggagctgaagagaaaagaggaccctcacgatgagaattaaccctctaataaaactgaattaacccattcattgcatcgactccccacccatacaaattctccgcatgatgaaacttcgggtcactcctgtggggcgggctgatcctcaattcaccagggattttcctaagcatggcatactcacaagaagcctaaacggcttttaacatccgca

SEQ ID NO: 491147 - DNA, 1019 bp, Homo sapiens
  misc_feature (278)..(278): n is a, c, g, or t
agccagataggttgctcaattgaggagacgtatactatacttcagagcactggtgtcgataactttgtccagggatgcagagatgctgtacgatggactagtacactaataggccctacactctcctgatgaccgacgtgtaaatgttcctctgagtcatggtgcaccaaatttgactggcgtccgatgggtaggacccgtatgtcaaacacctgggagccatgtattcctgaagcgttgacctagtctattaatgcatgcatcatactataccccgnaacatatcgatggtcatagtgcctcaattagctggtcgtagacggtaagtgcaatatcacgcatatatgggcaagtgttactacgagagcaccccttagtgttaaattaatgagtgctgcggaggatctgtgcggggttcgttttgtggggtgaaacttaagatactgttgaaaatattctcctcggagtatgatttgagcaaaaatgcactacataattcacgctcctcagatggtcctcataaagaactctaaattggtatgcaacggacatataaagcaatgggggtgggcctgaggagagaattcatctagtagccatcggggggtaaacgtctgggatgatccgatgggagccacttggaatcatgggggagaacatttttattcttttggaaaaccttttgcaataactgaaacgggccctgtgaaggaccacttccaagggggaagtgttgccatattggcctgggaagtcctatgactaagggtaactttctattttagaaagatgagaatcatcgtccttcgaatctggacttgagtcacgatcgtgggagtcattactctgagggtgcgaccatatgaactagttatggcacaatcctaggcgagaaaagatctccccatacgtgcctgaaaagtcggttgaactttcagcagttattttgtagtaccaagcaaaaagtcgatgttagctggaagaacggttcggggaagctccggtaaaagcgggcaacg

SEQ ID NO: 491148 - DNA, 440 bp, Homo sapiens
cacacagatacatctatgcacacacacatatttaaaatacacaaaaatattagcatataagtcactgggggtaaatttagttcctgttcctaggttcttgtactgactaggaagaggatagaagtactaactcataggctgggcgcggtggctcacgcctgtaatcccaacactttaggatgccgaggtaggcagatctcttaaggtccggagttcaagaccagcctggccaacatggtgaaaccctgtctctactaaaaatacaaaaattagctgggtgtggtggcgcatgcctgtaatcccagctgcttgggaggctgagggatgagaatcgcttgaatctgggaggtggaggttgcagtgagctgaggttacaccactgcactccagcctgggcgacagagcgagactctgtctcgaaaaagaaaaaaaaagaaaag

SEQ ID NO: 491149 - DNA, 1061 bp, Homo sapiens
ggccacgatggttcaacgcagccggcccggaagatccgcagacgtaaggcccggtaatgccaatggcgctgccggcatcgctccgcgccccgctgtcgggtcccatccgtgcctcatcggtgcgctgcctccagcggttcgggtaccatcacgagaggtgcgcgccggacgcggcttcgagcctggatggagctcagggtgtgccggcgattcaacaagaacggtgtgcccggagcatcgtgacatttctgtggatccgaggaggcgtgaacaaggtccacgggagtccctgcaggccaacgtgcagacggctgaaggagtaccgctccaatagctcatcctcttcgcgccaggaagccctcggcccccaagaagggagacagttctgctgaagaactgaacattgggcacccaggtgaccggaccggatcatgcccgtccgggaacgtctataagcaaggcagaaagctcgagtcatcactgaggaagcagcacagaatttcaaagccttcgctagtctccgatatggcccgtgccaacgcccggctcttcggcatacgggcaaacaagagccaaggaagccgcagaacaggatgttgaacaagacaaaataaagccctcctggggacttggaatcagtcaggcagtcatgctgggtctccacgtgagtgtgataacacgttgggaacaactggggcctgggatggggcttcactgctgtgacttctcctggcacgcgactagggagcttcttgacagacagtcaagccctggataaatgctctacctatctgtgttgaaacactgatgcgaggacggataagtactgaatgtacacgggctaccatacagcgcgcacccgtcaccgaccgccgtacctcacaaacgcgcccactagcgaccccactacaaagcagaacagctggacaggatgccacaacataacccaacattagaagagccgccatataacacccacgccaccgtgccaccccacaagcacaacaacgccgaactattctaccacaacacatagcacagcaaacgctcccccctgttca

SEQ ID NO: 491150 - DNA, 927 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgggggcctgtccctgggcccaggagccaatgtgaacttttttttttaccgggattataaaagaacaacaagatgaccttatttcttaactgtttcaaataaatgattaaagtattttcat

SEQ ID NO: 491151 - DNA, 189 bp, Homo sapiens
caagtcagtgctagggcaagcccacgaagatgatccttacatgtagaaaacttagcaattctaaatgcatacacaccaaagaacagagcatcaagatatatgaaacaaaaacggacagagctaaaaggagaagtacacaaagtcacaattacagcgggggacttctgtaacccactatgaacagttgat

SEQ ID NO: 491152 - DNA, 980 bp, Homo sapiens
  misc_feature (877)..(877): n is a, c, g, or t
  misc_feature (882)..(882): n is a, c, g, or t
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgcctggggacngaacngtggagactggtttggctcgggatggccgtccccggtatacttcgggccccggccggaccgttttgtctggtcttcccgagtgtctttttgtgcccca

SEQ ID NO: 491153 - DNA, 946 bp, Homo sapiens
aaaattgctagcgatcagtgctcgttgtatttcgtcacaggagaagtggtcgagaatagctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttctactatttcggggctcgcggcggccggcgacatgttgacaatcatgactcatctccagaagtgtccagtgagggggcacacagccgagagagactcgtggccaattggccgcggcaatcacagggccagaaagggggacccg

SEQ ID NO: 491154 - DNA, 151 bp, Homo sapiens
ctagttttgaatacatgggctcaagccatcctcccgccacagactcccaaagttctgggattacaagtgtgagcctatgtgcccagatattatgatatctacagacattaataatgcagatcctctacctttacagcacatataatattgg

SEQ ID NO: 491155 - DNA, 446 bp, Homo sapiens
ccagggaccggcccagaaatcccgggcaccgacacttactactaaattcgcggccgcgtcgaacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaataccc

SEQ ID NO: 491156 - DNA, 188 bp, Homo sapiens
gggggggggcccctccctgggggagggtttccccatgggcctgccccaggaaaaaaaaaaaaaaggaagcagggggctttttttgttaagaaagggggttggccccccccccttcttttttgttttttaaagcccgggggggggggggaaacccccccccctcctgcaataaaaaagggggatgggca

SEQ ID NO: 491157 - DNA, 588 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccacagagatggagtcttgctgttgttgcccaggctggtcttgaactccttggctcaagcaaacctcccatgatgtgctcccaaggtgcttgggacta

SEQ ID NO: 491158 - DNA, 619 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagcccggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcat

SEQ ID NO: 491159 - DNA, 375 bp, Homo sapiens
tctgctccgtatacttcacaaacaggacagacctatggagaggatcgctgtgtaaccggacgctcgtgcaggctgtgttggaagcaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgaccctgaagggcaagaaacgagtggaaagaactggcattgaccatcaccggggagc

SEQ ID NO: 491160 - DNA, 102 bp, Homo sapiens
ccggctgactgcagctctctctgatctgcagcgtattagctcaacagggcgcgaggtgcgggtcgttgaagaagcgcacttccacagcaggaggatgatcag

SEQ ID NO: 491161 - DNA, 2345 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 491162 - DNA, 1770 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaataccc

SEQ ID NO: 491163 - DNA, 792 bp, Homo sapiens
ggggtaaagatggcggagcgcgggtacagtttttcgctgacatacattcagcccgatctggctaaacttgtccagattgaatatgctttggctgctgtacctggaggagccccgtccgtgggaattaaagctgcgacatggtgtggtgattaggcagactgagaaagataacagaaatccattctgtatgatgagcgaaggtgtacacaacagtagaactcaatttagccagagcatataggtttggtgtacagtggcagtgggccccgatttactagagttgcttgtgctactgaggctcgaaaactaggctcaacaatactatcttgtgtaccaatgaacttccgattccgtactagctcagactggtacagatgagtagcttctgtgatgcaagaatatactcagtccaggtggtgttcgtccatttggagtcttccttaacttaattatgtggtgggaatgagggacgaccatatttattatcagtgagatcactatctggagcttactattgcctgggaatagctacagcaaggggaagagaactatgtgaatgggaagactttccttgagaaaagatataatgaagatctggaacttgaagatgccattcatagcagtcatcttaaccctaaaggaaagctttgaagggcaaatgaccagaggataacatagaagttggaatcgtgaaatgaagctggatttaggaggcttactccaactgaagttaaggattacttgggctgcatagcataacaatgaagtgactgaaaaatcagaatttcgata

SEQ ID NO: 491164 - DNA, 349 bp, Homo sapiens
atggcacaggtatacctatgtaacaaacctgcacgttttgcacatgtatcccagagcttaaagtataatttaaaaagaaagtagaaccttcaaaaaaaaaaaaaaacaacaaaactttggggcaaatttcctgtaagttaaaaaattagatgaaaattggaaaaaaatttatccaaattgagggcccaaagattgggtttcccttttaattagaccaaagagcttttagccaattcacttaagaatgaacacccccagttttaaaattggggcaaacaattatgaaagggcatttcaccacaattgaacttgcagatggctcaccgcattggatggggtcccgagctca

SEQ ID NO: 491165 - DNA, 381 bp, Homo sapiens
tatgcagccataaaaaaggatgagttcatgtcctttgtagggacatggatgaagctggaaaccatcattctgagcaaactatcgcaaggacagagcaccaaacaccatatgtttctcactcataggtgggagttgaacaatgagaacacttggacacaagacggagaacgtcacacactggggcctgtcatgggttggggggatgggggagggatagcattaggagaaatacctaatgtaaatgacgagttaatgagtgcagcaaaacaacatggcacatgtatacatgtgtaacctgcacgttgtgcacatgtaccctagaacttaataataataattaaagattaatcctgggttctacctcccagaggttttgatgca

SEQ ID NO: 491166 - DNA, 1386 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcat

SEQ ID NO: 491167 - DNA, 259 bp, Homo sapiens
ccccctccccgattagggataactttccaggtataaggacgattttgaattccagggacctttgaatattttagaagggttagaaaacttggtattatgcagcacagaaaaagtggtatgactgaggagatagagaacttaccacaaagggtctggaatgccatgatacatagtttggattttcttctgtggggagcatggggttagtgaagtattttaaaagcaacatgactcttggcaggaagattcaatgtgaggc

SEQ ID NO: 491168 - DNA, 442 bp, Homo sapiens
  misc_feature (17)..(17): n is a, c, g, or t
  misc_feature (85)..(85): n is a, c, g, or t
  misc_feature (98)..(98): n is a, c, g, or t
  misc_feature (123)..(123): n is a, c, g, or t
  misc_feature (134)..(134): n is a, c, g, or t
  misc_feature (140)..(140): n is a, c, g, or t
  misc_feature (155)..(155): n is a, c, g, or t
  misc_feature (165)..(165): n is a, c, g, or t
  misc_feature (178)..(178): n is a, c, g, or t
  misc_feature (183)..(183): n is a, c, g, or t
  misc_feature (206)..(206): n is a, c, g, or t
  misc_feature (217)..(217): n is a, c, g, or t
  misc_feature (235)..(235): n is a, c, g, or t
  misc_feature (292)..(292): n is a, c, g, or t
  misc_feature (363)..(363): n is a, c, g, or t
  misc_feature (378)..(379): n is a, c, g, or t
  misc_feature (426)..(426): n is a, c, g, or t
gaaacaaaagagaaagnagagagaaaaacaaaaaaaaaaaaccaagttgtacgtcctgagggcttacaacttattttctccaacnccttactttttcnaaagggctttgggggtttcaattgncaaaagcagancaagtngcatgtttagccagngaagtcttanttgcttaaccccngttancctccgccgttttaaagtgtctntttcctttttnattgttttgtccaggggnagaaaaggtgggggtggtttcctcctcctttggaaggggacctccccctggggctanacccaccttcccgtcccggttttaagaatcccagttacatagttattttttacctttttttttcctccccngttcctgcttgggcnntgggcccctcctgtttgcggcgttaattacgtgtggttcggtttccnggcccatggttggggg

SEQ ID NO: 491169 - DNA, 354 bp, Homo sapiens
ggtcactctagaggactcgcatacacagtctcaaactccttctcctgatggtcatcttagatcctgttagactgcgttctggcttgctagctgctgcggcatgaaggcctcagaggctccaaaaaattcctagtatgactagagacatgaaaaactagtccctcagtgggcttggtaggtcctctacatatttgggtcaatgcagaaccaaaacagcagctttctggtgaagcacgaattctaaatcttgtctattcaatattatcggatccattttgagagaagaaaagcaccagagactgcttggaaagggacagcttcatttccaaatgagtcttcttttctttccacaga

SEQ ID NO: 491170 - DNA, 153 bp, Homo sapiens
ttatctcggtatacctctccataagacaaagtgttgctctggatccccaagttatctcactcagagtaaaagccagaatgcctatagtgaacctccctccaataccctacaggacacagtgcctctctatgacctcggcttcttggccttcct

SEQ ID NO: 491171 - DNA, 335 bp, Homo sapiens
tcttacttgccggtgtctataacaaaaaaagtgagactttagaaccatggaccagaatcgagaacctaaataaaaccttagtgtatgtggataaatgatatctgacaaggggtgccaagaccatttaatgggggaaaagacagtctttacatcaaatattgctgggaaaacaggatgtccctatgcaaaagtatgaagttagactcttaccttacaccatatacaaaaatcaactcaaaatgtatcaaagatctatacacaggcctaaaactataattcactaggagaaaacgtaggagaaaatgtagcattgaatttggcaccgatttcacagg

SEQ ID NO: 491172 - DNA, 612 bp, Homo sapiens
cccagaaggtggagtgttgtcactgcattccagcctgggcaacggaacaagactctgtctaaaaaaaaaaaaaaaaaaaaaaaaattagccaggcgtggtggcacacctactcaaaaggctgaggtgggagaatcgcttgagcccaggagttcaaggctatgatcaattcattgcaccccagcctgggtgacagagtgagatcttgtctcaaaaaaaaaaaaaaagtatgaatttcagtgggccatggcatacctaaaacattattatgagagtttctgtaaggatgttttaagggtagctttttttttttttttttttgagacagggtctcgcttcgtcacccaggctggagtacagtgacaccatcttggctcactgcaactgccgcctcctgggttcaagccattctcctgtctcagcctcccaagtagctgggattacaagcgttcgccaccatgcctggctaatttttgtattattagtagagacggggtttcaccatgttggccaggctggtctcaaactcctgacctcaaataatccacccacctttgccttccaaaatgctgggataccggcttaattcaccggacccaaccttttaaggtgtt

SEQ ID NO: 491173 - DNA, 232 bp, Homo sapiens
  misc_feature (221)..(221): n is a, c, g, or t
cgcacctgaagatgccagacattggaggtgtctgcgtaggcagatgctcctccctggaccattgctagtcatccttcaaatgaccactccattaatataacatttcatccagtaaactggcctctactatctttaactcatgcatggccactgaaccatttctctatgtagcctgcgatttatctattctctctgtcctgcccacccctcttttttgtatnagcccaacgaa

SEQ ID NO: 491174 - DNA, 315 bp, Homo sapiens
ttagcatctccccttaccgagtccagtatcaagaaggtaccaggttcggggtagttttcctggataaaacgtcctggagacatttgagtcccactattccaggtccctggccttactcaaaggtgagagcaaaatgactgaggttttgagctggaggtgacatgaagctgctttgaggcaaagatgataaagccacggtcaacccacgagccacggtcaacccacaagccacggtcaatccacaagccacggtcaacccatatgccccggtcaacccacaagccacggtcaacccacaagccccggtcaacccac

SEQ ID NO: 491175 - DNA, 192 bp, Homo sapiens
agtcaatatccgagtactggtgctcccatgttctcagtagtgtactcccatttcagagtactgggaatggggagcacagtactggtgaacatgggagctcacagtacgtgaggaaatgggagctcacagtgactgggaaaatgggagcactagtgcgtcgtgccaggggtaccagagcatcgaattctgtaa

SEQ ID NO: 491176 - DNA, 124 bp, Homo sapiens
  misc_feature (1)..(1): n is a, c, g, or t
ntaggcaggaactgtgggaggcagttactgtgatcttaacctgtatcctgagactccagatgcagctacctgtggtggatgaatggtcagagctccctatactcacagcttgagctgtctgaaa

SEQ ID NO: 491177 - DNA, 1370 bp, Homo sapiens
gtgctggtggcatgttgcctgcctgatgtgcagctaatggtcaaatgagagttcatatttggttatttgccattaaacaaagacttcccagccatgtgctgctggtgtgctcactgcctgtaaatcccatgcacttatgggatgtgcctgactgctggcatgatcacccatcagtgtcaagtggtgttcagagatcatgcctgtgccaatcactgtgcgaacaaccccctatcccttactaaaaactacaacaacattagcttgggtcgtggcggccggcgccgccttgtaaactctccatgactaccctacaggtgcatcggcttgacgtgtaactgacgacctcaacattttaacaccccacgggacgggcacgaagtgtctggccaagatggacggcttggatcgcactcacttgccctgcttggccattatgccacaatggcacattgtgatgcccacacctccgacgatggcccgacaacacgtacgttgattcttcccacctataccacacacactgaatacaaacctcacacacaggattacacctccttctgcactgcactcactcaccttctccacacagcaatggtccccaggaacagttggctggggtaacttcgactattttacacaacggtgtgactctctggaacaacccacgtccaacagacacctaagtgttcccgcccaacttctggttccacatcctacggctacttaccgcttggtttggccacagcttcctctccatcgaacggctttggacaccccattatactgtcacatgtcagacccttttgtgcatagcttgagccatttctcaacttcctcctctacctcttttcacccaccccgctcacccgcaactccctccgccctgtgctcatcctccgaataactctccacccccccccgtctcccacgattggtagcactaatggcatccaacccctgtctgcaacggaacttaacagcaacggtcaacacgttcacacccacgccttaatcaataccttgcttattgcagttggcctcgaccactcctcccccaacacacacgaatcgacctgaaacctgcgccggtctcgaacactggcacactacgccacaaccggcgctcacctgagcttgccatcagacccaccacccaccacctgcgcaaaacatcccgcgccaccaccggcccccaacccgactagcaccagaccaccacacacacacgcccccgaccaacctcccaacaccacagcaccagaacaccatacatcccacaccgcacaaccacccgaccaccaccacgcacccacgaccacaaccccccccaacaccccatcccccgtcccgcatcccccgccgccacgccc

SEQ ID NO: 491178 - DNA, 161 bp, Homo sapiens
tcataatgaatagtcctataactattaaagacattgaatatcatagtattaaaaactagccaaaaatgaaatatactatggaccagatagtattcacctagacgaatactaaccacgtattactaaaacgaatttatacacaatacctgtaacaatactcc

SEQ ID NO: 491179 - DNA, 342 bp, Homo sapiens
acccctccataaagagtgcccagggagcacacgaggaaagacatttggagaatattaaatgctctgccgggcatggtagttcacagccttgcagacccagcggcactttgggagcccaaggcaagaggatcgcttgaggacgggagttcgagaccagcctgggcaacatagtgagactccgcctctataaaaaatcttaaaattagctgggtatggtggtgtgcacctgtggtctcagctactcaggaagctgagatgggaggatcgcctgagcctgtggggtggaggctgcagtagctgtgatggtgccactgcactccagcctgggcacacattatggag

SEQ ID NO: 491180 - DNA, 231 bp, Homo sapiens
  misc_feature (8)..(8): n is a, c, g, or t
  misc_feature (36)..(37): n is a, c, g, or t
  misc_feature (41)..(41): n is a, c, g, or t
  misc_feature (56)..(56): n is a, c, g, or t
  misc_feature (66)..(66): n is a, c, g, or t
  misc_feature (93)..(93): n is a, c, g, or t
  misc_feature (100)..(100): n is a, c, g, or t
  misc_feature (106)..(106): n is a, c, g, or t
  misc_feature (124)..(124): n is a, c, g, or t
  misc_feature (126)..(126): n is a, c, g, or t
  misc_feature (150)..(150): n is a, c, g, or t
  misc_feature (177)..(177): n is a, c, g, or t
  misc_feature (194)..(194): n is a, c, g, or t
  misc_feature (197)..(197): n is a, c, g, or t
  misc_feature (205)..(205): n is a, c, g, or t
gggtgcangtatagcaggtgggtcagggaacagcannggtncagtctacttcaggntgtcaagggnactctcaagcccgttaacccataaatntcaggcncggtcntagcgttaccctggcagntnactgccccagtctcctggtcaagntgcatgcttactctgaaggccgggggnggaaaatgattaaagtnagngagacggnagcctttcctttgatcagggaatatt

SEQ ID NO: 491181 - DNA, 109 bp, Homo sapiens
gcactggtccgtcatgcgacaacgtagatactgggaaatatctcaggaaggatatggtcacgaagagctctttgtctccatccacggggccagaacgtgctacagcccg

SEQ ID NO: 491182 - DNA, 320 bp, Homo sapiens
tatcaggcgcacttctgtaggctgaggctggaggattgcttgagcccaggaattggagaccaacctgggcaacatagggaaaccctctctctgccaaaaaattaaaaaacaaaacaaaacctaggtgttatggtgtactcctgtggtcccagctgcttgggagctgaggtggagggattgcttgggcccgggaggtcgaggctgcattgagccacgattgtgctgcagcgctctagcctgggtgacagagtgagagcacgtctcaaaaaaaacaataaaaaataaataaaatgacatctttggagaagtgcgcctgggtg

SEQ ID NO: 491183 - DNA, 476 bp, Homo sapiens
ggactcactgtcaacaacatcccatcctgaagacttgcttaccacaactgagagtggggagtcagttcgaggcctagcatcacttaaacttcctccaaaggcacaaaagccagcacgagaaaaatgaagacgggacatatcgacacactagtcaccatgctgctggcaaccatgatacatagtggacatttaccagcgtgacggctgaagtgttagacatggcagcactaatgcatttgactgatgaatacctgaaactgtacggacaggatggcaaattcacactacgttcacccaacctgctaacaggagcgaaaaagcaagcccaccagccactcagatacctgtgtgggaaaatgcaaaagccacactgggcagcctgaaagactcaaatcattactccctatgaacttctaaggataaacatggactagccctgactggcctatatccccgaaccccaagagcaaactccc

SEQ ID NO: 491184 - DNA, 265 bp, Homo sapiens
tggattgatctagaggatccctgtcttgatgtactgcgccaggttagagtgcaatggcgcggtctcggctcactgcaacttccaccacccaggttcaagcaattcggcctcagcctcctgaatagctgggactacaggcgcgtgcattacacccagctaatttttgtattttttttttttttttttggaaacagagttttgctctttcacccaggtcggactgccagggggctatctcgggtcattggaaagctcggtctccggg

SEQ ID NO: 491185 - DNA, 129 bp, Homo sapiens
  misc_feature (107)..(107): n is a, c, g, or t
agaggatcatcctaacagaatggactatgcccctagttacatgtgaatgtgggagttacttaggagtctgaaccaaatacattaaggatggtgttaccgaggctcgnaattctgtaatcgtggatcata

SEQ ID NO: 491186 - DNA, 919 bp, Homo sapiens
  misc_feature (2)..(2): n is a, c, g, or t
  misc_feature (65)..(65): n is a, c, g, or t
  misc_feature (81)..(81): n is a, c, g, or t
  misc_feature (84)..(84): n is a, c, g, or t
  misc_feature (100)..(100): n is a, c, g, or t
  misc_feature (121)..(121): n is a, c, g, or t
  misc_feature (142)..(142): n is a, c, g, or t
  misc_feature (150)..(150): n is a, c, g, or t
  misc_feature (161)..(161): n is a, c, g, or t
  misc_feature (213)..(213): n is a, c, g, or t
  misc_feature (216)..(216): n is a, c, g, or t
  misc_feature (242)..(242): n is a, c, g, or t
  misc_feature (263)..(263): n is a, c, g, or t
  misc_feature (291)..(291): n is a, c, g, or t
  misc_feature (314)..(314): n is a, c, g, or t
  misc_feature (316)..(317): n is a, c, g, or t
  misc_feature (323)..(323): n is a, c, g, or t
  misc_feature (334)..(335): n is a, c, g, or t
  misc_feature (341)..(341): n is a, c, g, or t
  misc_feature (353)..(353): n is a, c, g, or t
  misc_feature (368)..(368): n is a, c, g, or t
  misc_feature (395)..(395): n is a, c, g, or t
  misc_feature (397)..(397): n is a, c, g, or t
  misc_feature (399)..(399): n is a, c, g, or t
  misc_feature (472)..(472): n is a, c, g, or t
  misc_feature (474)..(474): n is a, c, g, or t
  misc_feature (543)..(543): n is a, c, g, or t
  misc_feature (786)..(786): n is a, c, g, or t
  misc_feature (832)..(832): n is a, c, g, or t
  misc_feature (853)..(853): n is a, c, g, or t
  misc_feature (916)..(916): n is a, c, g, or t
tnttatggatgggaactggaactgagaacccagcaggtacttctaggaagactcagcagtcagtngtgacggtggctgacnccncctggctgccccacgngctgcaggccttgcacaagangtgcccatccagcgggtagcngccctganactcgccctcngaggagagcagcagcccacactcctcgcacttgtaacagccaatgtgaaaanttngatccagagcaacaattctcacagtntcctcctgacctggctcaggnattatggccccaccgcacactgagcatnttggggcaaacttcctgtgaaantnntcaatntagtggatttnnttcgtngcatccactgtnttggggatgctgttnaggtcgcggtgacacaccacgcaggtnangntgccagggtggtaggccttccccatagcccgcagatccggtccaggatgggctgggagcacgtggcacatttntncagggtggccacgtagcagccctcgcaatatgccctcctctccacggcgtagaaatgctggccgcgaantgggcccggcatgtagaacacacaaagcagcccacgtgaaagacgcgatcaagggccacaaccccagctccatccccaaccacatcttctccgcagccaccacactggccaaagtactccccgctgggcgggtgggttcatgtcgtgaaccagcttcttcgtcagcctatccagctcatcctctggaggctggctcaggggcactggggcccgtgctcgcctcctcttcctcttcctgcaggncagagacccagcagcttctctttggccctggcctggctctctctgntctatagcaggccccagactnactcggctgggagaggaagtggggccgggagggccagaggctgagaggtccccgctgggtggncga

SEQ ID NO: 491187 - DNA, 333 bp, Homo sapiens
actgtctataaagcatccgccagccagctaatcatgcatcagaccaataccatcccgagtcacctgggccgcaccctaggtctctatggtaaggaccagcaggaggcccccctgcaggacatggagaatgacggcgagcaggacctccgctgcaaatacatctccctcatctacaccaactatgaggcgcacaaggatgactatgtgaaggcactgcccgtactactgaagccttttgagaccctgcgtgcccagaaccagtgaggcaagaccttcattgtgggagaccagatctccttcgctgactacaacctgctggacttgctgctgacc

SEQ ID NO: 491188 - DNA, 1819 bp, Homo sapiens
  misc_feature (112)..(112): n is a, c, g, or t
  misc_feature (375)..(375): n is a, c, g, or t
  misc_feature (835)..(835): n is a, c, g, or t
tttgtatttgttactgggtaccggtgactaaaatggaagcgttttgggggtcgcggtccggacttggtgagtcgggtggagtccggtccccagtgaacaagttttataccgncgatttccggtccaactctcccggattccttctcagtgggactccgggcgttctgtggcactttatacaaaagggctcacaaatcacgcgcggtacccagaaatccccatgggtgtgacgcgggaaccgtcgaggtccgtcggagtgtattaagttttcaagaggggcgggaagtgtgggtagaatgtgccggacagacacgatgtggcgtggagatctcgcatagcgggctctcctgtgtggctctgcgattactccgcganaacattcttctctcgcacattatatgtggcagagtctcagaacaaacgagtatacccatgtgcgcgtgggtgtgccctctctgtgggcagattatagcgccggtgatatttctcacagggagtattgtgggaaacgacatagggttgtctctccgggtcacacataggtggcgttgcatatgtgagtgtagagagagaagcctctctctgtggggcaaaacatggtgggaccacaacgaggggctataactatgggctcgctataagagagaccccatatattatctatctgctacaatgtgaggcgctgtggcacgccgaggggggcgcacgatgtgtcatcagacaaagtgctgctgtgagcgcgctctcgataaagagattatgtagaaaaacccccttatgtgttgtgtggaggaacagcgcacgcgaggtgggtctccccatctgcaggagggancgggggctattaaggtggtcctagtgagcattgttgcgggagagtgacgagtacggctttttctccactactgcggggctattcatgtggcgtgcgggcagccatgttgtccttggtggcgcagttgtatataaaaggccctcataatgatggaacaggggcccccccgctattttccagcgccgtggggggcccaacgctggggagggtacataagagcgcggcggaggagcgatataaaccctgaggggggacacttacatagggaccgcctttctgttggggtggtcggcgaaaagaaagacggtttctcctggtgggaggaaagtaaaaaggccgacggccccccagggtggtgggctataaaagcgctacgaagataaaccgctgggatggggtgcccccctgggggagaaccacttatttagggtattagggaaacacggccgtgagacattgtgggcgcgcaaaggtgtggccggtaggttcaccactaaccgcgggaaagaaagagtcgcccccagaggtcctttataaaaaaacgcgggagggttctgaccaaacaccccggcgtccaagtgtggtatccaccgcccgtgaaagaaaagaggggtgtgttttcgtggcaacacttacgcaagggcgggaccccacatggtggtctcatcacaagggagaggataccccccagtggtggggaaaatttatgttggtgggccccccaaacgtttgtaatcaccacggcggggggactttatggaaaagtgtgaaataatatcaccggacgagactgggccattgtaatatcccgcaggaaaacattgtgaaacgtttgtggccccacatcatttttaacaaccttgtggagaacccattgggggcttatactctctacacagacagaaattagcaaacctctttctcatttgggcgtgagacaggagacaacaataagttctccatcagacgtgtggtttacaaaaa

SEQ ID NO: 491189 - DNA, 556 bp, Homo sapiens
cccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtgg

SEQ ID NO: 491190 - DNA, 158 bp, Homo sapiens
gttttagctgtgttaggagagcagaagagaagacggggactgtacttcaatatttcgatcatttttagaaataggaattcttgagtctcttttctttcttcagtcttttccatatctggttcttttctttttcactgtgatttctgtgcccatttcaa

SEQ ID NO: 491191 - DNA, 604 bp, Homo sapiens
tgttagccattgttacacagattagaacttctaggcctatgccattgtgtgttgcctttcttttttttattgaactgttaactctgtgtgttgtagtagttcatgcgtgtttacttctttgcaggctgaacataacttctttattttcaaagttccctgtgttgtgaactgatctggggtgacgtgaaatctttgaggtaaggcaagctctaatgataaaatatggaaagaaagcctgttgaaacttggggacgcctttcagagataacacttttagagtcactgcctataatttttgaaatgccgccatttgtgtgttagggaggggactgtggagcataaattggagcaaccgggagcagcacatcgtgcgcttgacgtgctaaggtagtgtccatctcatagctggctcacccataatagcaattttatatgctgtgcactcactagtctgtggattgtatcaacagctttaaaggaggaaacatggagacatgaagagacttcatttctgtggtttttcccttacatgtttgagtgttgtccctggttaggccctagttcttttccattattatcactaaagttggctttggtcctgttg

SEQ ID NO: 491192 - DNA, 231 bp, Homo sapiens
ccttctacgtctcatgcatgtggatttcatgctccccctgccctccacttacagtgatgctacagcctaacatgtaacggctgtggtgagaaacattactgtttctagccatatcctctgcaagtaatccaaagagaaatgctgccacactgtctctctggtcaaagaaaggaaaggtgattcctagtacacacacatgtcacaagtatttcagtgatgagacgtagaagg

SEQ ID NO: 491193 - DNA, 294 bp, Homo sapiens
  misc_feature (3)..(3): n is a, c, g, or t
  misc_feature (156)..(156): n is a, c, g, or t
  misc_feature (166)..(166): n is a, c, g, or t
  misc_feature (255)..(256): n is a, c, g, or t
tcngcacactggtctcacatatcagcaggtgctcaataaaagtccgttccctcgcttgtgtatggcattctaatgaagacttacaacaatagtttttcgaataatatgtcacctgttttcgaataacatatcaccaaggtaaggcagatggccagngaaagtttanggcctccaatgttaatttgactcatcatactacaatatgccgaggctcagcacgccttaatccagtcgattgagctcttggtctgtacnnacttcgcttcatatctaggcaatacacctgacgtgctg

SEQ ID NO: 491194 - DNA, 422 bp, Homo sapiens
cccccgggaaagggtgaaacccctccctaattgaaacccctttccccagaaatattttcaaatttacctttgccccctgaccccatccagaggaatcacctatcctatggcaactatagcccatacaaaatgtatttccttaataagacttgaaagtcagaattattccttgatccatggagtaattctgcatggagctgcagaatagatgttaacaggcataaaaacattaatctccttgtacatctccaccagagctcttgggtgaccaggagccttgtcaataagcagtaacgttttgaaagaaattttttgagcaggtctcaacagtgggcctaaaatattcagcaaaccatgctgtacacagatatactatcatactgactttgttgttccatttacagagcacagagtagacttag

SEQ ID NO: 491195 - DNA, 188 bp, Homo sapiens
  misc_feature (13)..(13): n is a, c, g, or t
  misc_feature (27)..(27): n is a, c, g, or t
  misc_feature (133)..(133): n is a, c, g, or t
tatcatggattgnaaaaaaaaatactntgtatggatttttgtattctgtaagtattgttttgtgtgtgtgtgtgtgtgtgtgtgttggaactcctggggcatgttatattttgaagtgattaaactatttaantgtgtgtctatattttggagtggaataattcttcataaaaatgttttaaaacact

SEQ ID NO: 491196 - DNA, 106 bp, Homo sapiens
ttggatggcactcggtgactggcggtccctagcaatagcagctgctgtggggaagaagggctgcccagccagctggttctccctgtggacaccatgcatgatccac

SEQ ID NO: 491197 - DNA, 717 bp, Homo sapiens
  misc_feature (18)..(18): n is a, c, g, or t
  misc_feature (159)..(159): n is a, c, g, or t
  misc_feature (163)..(163): n is a, c, g, or t
  misc_feature (166)..(166): n is a, c, g, or t
  misc_feature (168)..(168): n is a, c, g, or t
  misc_feature (174)..(174): n is a, c, g, or t
  misc_feature (184)..(184): n is a, c, g, or t
  misc_feature (210)..(210): n is a, c, g, or t
  misc_feature (239)..(239): n is a, c, g, or t
  misc_feature (247)..(248): n is a, c, g, or t
  misc_feature (254)..(254): n is a, c, g, or t
  misc_feature (261)..(261): n is a, c, g, or t
  misc_feature (266)..(266): n is a, c, g, or t
  misc_feature (273)..(273): n is a, c, g, or t
  misc_feature (278)..(279): n is a, c, g, or t
  misc_feature (291)..(291): n is a, c, g, or t
  misc_feature (321)..(321): n is a, c, g, or t
  misc_feature (356)..(356): n is a, c, g, or t
  misc_feature (400)..(400): n is a, c, g, or t
  misc_feature (423)..(424): n is a, c, g, or t
  misc_feature (433)..(433): n is a, c, g, or t
  misc_feature (441)..(442): n is a, c, g, or t
  misc_feature (447)..(447): n is a, c, g, or t
  misc_feature (498)..(498): n is a, c, g, or t
  misc_feature (513)..(513): n is a, c, g, or t
  misc_feature (525)..(527): n is a, c, g, or t
  misc_feature (537)..(537): n is a, c, g, or t
  misc_feature (546)..(546): n is a, c, g, or t
  misc_feature (550)..(550): n is a, c, g, or t
  misc_feature (572)..(572): n is a, c, g, or t
  misc_feature (578)..(578): n is a, c, g, or t
  misc_feature (593)..(593): n is a, c, g, or t
  misc_feature (620)..(620): n is a, c, g, or t
  misc_feature (677)..(677): n is a, c, g, or t
ggtactgaattttgtcanctgtgtgctctacaaacccccagcaattctaatctcgggtccatatctctcagcataacgctcatggatgttgtctttatgtcatgtgctacgcctcttgtgttctttggtgttttctttcatgggggggtgatcacattntttnaancngggaanaaaaccagtngagcttccagctcaggtctgtgtatnttggggcgagggaagaccccactggctcntgtgattnngggtanggttggnttggnttgtttnttttnngctttgtgggtntggtggaaaaaagatttagcaaatgggcgntccatttcatagatgagaatctcttcataattganggctccagctcctaatttgggtggggcctggctggtctgcctgngtcaggtgaggattcggccacanngttttttancaatctgnnaaatnatcgctcttaattttgaagccagataaaatttttggggagagtggtaaaangagggggaagccccngacagatggtannntgctggcgtntgagtggtntaangtatttcggctgggttttcagnggtggnggctaatttggcccngttctgtagtggggcacttaccttgtncaagctgagggtcgtagaaaaggctagaaagaggggcttggagacgatgaattttgnctcctgattttattattcaatttctttttttcatttaaag

SEQ ID NO: 491198 - DNA, 1157 bp, Homo sapiens
catttaccatctcacttctaggaatactagtatatcgctcacacctacatatcctccctactatgcctagaaggaataatactatcgctgttcattatagctactcgtcagtaacccgtcaacgacccactccctcttagccaatattgtgcctattgccatactagtctttgccgcctgcgaagcagcggtaggcctagccctactagctctcaatctccaagcacagtatggcctagactacgtacataaccttaacaccctacgtccaatgctaacaactacatcgtcccaaccacattatactcactaccagctgacactgactctccaaaacaacacatacattcgaatcaacacaaccacccacagcctaatctattagcactcatccccctactatctctttcaaccaacatcaacacacacacctactctaacctgtcccaccacccttttcctccgatccccctacacaagcccccctcctactacttaactacctgactcctagccctcatcacatcatggccaagcaacgccacctgtcatccagctgcacaccgactatcaacgaagacacgacgtctagcctcctctactactaactctgcccgtagcgacaatgcatccttacgttcatcccatcaccagccacggaccgctcgctcctccttcatatctccctgcgagacgcacgactacaatccccaaacttgggctatccagtcaccacgatgactgtcatccgcctagtaacggcctaaatcgcggcgcattactttactcttcatacaccacctagatagctccccctccccttatctcatgtactacttaaactcctcgcgccgctcaggcccgctaaagatgtctacactccagcactagcgtgtccagacgattcagcctccgagacacgacgtttacatcacccagcctccacgatgccataccgcccaacgaacgaataagagcaccacgaatgactccccaagccagccaaaccacccccagccacaacgccaacacgccagcccaacaacagcccgcgcccccccccccacgccatcgcctccatacgcaccctcccaaaaacacggaaaactaccagcgacacgacacccgcatcgcaccccaacagccacccagacaca

SEQ ID NO: 491199 - DNA, 186 bp, Homo sapiens
cgcgatcctcggctggtggtgccccgttgctactcccactgtgaatcgctggtgctcatctattgtctctcacgagtgtatcgtattctccgaaggaagacaatagttccctctttcagattctgaaggtgctgccattattttgccacccactttgcccgagactttcgcatgttcggcatcatc

SEQ ID NO: 491200 - DNA, 411 bp, Homo sapiens
  misc_feature (37)..(37): n is a, c, g, or t
  misc_feature (231)..(231): n is a, c, g, or t
  misc_feature (233)..(233): n is a, c, g, or t
  misc_feature (377)..(377): n is a, c, g, or t
tcctttttgtttacttgttgggttgttgtggtttaantttctttgttttgccccccaaaggggttttgttgcaggacttaccacatctgtgtgaagggttgcctgctctttccacactgtttttttagtttgtttaaactaaatactgggccatcctttgcttacggaaggccactaactagctatcgccacaaaacaacatgtggccgggaacagcagtaggcagcagcnanctggggctaaagtacttcccagcaagttgttcctaattctcagtttcctcctgcctcctcagctcttttcaccctctaaaactgatgctccaactggatcacaagaaagggagagaaacagcaagggtgaagacagagcgagtntagggttgcatttctaaacattttctcagactct

SEQ ID NO: 491201 - DNA, 162 bp, Homo sapiens
gaacatataccccctttctaccactgaccccaaacatgactcattttgtgtgctatacattcttatcttttattaatataacaactacacaagaacagggatggagaggggcaagggtaataagctgcaggggcgcagtcccaggaggccggggatcctctc

SEQ ID NO: 491202 - DNA, 600 bp, Homo sapiens
ccatggatatcgagggtatcggttcggttgtgacttctttgacatcgagcgttaccgtgccggcggcttcacaagtggagccgcgcaagcagatcagcaccgaatgctatgtgccgaccactaacacaaaggtcatgctttggggagactcccacgcccagcaatactattacggcctgagcaagacgctcccgccctccgtatccatattgcaggtggcaagctctggctgtgaggcgaacttgccggggaccgctacagggggcttgaagtactgcgaccgctccaatgagttcgcctttgaggtgatggcaaaggaaaagccacaggtacttgtaattgcccaacttgaacagcatgacacaaagaataatttgatcgaccttacagcaagggccaaggcgcttggggtcaaaaatgtaattgtggttggtccagtgccgcgctatgaccagttcctgaatcagttggttgtgcgcaagttttggaacaacacgccgcgccggactaaagaaaatctgctgcctgcatccttcgacaccgacagggcgctggcctcccaagtacgctggtggtgctggtgggttagatatctgtcgg

SEQ ID NO: 491203 - DNA, 190 bp, Homo sapiens
  misc_feature (190)..(190): n is a, c, g, or t
agatataggagaattggctgtcctcaaatcccaagtaattttctactctcccttaggcactatgtcgtccgaggccccgagatgcccccttatgaaggtggctcttctcatggaaaactactttttcccagagactatcctttcaaacctcccaatatctatataatcactcccaacggaaggattacan

SEQ ID NO: 491204 - DNA, 702 bp, Homo sapiens
  misc_feature (682)..(682): n is a, c, g, or t
tggaaaggagtctcgctctgtcgcccaggcttgagtgcgtggcgcgatctcggctcactgcaagctctgtctccgtgggttcatgccattctcctgttcagcctcccgagtagtcccaggagtagctgggactacaggtgcccaccaccacacccagctaattttttggtatttttagtagagatggggtttcaccatgttatccaggatggttttgatctcctgacctcgtgatccgcccgccttggcctcccaaaagtgctgggattataggcgtgagccaccgcccgggcaaattttggtattttagtagagatggggtttcaccgtgtgggccaggatggtctcaatctgaccttgtgatctgcccacctcggctcccagggtgctaggattacgggcgtgagccaccactcctagccttaatgcatattcttaaatatcaagggtgcatttgttctgacaatggcttgggggctctaataacctaccttttaagattgagaaatggggggcttaagggagttcagttatgaatcaaagattgacccttcaaatgtgggctgggatttctgctatttcataagagtgggatccttctgagaatcctggatcgggacattggacaccaagccattcagcgtgtgaaccttattcttgtactttcctccttggcggaatntatggccggttaaaagggtg

SEQ ID NO: 491205 - DNA, 738 bp, Homo sapiens
  misc_feature (477)..(477): n is a, c, g, or t
gcttattagtcagcagttgtggtcaactctgtatataagaatcattaaccacacatgtgggtgatgggaagacgatttcagctgacagagttaatggcaaccaataatggtggccggtagctgctgaagagcttcacgcaggttcggccgtgggctttgcactgtaggatgaatttgagagtgtcctattgaggtggggcggctattctaaaagatttccttgtcgtatcacgtggttaagggggggggtaaagtgaaggttcgagggatgtacgtaggtaatgtatggccatccaatagtgtctcattggttacatagtggttattgtgaaggaagaatgagaagcacgaaaaggctggcgtcctggaacactccccagggaagacgaatctccagccatgtagtccttacgtgaagcacaactgttcatcagcgagaaggcaggagactgctcatgaggactagagcacaaaggntgcatttcccagtgaacttctggagtcgagaacatgagagtctcttagccttcagaaagtttgaacgtccaagcagcaggaaaaggccctatcgtatctccaaggcgcttgaaacggggggctgagaacgataggacggcgctacgcgggagctcaacgcgctgaaccgcggggcctcatctggtgcaacttacaccccaattggggaagaagaggaacaacagggggaaacatccctggggtaaggggggaccattgaga

SEQ ID NO: 491206 - DNA, 126 bp, Homo sapiens
agcatatatctgcagccgttgtatcacactgcggtgtgctcctgtaaagttccgtcgacacgtgagcacgtgcgtgacctccaaatatcgttaagctggagctggtcgaactagagaatcctccag

SEQ ID NO: 491207 - DNA, 378 bp, Homo sapiens
gagagacctgatctccaggctctcatggcaaattttgcgtgaactgtgtctatggttgatggaactgtggggctccccaggtagacccctgttttcagtgactgcctgacctattgcatgcagtctaatggcagcgttcgccttttcagatatcttctacctcctgtatgttctactgtactcatgtaagtcatggccttcctcactgagcagatcactgtattccctgggatgtctatcaacagttttaacgatctgatctgcataaatgatactgtggatcgaaattctgcttgcatatgaacctggccgtatccatagtctcaagaggcaatgatttgtgagataatatggcatgcccggagccctgctcatttg

SEQ ID NO: 491208 - DNA, 700 bp, Homo sapiens
ataacaagtttgcaaaaccagggcttggccgtcccgaatcccggaattcgtaccaggccccgcggggtttttggggggtgggtaatggtatttaaaaggaaaagcccttaaaaaaaaaaatggtttcctaataaatttgctttttttccctgccccttaaggaaatttgcccaagtggaaaaaccaattttttgtttcaatctaaaaaccccttcacgcccttaggattcacctggttcttcctggttttcccggcccggggcaagggaatttttggttgttttgggtgttttcttaaaaaacaagttaaaacccccccatttctgcaggccgtgtaagcaagtttacccgttggcctgccttgggggtctgttaaaagaaagtcaaatgtaaaagctaaaataaatcgcccgtgtctcaaaactgaaaaaccgcaggggctttatgctctaaaacagggtaggatttaaaaaaaaaagatttttaatcccggaaattgtgattgtgacccccgagtggaggaaccttccgttctaaaactgaaaaaggggggagcccaaaaaggacttttttttttgtaacccccgtcttgatggccaaaaaattatgggaaaaaaccagtttcgggtttattattccctaaaaactctgtgttatattcccctgggacccccaataaaaccaaaagtgggtgtttcca

SEQ ID NO: 491209 - DNA, 788 bp, Homo sapiens
gcaagaaacaaattttccttctggtaagggctcaagtgcgaaggccaatcctatggtacaaattgcccccaaaaacgatgttgatgtccaaattgacaggaggtcctacctgcctcaagacatagctggtggagttgagttctataatggagttcgtaaaataagggttccagcccctgggaaagcggttggttctcatagcccagcatattatgccagaagtccggggagccttgtttggtgcaaatgccaacaggaagtttttggactaagccttcaggaggtggagctcgtgggcagtctccccgcggccatgggaagcttttaatattttaaaacaccccaattgtctcagaaccttcctcttcacggccccagtattgctttgtatttataagcgatgcccctctgtcactcatgccgtgcctaattgttcccaatgggggaaggcttcatgtaatatgatcaggacccacctccagttcttctgaaagtgtgacagtgtccagccggttctgcagcagtagggaagggggcatatggtggttgcatgggcttcgtgggtgggcgctctccctccggcctaaaggtgatgtatttggtgtttggccccccagtcccccctcttgaggcttaaggggggtgtggcgctccactccttccaccagtagtgggttccctgttacctgtttaggcctagaagttttccctcctctgtcggtgtgaatttaaaatttaagccatgaatatgctttatttattaaaagagttatgcggaaaaaaaaaaa

SEQ ID NO: 491210 - DNA, 391 bp, Homo sapiens
  misc_feature (55)..(55): n is a, c, g, or t
  misc_feature (125)..(125): n is a, c, g, or t
  misc_feature (315)..(315): n is a, c, g, or t
tttattttaaaaaaaaaaaaaccccccccccccccccccttcctttttccccccnggcgccccccccaaaaaaaaccctttttttaaccaaaccccgcgggagacccccgcgcttttcccccacncttttaaaagaaattttttttccacccaccttcccccgggggggggggggggggggccccctaccccggggacttttcccaaagttttcccaataaaaagaggtggggcccctttctcacattcaccgtggcttggaacccaaaaaccccttttaaagggcaaatttgaaatttaaaattttttaaaatnacccaataacaagaaccccggtgggccatttgcccgccataagaatgagctggcttcctgcatatacagttctgag

SEQ ID NO: 491211 - DNA, 294 bp, Homo sapiens
tatctaataaacactaaagttttatccatgtctttcttcatatccacttactcgggacccgcagaaagtattgtgactcgagagcagccactcggcccctgaatcaacccagcatccgaataaaaacaaccagaagaaattattcttcaacctgaaatgaagccgggatcaaatggtcgctgatcatagcccatatttaaattggaatagtcaaactgagcattattaaatcaagcttgtttaatatgtctcaaacagaaaacaaaaaattcaatttggctctttctggcctta

SEQ ID NO: 491212 - DNA, 904 bp, Homo sapiens
  misc_feature (50)..(50): n is a, c, g, or t
  misc_feature (136)..(136): n is a, c, g, or t
  misc_feature (454)..(454): n is a, c, g, or t
taatcagcgcactggcaaggtgcagcgcttgtaaatgtttggcagagtcntgtgagggccccaagggttgttgcagttccttcgaccttgatcgcgttggtcaagtctgcttgagagaatatcacctcgtggatgnatgccatgtgctcttcgccctaatgtggttccttccgtcagcccagaggggaccgagataatcttcaatgcggttgtggtgcagaaaagcaaagatcctgtcaagcctggtggtcatgtgacttaaccagatccgacaagagcacaccgattaatccagctatgactcaacttgggggggaatcgggtgcaagggtcctgaattatctccctctttcatccctccggaaatctgaatacttattctatgtgaggctattacagccagtttgaacaccttcctcgttgttatgttctaccaaccctgtacgtctacaantttaaggacaaccattttaaataagtggcacaggttgcaggccgtggaaaaaacttaagggggcgccttatagtatcaattttcacggacgcttattgtggtggcgtttacacgcacctggtaattggcagaaatccactgtgtgcggtgtggtagtgagccatatagaacgtggttatctgggtgtggaccctatggaaattctggaggttttgcattatataactctacccttcattaattactttctgggaggatggtcttgcttttggactcagtggcattcttttccttttttttcctgttactatggtttactctggggaccactgagggtgaaatattattttttaaatttccaaattgtttggcaccattctttagggggggatttaaggtttttccaaattatactggaacctaaagtgggtttagaaatcaaaaattcgg

SEQ ID NO: 491213 - DNA, 385 bp, Homo sapiens
gggtggatggttccacatgtaatctcaccactttgggaggccggggcaggcagatcacctgagggtgggagtttgatttgagcccaggaggtcgtggctgcagtgagctatgattgttctccagcctgggcgacagagtgtgactccatctcaaaaaaaaggaaaatattagccaggcatacctgtggtcccagttactcaggggactgaggtgggaggatcatttgagcctggagggtcgaggctgcagtgagccatggttgcgccactacactccagcctgggcgacaaagcaagaacccgtctcgaaaattatacaaataaaaacaagcccctctttttcagtcagaaattccacatagttcagcgtctgacggggatcctc

SEQ ID NO: 491214 - DNA, 531 bp, Homo sapiens
  misc_feature (316)..(316): n is a, c, g, or t
  misc_feature (333)..(333): n is a, c, g, or t
  misc_feature (398)..(398): n is a, c, g, or t
  misc_feature (410)..(410): n is a, c, g, or t
  misc_feature (412)..(413): n is a, c, g, or t
  misc_feature (421)..(421): n is a, c, g, or t
gataaaggagaaccccatgcgggaacttcgcatccgcaaccaactctgtctcaacatctgtgttggggagagtgggagacagactgacgcgagcagccacaggtggttggtaagcagctcatcagggcagacccctgctgttttctcaagactagatacactgtcagactccttatggcatccggagacaatgaaaagattgctgtcccctgcacacgttcgaggggccaaggcagaagaaatcttggagaagggtcgaaaggtgcgggcgagtatgagttaagaagctaacaacttctcagatactggaaacttnggttttgggatccaggnacacatcgatctgggtatcaaatatgacccaagcattgtatctacggcctggacttctatgtgtnctgggtagccangnnttcagcanccagacaagaagcgcaggaccaggctgcattggggcctaacactcgaatcagcaaagaggaggccatgcgactggttcctggcagaagtattacatcggtcatccttcct

SEQ ID NO: 491215 - DNA, 957 bp, Homo sapiens
catctcaagatgacgcaccgccgaggacaaagaagcaacaaagcaggaagaaacaaaacacaagacagacaaaaaggagaacagaaaacacaagaagcaacaacaacaaagagaagagacaaaacaaaaacagaacaaaaagacagagaaaagaagaagaacaaagaacaaagaaaaaaagacacaacggcagagcaacagaagaagaagaaaagaagagacagcggaagaagcaagagcaagggaagagagaggaaaggcgcaggagagggaaaggcgagaggagaaacagagaagcaagcagagagagcagaaagagaaggaagaagagagagcgaagagaagagacagccacagaagacaaaaaacgaaaagaaaaagaaaaggaaggaagaggaaaaggctaagagagggagagaggagacgaagataggacaacggcagaagagaacggaagagagaagacgagaaaggagagaagcgggagaggggagagagagaagggaggaaagaacggaggaaagacgggaggaaggaagagacaaaggaggagaaaaaagaagaacgaagcacggcaaggggagagaagggaaagaaaagagaaaagaagaaaaaaaaaccagaagtacgccgcacgaagacgaagacggccaaaagatgcagaaagaaggaagcaccaagaggcaacgcagcagaaagaagccagaagacagacgaacagcaaaagaagaaagaaagagaaaaaaagggaagagaagaacgagaggacaacacaagcaaaaaaaaagaaaggaacggagcacacacaagcgaaacgcaggaaaaagtgaaacaaaaaaaagaacggcgcaaaccaaccagaaagaaaggggaaagagaaaacagcagacaacaagagaaaacgagggcacgacaacaaagaagacgaacagaaaacacaaagaacaccaagacgtc

SEQ ID NO: 491216 - DNA, 102 bp, Homo sapiens
aaagtgacatgatgacccagagatgacatgagagaaggagagagatgagagagatgatgagactggaacccatgatgatgatgatgagacatgagacccaga

SEQ ID NO: 491217 - DNA, 256 bp, Homo sapiens
  misc_feature (91)..(91): n is a, c, g, or t
  misc_feature (94)..(94): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (110)..(110): n is a, c, g, or t
  misc_feature (126)..(126): n is a, c, g, or t
  misc_feature (131)..(131): n is a, c, g, or t
  misc_feature (135)..(135): n is a, c, g, or t
  misc_feature (145)..(145): n is a, c, g, or t
  misc_feature (148)..(148): n is a, c, g, or t
  misc_feature (150)..(150): n is a, c, g, or t
  misc_feature (157)..(157): n is a, c, g, or t
  misc_feature (162)..(162): n is a, c, g, or t
  misc_feature (164)..(164): n is a, c, g, or t
  misc_feature (169)..(169): n is a, c, g, or t
  misc_feature (185)..(185): n is a, c, g, or t
  misc_feature (190)..(190): n is a, c, g, or t
  misc_feature (212)..(212): n is a, c, g, or t
  misc_feature (218)..(218): n is a, c, g, or t
  misc_feature (220)..(220): n is a, c, g, or t
  misc_feature (224)..(224): n is a, c, g, or t
gtataacccctccctcgagagtcgagtcagcatgtcacttgacacgttcaggacccagttcttcctgaaagtgacctcttttgaccgcggnggncaaggncntntatttncttttcgagagaacgnctatnttgnggatgcgggncgngnctttttnaaatntntgggncaagggactctttgtnacccnctctttagctttcaccaagggnccatangncttntctcctcgcggcgtgcttcacgagcagctcct

SEQ ID NO: 491218 - DNA, 140 bp, Homo sapiens
ttcataggatcccctcagatatccgcgcgctcggctctcaaagtactgcgattcatgggtgaaccaccatgcccggactactttgcctattttttgaaatgtctccatgattctgaattcaatccccggtcgacggagta

SEQ ID NO: 491219 - DNA, 602 bp, Homo sapiens
  misc_feature (46)..(46): n is a, c, g, or t
  misc_feature (55)..(55): n is a, c, g, or t
  misc_feature (73)..(73): n is a, c, g, or t
  misc_feature (120)..(120): n is a, c, g, or t
tctttagccaggtttagtggctcatgcctgtaatccccagcacttngggaggctnaagccggttggatcactngaggtcagaagttcaagaccagcctgacccaacatcgtgaaatgccngtctttacaaaaaaatacaaaaattaactggatgtgatggtgtgtgcatatattctcggctactcgggaggctgaggcaggagaatcacttgaacccacgaggcagtgagctgagattgcaccactgcactccagcctgggacacagagcaagactctgtctcaagataaaataaaataaacttgaaagaattattgcccgactgaggctcacatgccaaaggaaaatctggttctcccctgagctggcctccgtgtgtttccttatcatggtggtcaattggaggtgttaatttgaatggattaaggaacacctagaacactggtaaggcattatttctgggacattatttctgggcatgtcttcgagggtgtttccagaggggattggcatgcgatcgggtggactgagtggaaaagacctacccttaatttgggggggcaccgtccgacagactggggagcaagatagaagaaaacaaa

SEQ ID NO: 491220 - DNA, 304 bp, Homo sapiens
  misc_feature (67)..(67): n is a, c, g, or t
tgaccactgcacagctccaatgcatatctagactgaagacacactagtctatgaacacaactttatntgcgttagcaggtccatttcactttatttatttggttaatttgttttcgagacagagtcttgctctgtcccccaggatggagcgcagtggcgtgatcttggagcactgaaacctctgcctcccaggttcaaagcaattctcctgcctacagcctcccaagtagctgggattacaggcttgtgccaccacgcccgggtaatttggtattttcagtagagatggggtttcaccctgttg

SEQ ID NO: 491221 - DNA, 615 bp, Homo sapiens
tgaatcagctctgtaccagtgttgttggttctccagccttctcatcgactgtcatgataggggactttctctgagtctggatagcaacagagacataatggtgcacgggttacttgtgtatccctgatggggtggcaaaaggcagtggtaggttattgagattggccaaggctggctcatgtctccagtatagaggaggaggggatcagggccctcagaccacatggtactgcgtgtgcggagactgttgttctttatagaaaaccacggttgtagtttctagaatgcaggaactggatacatgggtcatagcagagatccagctgcctaagaggcaaggactccgatgggctgccgtcgggcccaaccccatggctgagaacttttgaagcttccgcagcctccccatggtggtcattgtcattacacttgtctgccttatgggaaattcctgtaaatgaaagcagacctggagtttgttcgccggtaccgtcaggcaatggggaatagagaaccttgcagagcaaagaggccgctcagcatcatcaccaccatgtctggggctacagaggaactgagaaatgtcctgtttcccaggcaaccaagcaaccccgg

SEQ ID NO: 491222 - DNA, 122 bp, Homo sapiens
ataccctggtcaaagaacctggaatcaaggggccggaacccattgagacccaacccctaagggagctccttagtaacagcttgaccgtagcccacgatcccagaagggaaggcccgatttgc

SEQ ID NO: 491223 - DNA, 362 bp, Homo sapiens
aaaaaaggggggggttccggggcttgggccccgtttttcccctaaaataagggttttttcaaaagggccccttttttttttaattggggggggtggagggggcccccaccccccgggaaagggtccccagtgaagaaaattcccctttttaggggggtgggggaaggttttgggtttttttggcccgggcccttttttaccttgggggatttttttttgccgaaaacttttttttaaaagggggtttggggtttttttacccctttccggttgggggggtttccccaaccccccatatgcccccggggggtttttgggggaaaccccaaaaaaggttttttttgggggtggggtttccttta

SEQ ID NO: 491224 - DNA, 548 bp, Homo sapiens
ttgttacaagcgtacgtagtactcactctaacatccgaagtgctgaatcacctttccttcacagtactggttcgctatcggtctctcgggagtatttagccttaccggatggtcccggctgattcacgcagaattcctcgtgctccgcgctactcaggataccactacgcttcggttaccttagaataccgggctatcaccgtctatggcacgactttccagtcgtttcttctcaataactgtcttgcgagagcgtggtcctacaaccccacacatgccgtaacatgggtggtttgggctaatccccgttcgctcgccactactaggggaatcattatttattttcttttcctgcaggtactaagatgtttcagttccctgcgttagcctccaaccaagttggatgacattccttcagaatgccgggttgtcccattcggaaatcttcggatcaatggtcatttgcacctacccgaagcttatcgcagcttatcacgtccttcatcgcctccgagaaccaagacatccgcggtgcgcccttattggag

SEQ ID NO: 491225 - DNA, 929 bp, Homo sapiens
cttggtgctaaaacgcttttgggtatcacatactggggcgttgcgcaagagttggccaaaacggtcgatgcttatataagttggcgtacggctcgtcgctaatcgccagatgtgcaacccctgttttgtccagcgtggtgcgcaactcatctgcactagctggttgtcccagaagtgtgcctcccctgcgtggcgtgactagcatacgctttccgttgtaatcggtcctatgggcgccccgtgtcttcatgggggatggatacatgtttccctgcgcgagaccatgttgattacagttagttagttctattgctggtactcgtttgaggtcccggtacattccacctcggggttcgttggctaacccgtcggcaagaccaaagtacggtactttgatgagcaaagagttgtcagtccccattcctgcaggcggaagtgctcccaccaacttctggtggaacgacaagccattgtcacgacggggaacgttctttactaacagctttgggtctcccagtaaccaagatgtggcagctgttggtgtgtccgccacaatagctcaacacgctgacatctttcttcgccactaataacacccgtggctcccaccaaaaggtggggcacacaggtcggcgcggcgcacgcgtcgggtgacgaagatgggtcgtgcttaggtcttctgcttgcgaggatctacttccctcttggatataggccacgtgcttgctatgaccccgtcccacgccagtgggcacctctggtagagtggacaacactacggggggcgctagagcaccggctttgtcaaaactgctgagaccagtcgggcgcgcccttcaaaacaactaacctcggcgtcttgtgtacgccgtacagcacaacttcagccccccttatcccaaaaccccagtgggcccccacaatatcaa

SEQ ID NO: 491226 - DNA, 152 bp, Homo sapiens
tgacttgtacaagcaattcacagcgcctgtgatgtgcctttgggtgcaactgtgtgacacctgtgcctctccggacagaggaaggaagtcccaccccgacttccagcagcagagagcctgtgtctggcattccctgttccgttgctcccacc

SEQ ID NO: 491227 - DNA, 136 bp, Homo sapiens
aactgcctagattgggctagagctgttgctccccaataatagttttatgttgacagcagtaaggcttggaaacctattattccctacacaagttacagaatacacatgttcctttctgccgaaagttctccatttc

SEQ ID NO: 491228 - DNA, 502 bp, Homo sapiens
taactcactgtttttctttttgtttgttccagagatcactttacccttcattatttggccctttccggggacaaaatattcccttaggattcacatagaccatccatttcttttatttctgggacttctaaaaatttattggccccgttttctggcataattagcaatacaaattgctcaattttgcccaaggtaggccaccataaaagtcgggccctttttcctttaacaaaggggtttaatttaaaattttttactggccgtttcaaaaaattatttttaaaaataaattttgccaagtgatactggggtaaaaaatttgtttttaatctttatggatttagggatttagggacctgttgggatggcgataaacctgcaagaataatttaaatttttataatttagggactgggtctttgtttattgaattttaaacatttatccctgcttggcaggctgtttaaacgtttaggaacttggtaccgggtttatttttact

SEQ ID NO: 491229 - DNA, 1175 bp, Homo sapiens
cgggcaggcctgcggtttcctttgtggacctgttgcgaaggatgtgcccctgcggcaccccgtgcactcattggccccgcccctgtgagacggctcgtgctgagctcattgggcggggtggctggggctctgcgctgccagatggcggggcctgactggacgagctggcctgaattgtgtgcacatttgctggtgaactgcagagcggagcagttgcatgagctgagaggcgaagtctgtgcataacagtggcgacctgatgattgttggatgaccatacagttctgcatgcttctagttggctacttgagagcacgggggcccagtgggaaaagcctatccccaagaactgcaaggtcccattcattggtgcccaggggtgacagtgagttgcacccaaggtgccgtggacccccccctttgaatgccgaacggcaatcccacatgtaattgacgtgcccaacgtggtgaaagctttccatgataacaggagacaattgaagtgtcttttaccattgtgtaaccgtgtggcaaagggttgagcccgaaagggtatacttcgagaagcatagatttcaaagccccagatggaaatggtaacaagcgccaatggtggtcaccccagggacattaggagagaggcactgaggcacttcccaggtatggggaaccgctggtacatttggggacaatcagggacatccggcgaaggacacaaccaggggacaggacaacgtagcggcacatttgggtaagtagtttagatacatgaacagttgagagccccaggaaagagcattatcacgaccgcacggatatgtggaactaccggcaagactaaaccaactagccatacggcaaataatgagcaacaaattacagtgggaaaccattccggggatatgacgctcggcaggtgatacactaatgggagaaaccacactgattaactagaagcgagcgaggacgccggtacgaaccggcggccaggatagcttgggcgattggcgagaaaaggtaaagtactgggatagcaatatccggactcacacccgtaaattggagtccaagcataacgacggcaccgcatagattgacagtaaatatatcccagttcgaaccggttgtaatgtggcacttggagaaaagacactataacaaacaaacaatacttg

SEQ ID NO: 491230 - DNA, 261 bp, Homo sapiens
gagctggtaccatttagaacatccacgagcatgattactttacccccataatgcaacgactatacatataatcacagatttcaggttaccttcctcaagttgtcagagacgcgctgttagcgggtctatatatgtcatgttgcaagaatagcaaagtgaccctggctgctgcttcttccaggcttgctctgtaaagggatgagagtgacatactgatgcctactgaggcatctgagatgcactgtttgtggaggtagcact

SEQ ID NO: 491231 - DNA, 1055 bp, Homo sapiens
  misc_feature (422)..(422): n is a, c, g, or t
ccaagtcgtccgtgaccttaccccctccctagaggctctacttgtatggtcccaggtcctgctggcaatactaccgtcaagataagggctgaacctctatgtgcgagatcgtacgacttggcgcacgaggtcgaagggtagagacgtctcatcagtgtggcacggagacacatgctcagcgaacgtcttgtcggctccacaggcaccctcgagtttgccggtgacgttgagagtccacgtcctgtaggatcataggccaccttgtacaggtcgctcacgacgttggtgggacgcgagctaggatctccccgtagctatcttggtgtgacaccccggcgtagtgggccgctgatgcctcccgcaccttggtgaggcatatttgctctgtcggaccttctctaccactcacctcgtctacttgncctcgtgagtacgccctatagctctacgtaggacgcctccgtcaccgaggccatgtgtccgcatcgtacgtgcccttccagtgtaacgtggaaagctagatgcccatcctgcgtacaccatcacgttgcatgataacttcacgtggcatccctatacagcacatcattgagtgtgtctaccatctactcgtctcggggcacgagtgctccctttctattcagcaaccccaaagggccctatactaaccctttgatgtaacccatacatccaagggaaagctcttcgtgaatccttatacgaacgaaattgttccgtctgtattaccttgcctttcgtagtacttttcccgaaagtgcttactttaagtaggcagtctcttgtacctatgtaaggaggaacctgtaagccctgtgacaacctagtcgttattgtcgcaccaccgcgcctagggaaaggggaacccaattcttgaccatcctgaatgctgaattccgggaccccattttagaggcacccccttggagggttttgatcaataccatataatcataaccaaaaggaatatcggagatataattttcccccatatttgtaaagtacgaggcgggcggaaaaaaaaaaaaccccctggg

SEQ ID NO: 491232 - DNA, 305 bp, Homo sapiens
  misc_feature (2)..(2): n is a, c, g, or t
gnaacatgagtgaacagacagtggtcacaaagagctccagagaccctgcatgcttcgccagcagccctcggatgatcccacgtagctcccggctgggggggctgtagggatatcatgagtatgcgtggctcagcgtgggtcacttagaggagcttgtagcttgtagttaagatagctggccaggtccttcaaccatatggatgggtttccagagaacacactctggctctatgtccagtacgttctgcaggtctgccacatccagagctttcagtgcttcctccaggctgcggaagcggccctgc

SEQ ID NO: 491233 - DNA, 320 bp, Homo sapiens
atccagaaaacaagtggctcgagtttgtgaggttaacctattcagcaaatggggtttcaagttcagttggtccttttttcttatagcttttcacaacactatatttgaagataacctctgtacaataatcattctactaggatggtagtttctaaaagaagataacttcaaaatggcaggtatttttctttgtttaccttcttaactaattaattattttattcgagagacattattgttaatctaccatgtatatgataatgttcactttactggaggtgcagcaaggtttctactgtatgggtctttcattcttcttg

SEQ ID NO: 491234 - DNA, 701 bp, Homo sapiens
agcggagcggcgcggggtcttcatggctgagctgcagctactctccgtggttgcaggcaggctggtggagtccattggtcaaggagtctgaaagagagcagaacatccggacgatgcaggatctcatgttccggtgctaggcgccagctgttgtgaggactagccaggcctccatgaaacaggtgcaccattgcatcgaatgggtgccatgtgcctctggcgtcaagcccaggctttggtcagccagatgacgctgtgataaccgttccaggagccggcatgggcccggatgcaccatgcagtgtgcgatgacgaagccgaagataacaattagatgctgggaggtaaggagcttcagtgtgagacatgcagctggacagtcgtgtgaacaagtgtgtggatgacaacatgcacctcagtccctaactatgatcaagaggatgaaggaggctctcttatcaattggaagatagtaaaagtgttttgtcatgtggcgcagtcatggcctgagggcggagaatagttattttttataacgggagatttgggaatcctagtctttataatgcataagtttacgaatgaagaaatgaagggatgtgccacaagtggtatagagatatgtcacgttgcctcgtggacactggttattaattatgtttcagtccctaaacaggtgacattggtggtaagtgttgcta

SEQ ID NO: 491235 - DNA, 580 bp, Homo sapiens
agaatgctggtggcgcctggttgactcggccgaggccgctgccgctcaggcggataccttcctagctcaagcaatgagctaaaaggagccttatgcatgatcttcccacgtatcaaataactaacaggcactgaggttggcatgttctgcctgctctgctaagaccttgggattccccacttgcattataagcttatatacatgaacattatccaaaaatgattaaaatatattaaaacaacatcaacaatccaggatatttccctataaaagcttttaaaaatatttgtatctatgttttcaattttacttcctttttcagaggcttggtttttctaaaggcttggtttccctttttattatttttctcctttttttattttttggagacagtcttgctctgtcgctcaggctggagtgcaggggccgatctcgagctcactgcaacctcctcctccccggttcaagtgattctggtggcatcagcctcccgagtagctgggactcacggcttgtgccactatgcccagctaattttggtctttagtagagacgggtttccccacatgggtcaggctgt

SEQ ID NO: 491236 - DNA, 115 bp, Homo sapiens
ccacttcccatcaagtagtatccaggagaatgggtctctagtgactccgaaatttcttgggtgaaaaatatatccgcaggttcggatgagaccaggtgtagcttgttcgaattat

SEQ ID NO: 491237 - DNA, 1097 bp, Homo sapiens
gtcttggagtacgtccattgctcctactggtcgtactattcaaacggaagcagatgaacaagattgatcaggagagtatattggaccaacagtcaacgcgcgatgtcgactggatagcttgcggctcgacttgtcctgtgcattctatcccgctctggcagtccagtgcagagtcacactagacaaatcgactccattgctgacatactacagcatggagactaggaccactcgttgtttttcacgagttagtagtcccttctccatgagctcgccactacaacgtacatacgtagtagtactatacctgtgagtccatttggcgcgtagtgaatgggtgcatgtatgatgtaaggttgacggtgtttcactaggagtacgtgtacagcagccatgaagggcacttcagacgttgctagacattcactaatacgtggtcatccttaatgacttgaagctccatgttccatctgtagtccactagcattgcagctcgacgatctggggcgaacaatcggagcgttaacctagttgcctgatgaacgtcgaatccctctaactaggtcttgcagcttcgctgacagtactatcggtcgcatccacttcgaacttccccagagctggccctttccagtgcatgccactatgagttgcggcaaagggcgtcgcccttatcttgagaaaaacaccctaggggcaaaataccctttcccactccaatttacccacgctcatgggatctttcgtttaaaggttcaccgcattgcagatacttaccctcctactggtccggagggaaggcgtcccgattggccagaacctatcgttatgtgggagtaccagcgtatttgtctcgttagacggtcctagttctttgaaccgacaataccctgttgctttactactaccgaggccccattcgccttcaaagggtaccagctaacttcatggattaggtaatcctgtacggtgtggcctcctattcctgattagctgtgcgttgggcgcaagcttcacttgcatgagagctccaggttcttaaacccgcgcacacccacgtgcattggggttgcgcgtgggcgctgccaggcactccc

SEQ ID NO: 491238 - DNA, 183 bp, Homo sapiens
  misc_feature (46)..(46): n is a, c, g, or t
agaatctcgctgagggattgtggggaggggtgtgctcacgcgctgngtggagatctggtgccccctgtatgccggacagaaagggccaggggggacaaggtcttggagaactcggtggcatccggctcttgatggctgtggttcccacggcccttccccaagccttcctgacagcagagagag

SEQ ID NO: 491239 - DNA, 775 bp, Homo sapiens
  misc_feature (89)..(89): n is a, c, g, or t
tgaaccagagtcgtccttctagcgattgtccctcagcagtttgtagcacaatcggcgcccaaatatccaccccagctgctcccatggtncattgctagtgggcgcagtaataagccagcatgtcacacgtaaagtcgcctctccatagcggcaatcaacatatagtgggctctcttataagtagatgaccacgatgagcccttggccagctggtcacatcaactgtgcaccatacattaagcaaaggtagtggcatctcagtctgacgatgttgaaatcatcccacatgaagccaggggtcacacagaatgctgtattcatggtgtcaggatcgtctgcccccccgcataagcaatgttgaccagcatgtctaatcgacagtgctgtagcagatccacatgcgcatacaggcttcgcacatcactcacctggcttgcatcgcgctcatcaggcacacaatggccctccagggattgtgcctcctgagcaaccactgaaagggtgccaatgccggacagatatgtcagctgtggcgcctgctttgcagaatagcaaggcaacgcacgctcgatacccctgtaggcaccagtcgcgacagactgtaggccattcatggcagctgccatagctcacaggcaaagcaggcaggtctgccacacgctatacccattagagtctgcagaaagcatgtctgcggtgaaagtctcggatatggcccagattagccgccgacgtgaagtcagtgttcaaggaatgaatctgcagccgaagcggg

SEQ ID NO: 491240 - DNA, 124 bp, Homo sapiens
gaactaggctacagttgctaaagaaaatatagaacctcttcctcttccctagacttacaacaggctagggttggccggggcggtggctccagcctgtcatctcagcactcggggaggccgacgg

SEQ ID NO: 491241 - DNA, 115 bp, Homo sapiens
cgacacagcttctgaaggacgagccatcgccgctcgtacccgcttctatgccgccagcctaaatggcgcccctcaagggggtgcaagtacgactgacgtcatcctgtatgggctg

SEQ ID NO: 491242 - DNA, 799 bp, Homo sapiens
agcggtgctaaggttttagcccctcggagtcccggcccccttcaatataagtgggtccccggggttcgggatattggccaggaaaaaaaaagcctggtttgttgtggtttctttgaaggggtacacccaatttccagtgaagaatctaaagctgatttccggtcagagtccctgctcacaaatcaagtccattgtttacttccgtgtaagaaggttaggttccagtgttcttttttgattcttcaggcttcatagggaggctcctttctcgtaccattcctaccaatccaactggtaagccccaaaatagaacgttttgggtgtgtattccgagcaccaccatgatattcacctctcatacatgtgactggtggcaagttatgtttcctccctagagagaagggtgagcatggctagctttacacggccagtcatttccctggtgatgaatattgattcttcggccacacccaatgagctcgcgcctgtcatcacagcatttcaggaggatctagcatgagcactgcttcagccctggcgttccatgccagcgtggccaacacaggtatgcctcgtctgggcaacatacgctttatctcttagccgaacatggtggcactcggccatggtttctggtatgcgggtgtagtatgggcggttcatctgagctcagagtattgagtgcacagtgccccgttcttgcccatttactctacagtgtgtgccacagagtgacccgctgtctaaaaaaaaaaggttgtatcttatctgctggttattataacagtgctcggcatgt

SEQ ID NO: 491243 - DNA, 1096 bp, Homo sapiens
  misc_feature (259)..(259): n is a, c, g, or t
cgatttttttttctttggctgctgtcgtacgtggtagcacacgaagagaagaggggacgtgccttttgttggtgtttctcgttattgctttatcgcgtgttgtgtggactgtttcctgccctatgggtatttgcgcagagtgtcaatcaagtctgaagagccacgggggtttaggacctttcccgagacctgggcttgcatacgttccccccgccaggacccgttttgggggatttttcccggggccacccatgggggnttccctagcttcggttacggtattctttgcgctggctccgctgggtcagaggtgaaccccgcattggcttcgtgtcacggagttttttttagccgcgcaccaactggggccccgagccccatggttgggcgcattcctggggttctcactacgtgttccgggggacacttgtaggatgatccttctatcccgcgacctcggttttttgggggcttgttgcccctcgggcaccggttccgcactgggggccccccctgtccgcattttgtagacgcctttgggcccccagttcccgacctcgcgtgtccttccgcgtatttgccaggagagtagtctgtggccatcccagagctaaattttcccggcagggacattctcaggaacaccccttgtgctccagatataacctgttgggccaggctcaatacccctgttgggtcaaccctgtcgtgggtgacaacccaggaacccctctcccctctgttgtcaagcgttctcaggccagattctgaggccctcccggcatcacaactttcacggggtccctgtgttaggtagacggcgccccccctcgctgggagtttgttgcatgcttgccgtttgagacttttctccagcgagctcagcttcctctggggccccgttgtgccagctctgtagactttgccagttgtgtcaattggcccccgatccaatgtttttttcgcctcacacttccccccagatgttttggagatcatattgagcctcctgtctatttccggggtggcccccggctagatacccccggggttttgtggcgccaaaattaaaaaccctccatggacccctggagca

SEQ ID NO: 491244 - DNA, 288 bp, Homo sapiens
  misc_feature (155)..(155): n is a, c, g, or t
ttttttttttttaaaaccccccccccccccccatttttaaaaggggggggggggggcaaaaatttaaaaatgggggccctcttttaaaagggggccaaaaaaagggggggcccccccaccccccccaaattttttcccggtttttttcccccggntttttttttaaaaagggtttggggaaaaacccccttgaaaaattttttttgtttccccaaagggggggtttttttttttttgggggttttggggaaaaaaccccaaaaattttcccctttgggaaaaaattta

SEQ ID NO: 491245 - DNA, 397 bp, Homo sapiens
  misc_feature (388)..(388): n is a, c, g, or t
acactcggatgtaggaagtctcaccctcgtgagagcggaatttggtgtcatcccagtttacgcagagcatattccatgtcctcttttctcaaatattcaaccatccccattccgtccttctgtacgtctgcataacagacatccccagcttctcgcatgtgatctttcaggtcctgccagctgcctgatggaggaagtcctgaaacaagaactcggaaatctgaccgtcttgtaggaggcccgttccttgcaccacggggccacccaccccgacctccgtaagtcctggggaactccacacggagtcgacactggccataatcgtaaccgtttcttccatagatcgcatcctcagcatctcgcgggtcctcgaagcgcacgaaggcgnagaggacga

SEQ ID NO: 491246 - DNA, 1615 bp, Homo sapiens
aatgcgggctgcctccgatcccctgactctcttcagtgtcccctgaatagtctccaaggccagcagccgaccagcaagcagcttcagcatggcaagcaggcagtccgtgatcaggccatcaacccatccccatgggcacattacaccacaccaggaaaaaggcagagaccaacagatacaggactgaacggcccagagcccaatgtacatcccacacacaccacaaccacaacagtgcagaaccggcaacagagaataagggtaataccaaaaagcacacaaacagggaaacctactcgactacaaacgaaccaaacaacaccagtgaaacaacaacagaggccaaacgaaggcaacgacgaagcaacaccaacgaaacgacaaccaaaaagacaacaacgacacaaaaagagaacacacgccacacacaaaagaaaaggaaaaaaaacaaaacaaacagacaaccacaaccgcgtcgcccaaccacacacgcaacacaccagaagaaatcacaggagcaccaatgcaacacccactcagaaaggaaaaagaaagcaccgcccaagccagacccacacaccatcgacaccaccacctcacatgaacgacaagcactagaacaccaatacgaaacacaacaaacgtacatacacacagatcaacaacctgacaccaacagaagcgagcacaccagaaaccaaccacactcaacatccacaccaccaccaacagaccctaccaagcaaccaacacaagaccagacaacatagtcaccacactatcaccaagaccatcggagcacacacaagcaccagtagccacaaacaaacgacgacacaggagaacaaatagaaacaacggaacattgccaacgcagcacacacaaagatgacgcataagcacggaaaacaaaggcgacacagacacaacgaagacagctacaaacaacagagaacacaggaacagaacaagacatcaaaccaaaaaagacagcaaacagcgacaaaacagagaatacaggaggaacgatccaccacgacagacaaccacaagagagaacaagcagaagcacaaagaaggccgacacacccaccacaccatacaacagcgaacagcgagatcgagaccaacgagcaacgatgaacaaacgagacaaaacgcgaaagaatctccagaaaccacccaaccacgacacacatacggatcacgacaccacaacgacaccataagaaccaacagcgctacaaacaaggccacgcagcacaacacagccgaaggactacgcacagccagtagccagccacaaatcgacctggacatcacatctcatgaaacacaatcgaccacacacacaatactaaataacacatccaacaaacaactcacacaaacacaaaactactacataaactagacaatacacatatactaatatagagacaaacgcatacacatacgcatctactactccacactacaacacacacacgaacacctactaaacaccagcactcaagcaataacaaacacaaaaaaaacacaacacataatcaaccactataaaacacttaccatccaccactcaccacccacacaacatacaaccaaaacacca

SEQ ID NO: 491247 - DNA, 140 bp, Homo sapiens
tttcggacagactctcggcccagctaaacataatcgtcttggtaggccattaccctaccaactaactaatgttccgcacccccatttttaagtgaaagctgagaagctcctttctattactcatcatgcggaaaaagctt

SEQ ID NO: 491248 - DNA, 1010 bp, Homo sapiens
gcactatcctaatgtaaaactcgtagatgaccttgcttgaccattatctccagttaattaagtgttcatgtggtgcttggaaactgttgttttcctgaacatctaaagtgtgtagactgcattcttgctattattttattcttgtaatgtgaccttttcactgtgcaaaagggagatttctagccaggcattgactattacaactttcattttggtggagtctcagtttcaggttttattgtataataaaatcctgcactgaatctgtgtctcctctgttacctacttttgcctagtgaaatttaatgttttacaaatactttcagcaatgtatttttactactgcaagttaatggtctttaaaactgtcaagtagcatctctctctttctctctgtctctttctgttagctctctccagtatgggattcttgaattgcccatagtgggcctaaagaattccacaatatttctgtaaaaatctgttctctctattgcttgctcgtcagtaaaggtgaattaatcccttcgtgtgggggttccatggtaagatgtaatataattcttagcttttgacttggaagatcccttgttaatgttaaccttggtagttccaaatacttctgggtcgattcgcttcagttatctcttccatcacaaaaaaacctttaattttgcccttgaaactgtagaacctatgccatgctttcattagaagcaggcctctgtgttaacagaccaagaatgggtgtacattagaaattgggactgtggactattcacctgttctgacaaccacattttaccagttctgtcatcgacaagattgcagttttacccacctgttgacgctagcagacggtctttggacatcacgctttcaacattatcagggcttctgaaggctccctggggaacctatcttttactttcataacatgggctaggcaattcgggtaattgacagcttctctaagatttacaattacatttacccactgttcaacaccc

SEQ ID NO: 491249 - DNA, 466 bp, Homo sapiens
tgggcgcaaacacagaaggataaataagatcctcactttggcagtgctatcctctcctgtcactaccacggctctttccagtaaccacacagcctgagtgctgcagcctttttatttatgcttttccctattggctgtgactggagtggggcagcactagcagcttctagattttaacagcggcatctacgggaattgtcaggcaccctacagtaaggcctgccatgctgtggccaactgtatcactggagcaagaaaggagatctcataggacggagggggaaatggttaccctccaagcttgggtcagtgtgttaactgcttatcagctattcagacatctccattggtttctccatgaaactctgtggttacatcattccttcttagttgacctggacagtttggctcgacctagatttaacccctcaggtaaagatgctggggtatagaacgctaagaattt

SEQ ID NO: 491250 - DNA, 365 bp, Homo sapiens
  misc_feature (364)..(365): n is a, c, g, or t
atgaggacaggagttggtcagccctggccgacatggtgaaaccccatctctactaaaaatacaaaaattagctgggtgtggtggtgcgtgcctgtaatcccagctactcgggaggctgaggcaggagaatcgcttgaacctgggaggcagaggcctgcagtgagctgagatcgcgccactgcattccagcctgggcaacagagcgagactatgtctctaaataaattaattatattaattaattaatttaataactgcagagcgtggtggctcacacttgtaattgcagcattttaggaagccgaggcagtaggatcgcttgagcccaggagtttgagaccagcctcgacaacgaagcaaaacnn

SEQ ID NO: 491251 - DNA, 828 bp, Homo sapiens
cgagacggcacagcagggggacgaaggggacaggcaggcaccgccaacgtggcccgggaaatcctccgccggcaacctcctcagccacagcacccagagcagggattcgagcaaataaggccgaatacctcaccaagaaaacccaggcagacaagcgatggaggtctgagtaagatgcatggacgagatcctcctgacagctgagcgcctcagtgcccgatgaaagatgatgccaggcgaggtttgattgccatccagattaacaacgatcccccagcagcccgtcaacaccctgcatgttcgacgctggccaactagcttactccacgcgtccagctggtacaccaacccctaccaggccaccattgatggagtcagatctttggggacatcaggacagaacgtgagtgacatatcttccgatacagcagcatggaggatcacttggagatccatggagtggaccctgcagggtccgtcacatcagccccatcagcccctgacactctaggttgttaccccttcgtacaaaacgtgacgccgttcatcttcccagagtgcccgcatgtcgtactatgttagtggcaacacccccagcttattggctccaaaatcatccgaggtcctgaggaccagacagtgctgttggtgactgtccctgacttcacgtgccacgcagaccgcctgccttgtgaactctgcgcacgcctggcctgccagcccatcagcttctcgggcttcggggcatgaggacgatgacctgggaggcctggggctgggccctgactctaaaaaagtggttttgacaagagaggcccagaatggagg

SEQ ID NO: 491252 - DNA, 830 bp, Homo sapiens
tgtgagtaaaatcttcataacctaaagctgggagggacccaaaaaagccaatttgtgaccccttgttttgcttcaatttgaaagttggctcagggctctctagacagaattaaccatagcaaaggttgagaaaacttctgtcccgtttcgcacttagttttggtgttttaatgatttaaaactcgtttcttctccctccgtgcagtggctctcagagccgtggtctgggccctccgggacattaaatttctcgatggctggtctggcgctccttcggtgggctgatgttctggccgcacagaagtctgcccgtcttggccgccaggagtctcttggcgggcctcctggcgctgtcttgtcgctgggctgtctggaggccttgtcgcggtcccactggccggcttggatttgggctgggcttctttggggaccggagggggtggttccttctcttccttcctcttctcgggggtctccaccagctgccagctgttggccttgaggtggtagagttcatcgaacttcatgctgatatcctcgatggacagctgtagcaggtcccaaaaccctgccaggtcctgggctgtggggcgtgggttggcatcagggtccaagtttggctcacagaggccccggaactgctggaatctcggggacatcagtagctgggcactgccccacagcactgaggactttcctaaaacttcttcagaaaggttgacccttgggaccccttgtccatctggcagcacaagccttccaggcggctcatgtctttgcctgacagtaggttagcgaaccaagtaagccgtctcggggggaggcccctg

SEQ ID NO: 491253 - DNA, 803 bp, Homo sapiens
gggcaagcggacgcagtgacttagtacgcctccattgagtgtcaaggcggaggtgactcccttccagcatggataaccgtaccttcagactatcaccctgagtgtgcatacataccacatgctccgcaacgttctggccgagtctaactgaacctgcaagctgtcgtgatcagcacagcttacggctgtgctgacgtcaggactgcaggtcaagtaccagtgatgcaccggcctgcccagttcatgtgcccacaaggtggtgctggcctcatccagccctgtcttcaaggccatgttcaccaacgggctgcgggagcagtggcatggaggtggtgtccattgagggtatccaccccaaggtcatggagcgcctcattgaattcgcctacacggctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggtctacgttcaggcggctgtgcgggcggtggcctgcactcgttgaggcgaaattctg

SEQ ID NO: 491254 - DNA, 898 bp, Homo sapiens
gcattcttggaaaaactcagcagggcaatgctggatctacaagtgcgccatgtgcgacacagtcttcagctcacaaacccgcatcctctcctcacacttcgtaccagcacttgctgccccagcgtgtcagggtctttaagatgcccgtcttgtcctctgctctttggccaaaaaaggagcatgctggaacatctcaagagacacccatcagtctgggcgcttggaggagacatgctgggaagaggggccgggggtgccctgtgtgacccccaagactgagtcctgaggcagtctggcatgtgttctcaggggaggggcatacccgtgtctactgaggagtcgtcttcatcttcagaagaggaggaacgtacccagactcccctgagccccctccgttccagcacaaaggggctcggacgggtaactagggagcaaaggcctcaaggcgtgggggtggggggcctggtaggcgtggaggctgtggcgctgtgtcacgcctggttcccatgagcgtgcatgcacatcacgtggcccacatgaggcaaggatgcatggcaagtcagctgaaacaagttcccctgtcgcctgtgtgagcggctcgttctgctccgaccccagactgaggcgccatgtcagagttaatcacgagggcatcaagcgagtttacccctgtcaggtattgcacagagggaaagcgcaccttcagtagccggctgatcctagagaaacatgtccaggtccgagacggattgcagcttggggcccagtcccgtggtcgggggatgcacttggctcgggttccagtgtctagaggccagggggcaaggtcggaagacgccgcagtcgttctgactcttgcagtgaggagctgagagagcgaagcgccagcaagtcccca

SEQ ID NO: 491255 - DNA, 121 bp, Homo sapiens
ggtcggaccgctattcatcggcactcgctattcatccccaccatcatagccacatcaccctccttaacctctacttctacctacgcctatattacaccaaccccggtgccgatgaatagcg

SEQ ID NO: 491256 - DNA, 332 bp, Homo sapiens
agacaagttcgttcctcctcgggacgttctaatcagactcttacacacttgatccagataccctccgcaggaggagaatgcccctcacagagcctttgagaggacggtcatcgacgccaaaaccaaattcagtaccaacggattctacaggattcccctgggatctgaaaatagagctccctctcccatgtggtacaggaaacctccacaggttaggtgctcgcagtcttcactcagtctttaatacaatgtctacagcagcactcgatgtcagcagtaatttagagtttgatgagggtcaaataagtcatttggcatggaaggacccttag

SEQ ID NO: 491257 - DNA, 369 bp, Homo sapiens
gttttacaaaccttacaaagccctgcacgacactgctatcatctctgggataccggctgcagctggcgttgacttacatgagaaatttatagagtctgcacgagatttgcacatgttaagaacggatggttctgagctgttccagcatgtgccacagtttgacattgatcgaatgaagcttgtgcaccccatagccatactccactacattgccagcaaatacatcctgtatggcaaagacattacggagagagccctgatcgatatgtatatagcaggtatagcagaatcgggtgaactgagcctccttctgcccgaacgtacatcagcggtagatgccaatctagcctcgatcagtgagagacatcc

SEQ ID NO: 491258 - DNA, 485 bp, Homo sapiens
attgagtggaagtagctctcagccgatgggggagccagaagggagatggttttcctctggagttgggctgctcagcggcccgactctttttcgaccactccagacaaactccgcatccttctgcaattgatggactgctagactgcctgtgcctttcgacatgctcttccagcagtgtgttcttgatgaccagctccttgtgtcttcttgtgccgatgtgtttctcatgatgtccagcagatagtgtgtgtacccgctagggtctcaggtttttataggcccaggatggggacatggcagaccagggtggtcttggaaaatgcaacatttgggctcggaagcaggagtgtctgtcctcacctaggtctgtgggggtggggccctaccagggaccatgccctccatgcacttccctttcccccttttccatatcacttaaaggggaccatttgtttttcctttccaagcacttcccgtattaattt

SEQ ID NO: 491259 - DNA, 946 bp, Homo sapiens
catttgttctgtactaagaaaaatagttttgccttgagacgctgttaatctgtaaccctacccccaaccctgtgctccctaagacatgggctgtgtcaactcagggttaaatggattaagggctgttcagggtgtgcttgttaaacaaatgcttgaaggcagcatgcttgttaagagtcatcaccactccctaatctcaagtacccagaggcacactacactgcggaagactgcagggtcctctgcctaggaaagccaggtattgtccaaggtttctccccatgtgatagtctgaaatacagcctcgtgggaagggaaagacctgactgtcccccagcccgacacccgtaaagggtctgtgctgaggaggattagtaaaagaggaaggaaggcctctttgcagttgagataagaggaaggcatctgtctccggctcgtccctgggcaatggaatgtctcggtgtaaagcccgatgtatattccatctactgagataggagaaaaccgcttaggactggaggtgggacatgctggcagcaaatactgctctttaaggcatgagatgttctgtatatgcacatcaaaagcacagcacttttttctttaccttgtctatgatgcagagacattgttcacgtgtgtactgctgatcttctctccatattatctatgtcctgcaatccccctctcggaaatggccgataatgatccataaatacaagggactcagaggcaggcgagatggtccacggaggtgaacgcggcccggggccattctacctgaacagcatcgagcacaccgtcaagcccctcctaggaaagccacgggggggcaccactcaaacagtactcaaaaggagaagaaacccacgggaaccagttaggacgcgaaaaggcgaaagcgagagccaaacaaaaagaaatgaaaagaaggacagaaacgcta

SEQ ID NO: 491260 - DNA, 432 bp, Homo sapiens
  misc_feature (307)..(307): n is a, c, g, or t
  misc_feature (378)..(378): n is a, c, g, or t
  misc_feature (410)..(410): n is a, c, g, or t
attcacctctgcccagcaggacaagatgatgaaagtacagagaacttgtgggtctaggtttgtgtcagaaaggaggttagtggcttgcttagggccaggcagagggcacattggaaggaattctctgttcccggtgacagcccttggaattgctgtgcacccagagttgcggagtaatttattggcttctgataactatagtattggataacttcccaacattttattaaaaattttaaacatatagggcatgttggaaagaatttaatactcaccacctaggatttttgccactatccacatatcntgtggcatcctatttaatacattttttaattattatttttttttggaggacaggagttttcttttttactncagggctggggatttgccaatggggtggccantcttcaggcttcacctggcaac

SEQ ID NO: 491261 - DNA, 260 bp, Homo sapiens
  misc_feature (207)..(207): n is a, c, g, or t
cagcagttgtgtcctggaaggattgctctttgctaccagaggacaaaaagtcaatgacacatctgtcaccgggcattcccattcttgccactaattggagtgtttgctaagatccaatataactaagtggctggcaagcagctgaaataccagatgaaatggaattgtgattattttgtttaatcccatttcaaatatttatatttngttgaagatttaagtagatggcctgtatcagaaagatgtgctatttcaatagg

SEQ ID NO: 491262 - DNA, 139 bp, Homo sapiens
acacctggcgtatacaagtgcagctgtgaacccgggtacgagctggccccagacaagcgccgtgtgaggggtgtgatgatctacaggttgggaaacccctgttgtgggacagacactgtttccgcctctccacgcatgg

SEQ ID NO: 491263 - DNA, 257 bp, Homo sapiens
cacctctttggaggggagctgatgagaaggggatttggtcacctgagagggttgagtaaacttggcatcaggtcacaggcttctctcaccatactcagtcttttcgcactcactcccgtagttgagcctactggcatcaatgctcttaaataccaaggctggtgatggctgtggagcatgagctatgtgcccaatgtgctctgagaggggaggagacctaaaaccccttgtcagggaacatactgacgctgggcagt

SEQ ID NO: 491264 - DNA, 746 bp, Homo sapiens
tgcctacgtcgggttctgtgtccgaacgtttcgggtcctccgccgttaggccctggggagatggcgcgtggagccccttgcgtggctgggcctccgtgtgtactggtccgatcccacgcgcgttaatttagaaacccgtcgtccgcttgaagtttgtccccggcggggggtggactgcagtctataccgtgtgtgcctttgtgaaggtccacaaccatttttttgccagctgggtccagggccggtagacctcctgtgtccgatccggcgcggtgtgttgtgcccggtcgtatgagtgggttaatatgagttttagcccccctagggttggggttcgagtgtggcccattcggcgaggtgcttgggttgccgtgtccccaagtaggctgggggggatccccgggccgtggtgcccactaacgatccgcgccttttgttgtgtttttcttttggagaatgggagttcctttgtcccttgttcaaccccagggccttggaagttgcaatggcatgatctctgctcactgcaacctctgcctcctggctcaagcaattctcctgccttagcctcccgagtagctgggattacaggtacccaccaccatgaccggctaatttttgtattgtttagtagatatggatgttacaccatgttggccagacctgttgtcgaactccacacctcaggtgattcgcctgcctcagctccatgccacccagacgaaacacccccccccacaaaaaca

SEQ ID NO: 491265 - DNA, 371 bp, Homo sapiens
  misc_feature (1)..(1): n is a, c, g, or t
  misc_feature (3)..(3): n is a, c, g, or t
  misc_feature (33)..(33): n is a, c, g, or t
  misc_feature (124)..(124): n is a, c, g, or t
  misc_feature (127)..(127): n is a, c, g, or t
  misc_feature (165)..(165): n is a, c, g, or t
  misc_feature (367)..(367): n is a, c, g, or t
ntnggacgaggtgagaggattgcttgagcccantgagtttgaggcggcagtgggctatgattgtgccacatcactccagccttggtgacagaacaagactctatcttaaaaaacaaacaaacanaanaacagatactgatgactaggatgatcaaaaggaaccanatagatgggagaaattaagaagtcattatgtatgcccaggggagggtggaagcctcagtaaagtcatgtactgaataatgatgttttggtcagtgacagaccaaatagataacagtgggtcctataagattataatgggaaggccaggcatggtggcttatacctggtaataccagttgcttttggggaatgggggggggcnctcc

SEQ ID NO: 491266 - DNA, 247 bp, Homo sapiens
aacatttcagggtgaaggtacagtgtatatatagccaagggacagagctgtgatatatagcccagtggttcttaaagtgtggtcctagcaccaatggtgtcagcatatactatagaaacttgtttagacatagcagatatcttaggcctatcaaccatatggcctggccaactacaagaaattcctgggggatgagccaatctagtggtttttacacggtccttccagggttgattcctgattgtaa

SEQ ID NO: 491267 - DNA, 344 bp, Homo sapiens
tttcatgagtactccccggccgcccagcttctcggcctttaccagcatttgaggatattgtacttgccatcagtccttccagttaactgctgaggcttctcccttcacggctaagttatgtgcttcttgtgtctccaacagttttctctggatcctgaggatttggtttgtttataattctctcatctactgaaaccatttttgtaaatcaatatattagtagattctaagttccacttgttttctcttctggatccatctacagaatgttcttgcgcatatgttttcgttcttgctgcaccattaagagacttcacgatggaaggcagtccccactctgtgct

SEQ ID NO: 491268 - DNA, 188 bp, Homo sapiens
attgagtaagggagggtgaggggggctatgatgatgggggggggttggtatgtccaaacggtcatttaattttaacgtggtaagatagggggagtagggtgatggaggtggagtagataaggcgtaggtagaagtagaggttagggagggggaggggggctatgaggccaatcaacatagggtaccga

SEQ ID NO: 491269 - DNA, 273 bp, Homo sapiens
cagacctctccaactgggcataaaatgtaaacatatttttgttctatgtgaattgctgcccaaagaacagcctcagcagaggaagatcatgataagcagcctttttcctcagctattcctgtccttgaacaatggcctcatgagaaaaaaacggtcatggtggtagggatggatattccacatctgcatgttattaatcttcctaaacctgttttctcatatataaaatacagattacaaaagtacctactccacagggctgttgtgatgttt

SEQ ID NO: 491270 - DNA, 787 bp, Homo sapiens
gaggtggtctggtgggccctggaggtggcccccacagcttcccacacccattacccagcctgacaggtgggcatggtggacatccatgcatgcacaaccccaatggacccccacccacttgtgatgcagccaccgagcaccaccagatgaaccaagggcacacccgaccgctccatgtggcaccatggccctccgtccaatggatcaagtacctgggaagtacagcctgtgggctctggggtctatcgcctgcaatcaaaggaaaaaggtatgatagccagcacatccagcctactaggggcaatgagtgacacgacacgccggccggactggcaacctcgaggagggacaggaacgccagagaaggagaagcgaaaacagaaaacaagaacagaagagaagggaaaacaagagaaaaggagaggaggagacagggaggagaaacaagagagagcgaacgcaaggggcagcaacagcggcccccgcagcgcgcaaccaaagcccaccagaccacggagagcaagaaacacgcgagggcgggacacgcgcccacacagacccagcacccagccgagagccagaagcccagagcccgaccgggaccaggcgccagacccaaccacccccgcggcagaccggtcagccccgccgccgcccagccgaccccaccagcgcacaagcaaacagctcccacgcaggaagacagcgcggagcagacgctgcacaccccacgccagagaagcacaacgaccagctggcgcagagccacacccacgcccgcacgccc

SEQ ID NO: 491271 - DNA, 386 bp, Homo sapiens
  misc_feature (141)..(141): n is a, c, g, or t
  misc_feature (193)..(193): n is a, c, g, or t
  misc_feature (294)..(294): n is a, c, g, or t
  misc_feature (315)..(317): n is a, c, g, or t
  misc_feature (332)..(332): n is a, c, g, or t
  misc_feature (344)..(344): n is a, c, g, or t
  misc_feature (360)..(360): n is a, c, g, or t
gggagaattgaaaaggtgctcatagtttcactatgcaaacttaccccagtctctaaaaaagtaatttagatttaaagttctttgatgtatttgattttctaaatctttatggttatgatttggaattgtgcctaatcctgngctacattctgttcttaaatctgaatgccttctcatttaagggtgaggaacnatcacacacgtgtcttcattgaccttgacgtgcgtatacaggggccttataagacaccataagtttagaccataacttttatggaggacgggctttggcanctgggccctgccccgcgccgnnnctcgaagaagccttntgctccctcacnctttcccactccccgnggtctggcgccccctccagggccgac

SEQ ID NO: 491272 - DNA, 509 bp, Homo sapiens
ggggtcttctcacccccacccccttgtcctgggtaggggcctgcctgcccctctctgccttttcctcgtggtgtaccctcctacgagcccctgtggcatttggcttgggtggcagagcccacttgtttcagtggaccccagtgaggtgccccctggctcccagtgactgtgtgtgggtaccggggtggtggtgggggtggtggatgaagggtcgggcagcggtggtgcagcgggaggaaactcctcaccatggagagccaaagacagtggttgtgccttaccccagtgagccacccctggtaaccccgccagcttgtacacttgcccactttcacccgtccaactccctaacccacctgaggccgggcccctgcctcgctctttatccctatcctcctttctctcagcgctgacgcctgaatgcagccgtgggtatccccgcaacccatgggcgagccagtgcaattgaatctgaactggcagaaactaagcaaccaccagagaaccac

SEQ ID NO: 491273 - DNA, 1659 bp, Homo sapiens
ttacgtggatcatatgttaggaaatggtaccataataatactccgtgtcgtttgtcttctctcgtgcatataatatgggtagcaaaaacgcactctttgtacaaggggggcgggccgcctctttatttctacgctctgggttgggcgcccgctagatagactcaacgggggagagtgggttttcccgtcgccacagtagtttgtcgttgggccgcctacaactatccccctctgtggtgttgcgccccgctgtgcgttgttccccacctaggagaggaagtccggttctctctataagacgtcgtgttccaaaaaatagggtgtttcttgttcactgtccggcccttttatgtgatgatacaccaactacaactgtccccgcctgtgtgttgctccttgatcaaatacaaagcaatcagtttacccacgcagggtgagcaagaagccgtacatagaatgtagcccaaaacggtggggtgtgaaagattgtcgtcggggttgttgttgctcctcctccgatataaaataaatgtgtgtcttttgtctggtggggggggacgacgcccgtcagtagtgtggttgtagcctggttgtgttgtgtcgtgtgccccccaacaacaggtgttgatagccccagtccttgacaacccccccctttagcagtgttgggtttctcattaattaacaaacaccttcggcgcattatatcccgggggaagaaaaaaccttttgtcctcggaagaacaccccctgttgtgttcttctctgcgccacagttttggccgcacactttgtctgggaaactttgttccccaacagggggcgagacaacaatagtggagggagggttgtccacagcgctttattgtgaggacaatatactcacaacacactcctcatataaacacactgctcgaagacactcttgtggctcccttgagagcgttgtgtctgtgtacacagtgggggccgtgttatcgccacaacacctgcggtcgtcttttttgtgcggagatataaacattagttgccgtctctaaagaatagtggtctcacgacggagtattctgtccgtgaataacaatatattcacaggcgtcgtgtcaataatcttcgcggcgacatacaatcccctccctctctttgtgtgtgtatctgtctaatatgggccgtcaaagagacacacacactcgggcgttttacacagtttggcacaatgcacacacgtgtttcttggctctctcacagagaccccttcacacacacacctcgtgtcctctctgtctcgcctcggcacaacaccttctgtcctcttcacactcttccaccctcaagctagagtctctataaaggtgtcctcttcctccacgggagggtgtctttttctgaagtttcttggtgggggtgcacaagagacttttctagagaaaaatacagttagcacccacatgcacttttcacacgagagtttttaattacacacttgtaaaaattaatggccgtgaaataaggcgtggctgcgctgctatagagttgtaaagctcaccgaggggcacagaagaattttgttcacacacatcttgctcacatggaataaatatttccattgctgagccacaccagggtgcaggtccaatgaaattttgaatgaacatccca

SEQ ID NO: 491274 - DNA, 865 bp, Homo sapiens
cgtgttttgtggaaacacactttcgctgttggttgtggggggtttcccgcattggggccccccgaggcggggagttcgccccagtattgggccctctgcgggtgcggcacctggggcggcagttgtctcggtgtgggggtatatgagcacccacatgtgtgttgctgtgcaatggcgctagttggacccctgtctcaagagtggtacggagcgatcaggcgtggagcccgtcatcgcaagccacgaaccaacgatggtgtagccaagccgcattgccccccacgtttcgagcgtgggtcaatcccgccagggcaccaccgccgagcctttgtgcgcgtgcccctcggtcataggccccggggcagtcgtcgcagtcctctcttgcagaggatgtactctccggcgcgtctccttgtctctatgcagtcaggcgtgagttccccctctcggtaccacatgttggcgcagccttgtcttcgttccctttcctctgcaagggaccgaggcggtggggcttttggtgacataaataggcgtttagcgagcgacccatgttataagtgctatgaccatgtctcctccgccgcactccttcttcagtgtttccctctcgtttcaacgcacatcgcgatatactcccactctatccagggtctctatacaagcgcggtctctggagaggtccatggtaggccgccggtcgaacagacaggcggtattgtaggtgccttggacaccgggattaaagactgctgtcgtcgcccctattcgcctccgctctcgaatgagcctccatgtactcgccttattttgggacaacagctgctcagaaatccggggacccaatatgccccgaccacatgcc

SEQ ID NO: 491275 - DNA, 600 bp, Homo sapiens
  misc_feature (600)..(600): n is a, c, g, or t
atttccttactgcctcttgccatacagacctaagtcagcggcaaaatgaccggcagctacaggatctccaacaccatatcatcacatgcgttgaacctcaccggggctcacttcaaatttgacacatcaaggtacgcctacatgacctttatcagcatctcaaactgcaaacacactgacatattcatgaaatccaccgctagagtaaaaatgcgcaactgaaacgacattaacagcggaaccacgggaatgactagacacaacagagactgatcattcactgatagatactgtgatctaagcgcataatgtgcatagacaaacccagtcttacttctgcatcaagaccatagagcgtgaaggcagtctgcaatgcgaaaacatccacaggatgatagtcgtcagatgtcacatagccgaaggctcaagaacagccaaaatgactatcaggtatgcatcagagcgtagatggaacagcatatgctagagagaaacctctgatgctatgagctctcagcagcataatgaactcagacactgacagatcaatgacaggagcctgatctactggtgaacagagtcgtgtctagctacaggagn

SEQ ID NO: 491276 - DNA, 198 bp, Homo sapiens
tgtaggcagcaggtgattacgagtcagagttcagaccagccttgccaagatggtgaacacatctctactaaaatacacaattagccagcgtgctgccagtgctgtaatcccagctactttggatgctgagcagagattgcttagccttggaggtggaggttcagtagctaaaatcatgcacttacttcagcttggcac

SEQ ID NO: 491277 - DNA, 441 bp, Homo sapiens
ttggcccccaacaggcatccccccgttaaatcccctaaaagtccccctcctaaacacacccgtattactcgcaccagaagtatcaatcccttgagccccccaaagtttaaaaaaaaccacccgaacccaaataatccaaccccggcttattccaattttcttgggtttctattttaccccccacaaagcctcagagtacttcgagtctcccttcaccatttccgacggcatttacggctcaacattttttgtagccacaggcttccacggacttcacgtcattattggctcaactttcctcacaatttgcttcatccgccaaataatatttccctttacatccaaacatcactttggcttcaaaacccccgcctgaaactggcattttgtaaatgtggtttgacaatttctgtatgtccccatccattgatgagggtcttt

SEQ ID NO: 491278 - DNA, 227 bp, Homo sapiens
agttgctaactccacaaacagtgtatagccggtggaatgtgtatatgtggtgtttatgtttagaactgtgtgtaaagtgggtttgtgtacattgtggtgagtgtgatgacccggtggtttgtgtatgtatggggtgtgtgcaggttgcacgtgtggtgtgtatatgtgtatgtgtggtctatgtggtatgtgtatgctgtgtgtgtgctgtttgtggaggtagcact

SEQ ID NO: 491279 - DNA, 232 bp, Homo sapiens
ccggatagagcggtctggggacagtggagagctttgttcaagaggttgggttgccacgtggggtgagccccttgtgaattatcaggcaagggttcatgaagtacgactacgatgtgattaagccatagccgtgcacacagtaggcctggtaaaatgccatcacctgctgcatcccagagatgaaatagggcatgcatgggagtatattcggccggtgggtttgtctgctgtg

SEQ ID NO: 491280 - DNA, 958 bp, Homo sapiens
  misc_feature (796)..(796): n is a, c, g, or t
gggtcttccccggctcgccaactcggactgactctgggggattcgtgcgcggtaagaagctgcgcggtcagcgcggtgaggtaccactgatgaaattatgaccaggtggtgcccgacttagtaccacatatcaactagggtagtagtccttgggtctgcgagtttcatgggaggacatgaaacgtaagggacttcctttgtagcgggaatacaagtcgcaaaagcctagctcgaaatgcgtaaaatcaatcgttgaaggccaatgaggctatcccttcaggatacatgatgcgcccctacgacagaatgttagaaacgattcaagaagaggaaatagatccctgacgtatctattactttgaacgattggtgaccttcggatctccacttggtacatttaaccctgatcgaaccttgagacttttcacccaaagaattgggggtctccacacaagttgcgggtctaacccctctactttggcacatcacggaacgagggatgtacgcagataaagcctaaggggggaccaccccaaaaggtttggacaacggttctcggcggtattttaccacacttcaaaaaacggcaaccaggtccgcgaaacgagcggcgattaaggaggataagcgaaaacgtagagtttaactacgaacacgaacgctaaatgagctgagttattaaacgccattaactaggtatgccacagttgggcttagttgtgttactcaattgtgcttaaggaacattaacgcctggggttcccatttgcgggaacactttgggccaccggatgtnttgctcccccgaaccggacccccttctgacacaatttccttagtgatcatttggggccgactgggggagtatttgtttgaccaggggtggctggcgggtccgacccagaacgccacgaaattttatacctagggttgttaaggcgcttaacacgtatttaca

SEQ ID NO: 491281 - DNA, 135 bp, Homo sapiens
tcacattccacatccttttagaatttattttcgaaggggaataggttccatgttttattcacttgggctttttttcttccccctctttctttagagaactgctccatattcaatctgttgtgaagagggaggccg

SEQ ID NO: 491282 - DNA, 178 bp, Homo sapiens
tcagatgacaaagcagggggaagaaggtgggataactttgtttgctgtgtcttctggcatatattccctttcctatactgatatgcttcctccatgctcctcctgacccttgagacatcatacattcaggttcttcagaccttcggattcctgcaccttacaccagttggttttgctg

SEQ ID NO: 491283 - DNA, 140 bp, Homo sapiens
agaccgcggatggcttggtcttaaggaagattcttgactgggaggtcccactgctacacatggatcaggagggatgggaaggtcccaatgccacatgtccaaggattcgagatcaaggcagccacagagctgtgaagatg

SEQ ID NO: 491284 - DNA, 515 bp, Homo sapiens
catgaaatagaggtgggggactaccgcatgcactctgggaggtgcagccctaaggggtggactccagatctccctgcaagagacagcttggcttggctttggctgttggggaggagtccctgccatccccgtgagcctggggctgttgcttaaggtcttctgggtggacacctggagaaagagaaagcaaacgttggaacactaggaaaagctagaaattcagaccacacacatggatccccttaaaacatgttaatgggccagaacacggttgacctgcccgcttcttgaaccctgtggcccccgtggaactatcagtggcgtttccatgcacacgcccttttgttttctctttctagactcgcggtgctaaaatcagacaataccttgttgtaagcccaaagggcgtgcagggacaccagattttcctttgttgaatttgccaattttgggccccgtcggggatgttctacaaccctggttttaaggtggaaaagttcaagggtgaaaaatta

SEQ ID NO: 491285 - DNA, 460 bp, Homo sapiens
  misc_feature (19)..(19): n is a, c, g, or t
  misc_feature (90)..(90): n is a, c, g, or t
  misc_feature (133)..(133): n is a, c, g, or t
  misc_feature (138)..(138): n is a, c, g, or t
  misc_feature (154)..(155): n is a, c, g, or t
  misc_feature (168)..(168): n is a, c, g, or t
  misc_feature (393)..(393): n is a, c, g, or t
  misc_feature (459)..(459): n is a, c, g, or t
ctggtgcttcccacctggnacactggtgaggtggtgggagacctcctggtggcccctagtggtggccttccagttatttcttggagctgngcgctcaggtgagtggggcgacatctggtggccggttgttganggtcnttgcagagaggaaggnngccggggaggggngcctgcggtgagggccgtgctggggtgtgctccggttctcaccacccttgggccacgccgtctaaaacaacacactgaaggaagttgagtcaggtagaaggggcggatgaccgtgcggcagcccgttgaagtgccctgtcggcgcaggggaaggaggaggtgctcttcgagctcgcttggtgtccagggcactggtgaatcgcacgccttccagccctctgaaantcggtgactgtcgtgctacgaagaagcccttcgcagtagcttccggagcatttgttttcgtgggcna

SEQ ID NO: 491286 - DNA, 226 bp, Homo sapiens
  misc_feature (39)..(39): n is a, c, g, or t
  misc_feature (96)..(96): n is a, c, g, or t
  misc_feature (155)..(155): n is a, c, g, or t
  misc_feature (189)..(189): n is a, c, g, or t
  misc_feature (219)..(219): n is a, c, g, or t
cacatcaatgaagtagtgctcctagacgaccccgtggtnggtgtgcgcggttggctgacgagagcggccacgtagttatacgctggctcccgccgnctgagacacccatgacgtctcacatccgctacgaggtggacgtctcggccggcaacgcnagtggagcgtacagagggtggagatcctggaggnccgcaccgagtgtgtgctgagcaacctacngggccgg

SEQ ID NO: 491287 - DNA, 968 bp, Homo sapiens
gctggtgtcggcggctctgtctgcagcggctgggtgcggcggcctgtctggcctggcggtgcggctgtcgcgctcagctgcggccgaggctcgtacggcgccttctgcaaggggctcacgcgcacgctgctcaccttcttcgacctggcctgtgcggctgcgcagtgaacttcccctacttctacatcgtggcctcggtgatgcttaacgtccgcctgcaggtgcggatcgagtgagcgccggcggcggcggctggcgaaggcccggctgaaggggcgcccgtgtccccgcccgccccccggccgggtacgccggcatgaaggaaagctggagccgcgtgtggggtgcgcggagcgctggggctggctcggaacccctggactctagacctacgcccgacaagggcacagacgtgcccagccctgagcccggctgcggtctcagacccgggggccctggatcgccgcagacaacgcactgaactgggcccctgcacatacgggctaccagaaactacctggtgctcaggacgaacctgttgcctcactattggccaaagagggggaaaccagaatgagggaagtactgcctgcggcgacttgactttacaaggccggagcagaaaggcataggcattagtaaggcaggtagacccgacgcttctctgggccttgccaagaagtcacatccctgccaaggggcacctctggcccctgtaactggcctgggaagaaggcacgttgaatgggcctgaaacaagaaggaagaacgaaagggaccttcctaagtaaggaagggcaacaaggtataggcacaaagagggtcacacagcagcggtgagagatgcaccaaattgaatccaagtatcctggaatagggacacggaaagggtatgaaggctacacataaggagactgacaatctgcataaacagacagtaagaacaaggtggatatatcccacagatg

SEQ ID NO: 491288 - DNA, 942 bp, Homo sapiens
  misc_feature (8)..(8): n is a, c, g, or t
  misc_feature (79)..(79): n is a, c, g, or t
  misc_feature (174)..(174): n is a, c, g, or t
  misc_feature (186)..(187): n is a, c, g, or t
  misc_feature (195)..(195): n is a, c, g, or t
  misc_feature (263)..(263): n is a, c, g, or t
  misc_feature (274)..(274): n is a, c, g, or t
  misc_feature (278)..(278): n is a, c, g, or t
  misc_feature (286)..(286): n is a, c, g, or t
  misc_feature (288)..(288): n is a, c, g, or t
  misc_feature (365)..(365): n is a, c, g, or t
  misc_feature (441)..(441): n is a, c, g, or t
  misc_feature (478)..(478): n is a, c, g, or t
  misc_feature (500)..(500): n is a, c, g, or t
  misc_feature (504)..(504): n is a, c, g, or t
  misc_feature (507)..(507): n is a, c, g, or t
  misc_feature (510)..(510): n is a, c, g, or t
  misc_feature (514)..(514): n is a, c, g, or t
  misc_feature (518)..(518): n is a, c, g, or t
  misc_feature (520)..(521): n is a, c, g, or t
  misc_feature (525)..(525): n is a, c, g, or t
  misc_feature (527)..(527): n is a, c, g, or t
  misc_feature (530)..(531): n is a, c, g, or t
  misc_feature (534)..(534): n is a, c, g, or t
  misc_feature (538)..(539): n is a, c, g, or t
  misc_feature (544)..(544): n is a, c, g, or t
  misc_feature (551)..(551): n is a, c, g, or t
  misc_feature (557)..(557): n is a, c, g, or t
  misc_feature (559)..(559): n is a, c, g, or t
  misc_feature (565)..(568): n is a, c, g, or t
  misc_feature (570)..(570): n is a, c, g, or t
  misc_feature (590)..(590): n is a, c, g, or t
  misc_feature (596)..(596): n is a, c, g, or t
  misc_feature (599)..(599): n is a, c, g, or t
  misc_feature (601)..(601): n is a, c, g, or t
  misc_feature (603)..(603): n is a, c, g, or t
  misc_feature (609)..(609): n is a, c, g, or t
  misc_feature (612)..(612): n is a, c, g, or t
  misc_feature (644)..(644): n is a, c, g, or t
  misc_feature (648)..(648): n is a, c, g, or t
  misc_feature (651)..(651): n is a, c, g, or t
  misc_feature (675)..(675): n is a, c, g, or t
  misc_feature (698)..(698): n is a, c, g, or t
  misc_feature (716)..(716): n is a, c, g, or t
  misc_feature (718)..(718): n is a, c, g, or t
  misc_feature (739)..(739): n is a, c, g, or t
  misc_feature (798)..(798): n is a, c, g, or t
  misc_feature (803)..(803): n is a, c, g, or t
  misc_feature (832)..(832): n is a, c, g, or t
  misc_feature (836)..(836): n is a, c, g, or t
  misc_feature (856)..(856): n is a, c, g, or t
  misc_feature (918)..(918): n is a, c, g, or t
agaaatgnaaggcttttacatgtcataatttatattttaaaattaacatgcttctagaaataaaaaaggaaaggaaganagatatatacaaactaatcagcctggtcaacatggtgaaagcctgcctctactaaaaatacaaaaattagccgggtttggtggtgcacacctgtnatctcagctacnnggaatgcngaggcactagaattgcttgaaccttggaggcggaggttgcagtgggtcaagatcacggcactgccctncagcttgagcnacanaatgagantncatcaggtgcaggggctcatgcacgtaatcccagcactttggaaggccaaggtgaacaaatcacgaggccaggagcncgagaccagcctcaccaacatgaggaaaccgcaccacaactaaaaatgcaaaaattagtcaggcgtggtggcacanacctgtaatcccagctactcagaaggctgaggcagantcgcttgaacccaggaggtggngggngcngtnagtngggntnntgcngntgnnctntggnntggtnaacagancgagantntgtcannnnanaaaaaaaaaatttaaacccntagaancananantaaaanaanaaaaaaaaaatcccctatgaggttttcttctntttnggngagcttcttcattatctttcaganattatattttcttccatcttccncatcctcctgttcttcancnaataaatgaaaaaagatacanagaagacacatttgctttttatccactgcacttccactcactattagtcaatgtggttncagcngagaatagcagttttctggcagggcagcnactnctcagcaataaacagcacantgaaaaaaaaggataaatccttcataaaaagctaatgaactttttttttcctggaaactttnaaatccctcaaaaactgtttatta

SEQ ID NO: 491289 - DNA, 565 bp, Homo sapiens
aaaaccttcacagtatacttgaattctgcaggggttcgggggaactcctcggccccttccccgttccccttcaccagcctcccaccgaccgggcgtccccaactcagcccaaggagctgtcaggaatgggaggcggggggtcctcgcggagaaattaagaggggccccgcggggtggccgggctctggcccgggggccgatggcacgccgacagcagatggcccgaccccggaggagcccactccaccagtggcgggctgagagggtcagacacgccccgggaggtgggccccgagcccggggggctcgcagggcggggcctccggcccagtcccggggatgtcctactgcgcgcgcagggtcgggggcccaagggcggcgcgaaaaaggcaggccgcgacgaggcggcctcgggtgcgacgcacacagtctcccgccgcggcagccggcggaccaaggtccggcagggcgccggcgcaccgctgcaaaagccgcccgtgcataggacacaaacggcgcggaccacatgggccacacggccaggcaccactgaggagcacggtgc

SEQ ID NO: 491290 - DNA, 765 bp, Homo sapiens
gtaccaattaaaattatccatgagggagaaaccagtattgaataccctacctgactcactttgagcaattagaaatatttagtcttctattatggataatatgtaaaggagaaacaattttctctaccatgacgtacttgcattctcctcagagaaaatgggagtagagcattcctaaatccaagggtattccgctcataggtgggactagattactacgtcttgactctgccaactagcaatttcagggaggacttcgttggctcagcttagacgaccaactttcgtgtgtgttttcaaaagtggatgccttaacttgctagcctgttatccctaagtctgtgagggtggaacctaactcactggctgtccaatccttgatagagcaaaactcagaacaggttatgtaaaaatatagtctggctttagaacttatgttaattcacctgctttgccacagaaaaatggaggctttcacaagggtttgatcagaattaaaacccaaacccgccctctgttaggggtggtctttataactttactgaaacaagagggaagcaactgtgatgggaagagattacctagccttactaacaagaagcattctaatagataaactagtaaccatcatgtaagggaagatgaagccatgtgcatccaacatgtcccgttcagaaaacctcacaggacagacgaatatccggcttttaagttcattaaaggcagcaattcctactcgcttaaggtatgtgagcggcgacccgg

SEQ ID NO: 491291 - DNA, 251 bp, Homo sapiens
  misc_feature (79)..(79): n is a, c, g, or t
  misc_feature (110)..(110): n is a, c, g, or t
  misc_feature (209)..(209): n is a, c, g, or t
  misc_feature (211)..(211): n is a, c, g, or t
attctcaaaaaaaaaaaaaaaaaaaaaaaaaaaaaaagcggccgctcgaatttccggtgacaaaataacgtttactcangagcaatcactcccaaagatgatacgtcagnggatatcgcccctgctgttgcggccagccagttgaaatcgctgcaactgcgaacgcgttaatattcgcgggtcgcgcccttcatgaagatgcgtggcancnatgcctttcagcgcgcatggcatgagcgcatcatcccacc

SEQ ID NO: 491292 - DNA, 209 bp, Homo sapiens
tcatgagatccattccatagtccttcagcttaagatcaatattatgtggcaccagcatccagactgttatctaccatcttcttcacctgcagtgcttagactcagtactaccgtgcccagagcaaatctgatggactgacttccgatcaataggtttgatggccttagccggttcgtattgcaggctgtacatgtgaatgcatgtgctt

SEQ ID NO: 491293 - DNA, 109 bp, Homo sapiens
agtatctacagatgcataggacagtgctgacacagtgcagagtctaaataaacgctgttgatagaggaagtggctgccgagaacaagccggaagagataatgatgcagc

SEQ ID NO: 491294 - DNA, 948 bp, Homo sapiens
cgcccgctccaggctgttcccccgctgccgctccccgcgccgtgtcgtcgcagctcatgtcgaggagaagcccaaggagggtgtgaacgacagagaatgaccacagtcaacctgtaaggtggccgggcaggtactgttccgtggtgcagttcaagatcaagagttgcattacgccgttggagcaagctgatgaagtgcctacgtgcagatgaggcagggcttgtcaatgagggcagatcagattcaggttcgaggtgcgcagccaatcaatagaaatcttgataactccagcacagctgtgaatcaatgaggaggaggaggacaccatcgaggtgttccagcacgcaatacggggagggtgtgccggatatgcagcctggcatggcacagtttctagagggcccgtccccctagccgcgggcctgtccatcctcgcattgctgttgaattgtagagcgacgtgacccatgcgcgacgaagaaaggtgtctatgaggaaagtcgagggagcattcaccgacgatgattttcgctctctttgatgtagcttcatgtgtaattcgaaaattatatctggagggatgaatctgtagcttaaattggtgccaatcagaattgtgtatctttgttcaggtaaaaatgagttgcaagatattggggggtactttgtgtgctcagtgtgtgtatcgcgcccttctagaacatttttttaagcccaaagattataggctgaatgtttcgctttttagctctgggcccgggattttgactcctgagttgggtgcctttccctgttatccagtcccatacagcattggggttcccccgcgggattccgtgttggccgggtttgcggcggtgtctgccccgcgctgtccttggttccgcggccggtgtacatgccattgccttcctgtcgcttgccgttgggccacgcggttccggtcaa

SEQ ID NO: 491295 - DNA, 753 bp, Homo sapiens
ccacgcgttcgggccactcggacctcatcagcttccagcctacggacagctgacatccccaggttcctgtgaggactccaaccgggccaagctgccccggggtatccagcgcaatgtgcggaccctacactgctagaatcatttgatcaacgtgccccatgcatagtgccccattttcaccagagcgttgcaccccagtataccattgtgtgaggatgataaagatcatgcaacgagtacggggggagggtgaccatgctgccttgggcatgtcgtcgtgccaaccactgccgggaacagctgcccctcttcctcccagagcagaattcagcatgtgccctggatccccgtgtacccatcccgtagctcctggaagacctttggctaccgccaccagcatcatcctatgggcccagtgctcggagtgccctttctccccttgcagtctgtcagggcagtcgtcaacatgcctgcccctgttgccacgtgacccttttcgccaaggagggagagcatcacgcgtcttccgtggtatcgaaccggctccgggatggccacctatgcgcttccgtcaatgtgccttcctcttccgtggcgttgcagttgccctgctgcaccctggtggtcatccagttccttaccttgtctggtccacgcctgccgccacttctctgaagataccacccgacttccttgtggctgtctgcttgttgccacccctctggccagcaatctctcttgtggggacgcccc

SEQ ID NO: 491296 - DNA, 201 bp, Homo sapiens
taccgctctgaaagatgacagcaggctcaagggagaatttgtcacagagtgtgcagcagacgtggcgctgcatgtcatcagttgctcgaaaagtatccagctgccatgtcgtgctgctatctgccatactgtgaccacttctagggacatcttggtttggaaccccaggagggacagcttagtgtccatggttgtgggtac

SEQ ID NO: 491297 - DNA, 163 bp, Homo sapiens
atcaaagcagtggacaagaggctctggagctggcaggtaccagttccagaagctcagaggctaatgaatattatcctaatacctccacccactctaatcagtggagagacgtctcagactgttgtacatggccattagttgagtagtaaagctgtatgacaca

SEQ ID NO: 491298 - DNA, 992 bp, Homo sapiens
gggtatgaagaattgtctagacctgatatctatatacaggttagctagaactccatatgtatctactgctatgattttggcttggcaagtgcaacaggtatagcccgtgtcacacgcactcagaggatcaatggtaatgcatatatattcgacggcaatgactaatatgactgtgctactaggtgagcgcatgtccactaagagggaaggatactgactcaattggtaattactgtgcactgggaaagctgatcaatacaatacggatatcacgtccagctatgaatagggatcatagaatatatccatataattcaagtaagtgaccactgcgatatggattattggcattaagggaaatgagaactgagctctgctgtgtaatgagaaaaaggattctaataatggtagaatacatatatgtgggattttaagaagcagggagacattacatgatttgattgttaaaattgtgatggtcatggtgatagcagtcatgagacgtgtatggtatacactagtatatgctcacgtcataaaaaaaaatagtgtacgtgtggattagtcgttcataagtttttataattcgatatggagatgtacgataacaataagtatcgtattagggtccaaagaacgagatggtgttggtgtccattactagtggttgggatgaatttggtgcctacattgtgcaaatactgtcatgatgctaagtaatcaagagtggatgagtccatgttcatagggaggggagtcacgcaatcaaggcttgtgggaaatcggagaaagctttgtctgaataatggggaactgttataaaagaagctagtaaaggaagttagagtgcaaagaaagaatcttctgtagaccgggtctgtgttcaatgaggtggcatggaatggggaaaatttggttaagcgctataatggaaaggtcacgggggttttaaaaaggcaagagggggggacaaccgttaacagggaaaaaag

SEQ ID NO: 491299 - DNA, 116 bp, Homo sapiens
gacctggtataccacccatgatcgcaaagtatattgtggacgatttaagtctcgtaaagaacgagaagctgaacttggagctagggcaacaagaattcaccaaatgtttacactca

SEQ ID NO: 491300 - DNA, 143 bp, Homo sapiens
tcttaacaccccgtcgcacgaccctttcgttaggaatgtcctctggggattaactggtccaacatgtttgtcgaaacagactctgagtcctgggacttctccacatcattgacattccgaaagtactgacgtctggaagatta

SEQ ID NO: 491301 - DNA, 802 bp, Homo sapiens
agcggatccatccttcttccctatccaaatacttcgttctcagtgggcagtcagatttttttggcttccaaacctcactgagcatgttcagagaattcctctcagttaaggaaatatttgttccccacaatggtctgatgtatgagtccgtctcagaagcacaagtgcatactaggaaggctttgtaaactggttttgtaggcaggctgtacctgcaaataggcattctgagcaaggatcctagatttcccttcggctcatgtccctcctgactcaaccgacattctcctttttggcatgtctggtgaataagctacagaggttcacaggggccaaatattctccctttatgtactctaatacatgttgcacacataagactcaagggagtgatttgcggttcctaagtcctagggagttctgattccatttattctagatgtcccttttaagggaggagatggtgttgaacgtgtgacatgctttagatgataactgctttggcaattccgccagacaggtatagctgtcttcagtccaaaagtggcacctaaggtttcatattagacaagaagtggttcgcttagtgatccactgatctctaatcagaaatatttttaaaaaatacaattgagatctctgacacatgggaaccactcaagagtatcatctagatagtgttacttcacgcatatgactgacctgatcttatgaaggggagtctagcctgacttttccctgtagaccctatcatagtcagaacaaaaagtggtcacattgaaagcagcagggaccaaagggc

SEQ ID NO: 491302 - DNA, 197 bp, Homo sapiens
  misc_feature (121)..(121): n is a, c, g, or t
  misc_feature (139)..(139): n is a, c, g, or t
  misc_feature (172)..(172): n is a, c, g, or t
  misc_feature (195)..(195): n is a, c, g, or t
actggtagttagacaggcgcgtgctcactcctgtaatccagcatttggggaggcgagcgggtggatcatgagctcaggagtcatgacagctagcacagatgggtaaacccatctctactanaaatacaaaattagctgngcaaggtggtgcctgcttgtaatcccagctacntgggaggctgaggaggaattcgncc

SEQ ID NO: 491303 - DNA, 1008 bp, Homo sapiens
gtgacgcgtgggtccggggtgccacccgtgcgggtacgcggtccgcgcgcccctagccaccgtcgcgtgtcatcgtcccgagtcgcgttggctcgtggcgcttggctgccgggcggggtgcctggggccgcgtgacgcgtgggggcgcgctcggcctgcgctcatcctttagatcggaagaatgcgggcggggtggcggtcgcttcggggtccctcagctgatcgcatcctagggtcgatttctcggtgcggtgctgccgctggccctgtgcggatgccggtgctcccttgtgagtgccctcgtggaggtggtgcttgggacggttcttgatctacctacattctcgttccgtgtcgcccgtgttgtgggttgggaaatgcccgggagtagtaggccctggatcagagctgacggggttgcgagcggcgtggggtgtgcctgggacggtgaccggcatgtgtcttcctgaaatcgttgtattcgagctccagttctctctgtttctacagctgggcctcagtcctcacagggctctagtgggcgttcagccacaccaggagaaggcgcccaggggattaacaggacccttccctctcctgcctcttcccctcgccccccatggtccccctcctcctattaagtaggtactttctccagcaccccacagcgatgagggatgctgggcctaaagtccaggtgggagaacccaggcggaattcaggcaccctgtcttttccttgttagggggggttgcccagggctctcagaagtttggggcagcgtaatacagggggttaccgggggtacccagaaccgcattccacacatgcatccctgtttagggcactggcgcccttgactgtgtggatgctaagataaggggggccagagccaaattggaagtgtctcttttaacgcaccatggttaagagttccgggacaccggatggttgatctctaccgtttcgtaagcaatcctaagtacaccatgacatagaagtaacgga

SEQ ID NO: 491304 - DNA, 562 bp, Homo sapiens
cggttgcgtcgtcgctggtagtgtactgctgcgtgcagcgctttaggactattgcgggtcgctaccaccagcacgcggaaaccgtcttcgttgtaatcattggcgagcgccagtagcgcttcactgatggtggtcatccaggtgcccaggcttcgccggcctccatgacatgggtagaaatgctcagcatctcttccaccgcgcccttgcataccagcaactggtcaccggcggcgtccttgagcactatcgacaggcgacgacggacaaagtcgcacggcaattcatcgaccttgctgtaggcaaacggcacctggcacttggggtttcgttccgagaactgcaccaccgcctggtccatcaggtttatcatgccgctctggtgaaagctgttgagccaggccagggacagcacggagtcatcgcgctggccaaaggcatcgacgtgatgctcgaggatgatcttgtcctgggtgccgcgcaaagattcgaaactctgacgcggcgtacgcggctgatggcgtgcgagtccaccgagcatttgctccaggtgatcaatgac

SEQ ID NO: 491305 - DNA, 135 bp, Homo sapiens
ctggcttgctgtaagtgccgcttcttcttccgaggactcatctgtatcctcctggaattggttgaaggttcaggctggggggtgctactagagcactggtactcccttggagggatggaagttgtccccttttgt

SEQ ID NO: 491306 - DNA, 1238 bp, Homo sapiens
  misc_feature (587)..(587): n is a, c, g, or t
tcaaggtaaaaaggaatgttaaattttttttccagggattcaggggagtccataaatggcttaccaggggcaaaatatcagcccagggtaaaggcaattcctggggaggaagcccacctctggccctaacagcagcctcgggaaatccaaaataaggtgggtggatgttctggccagggtttggctaactggggcgagcacattaagaaccaattgggagaaagtgtgtgaaaagaggtgagttcatagtgttctccctctcgagccactcccacaagtgttatcaccccacgaggcattagacagccctatagtgtggtagagtctcagcaaactcattctccgtgaaccttgtgccagcatagaggacccaatcttgtgaacatttatacgcgagaaacgccaaaactgtggagaggggtgtataccccataaagtctcgcgacaagtgtggccacatgtgtgtatattatacccccttgtgtgcacacatgtgtgtgacacaacatcccagtggtgtgacgcgagatacaggtgtgtggacgacacgggtgttaaactctctctctctctctcacacacacagncgtgtgtgtaagccccttgttgtgctctccacaaaaacgggcacagagtcatccgcgtgtgtcacaaagaagtgtgaggagaaagaacagattgtggggcacaagactaccacacaaagagtctttgtctcctcaatatatcacccgctcttccgagtagcagtatggcgcccacagagagcatcttagatgtcatcaaagaagtgggagacactccagtgatgacaactgtgacacacacccaataagaaacacagtgtgtggttgtgttcgccacgaccgtggggtctctcagtcataacactctctcaaaaaaaagcagcgggggtcctcccctatgaaaacgggggtaacaacggcccgtgggcgaacactgtgggtcctagtggaacagtttacaacggggaggggaggggggggcggcgacccacatacagagcgtggtggcctgattgtctgttggcgacctccacccgctattaacaaaaaaccgccagacaagaaccacacaaacatattacagcaaaatccttaacgagacacctcatcccaacaaacggccttatttaaaaaacgggttggtgccacacacacgccgcccccaccaataggtagtaggacaaagattctcacaggggacgagcacatacc

SEQ ID NO: 491307 - DNA, 205 bp, Homo sapiens
gaggaagggaggcaggagttgcgagttatcgagtgtcaagaggattcatcagcgaaggccctttgggttgaacagcacaggggtgcatatgtcgctcttcaccatgccaggtgtggtgcagaatggaagccagtagtatagagcacatatagtgttgcaccagttgtggccgtcgtgcagtcgtcgcccttctgtcgtcttctcg

SEQ ID NO: 491308 - DNA, 160 bp, Homo sapiens
caacagcaagatgcacacagatggagacaggccacaggacaggctgaggagtgaataaagagttcacactgcttcccatgaattaccccagtagacatagaaggctctcaggccagcctccgtacctcagcgctacctccatcgaacatcgaccactcct

SEQ ID NO: 491309 - DNA, 282 bp, Homo sapiens
cccagagcgataaacaaatgttgacttcgctctactgtgactcataaatgcagcaagtcatacaatacaggaattgttcaccatgatgagaatcattcatcttctagtgcgggaaacatgattgaagcctcttctctgcttagtgccacgtgtaacacattcatcacaacggcttgaggaatgtgtgaaagaatagcccaatgcccaggtttaaaacctggagatgtttcaacgtggcaccatcccggatccctttaagtttctcctggtgttcaccttctt

SEQ ID NO: 491310 - DNA, 323 bp, Homo sapiens
  misc_feature (75)..(75): n is a, c, g, or t
  misc_feature (85)..(85): n is a, c, g, or t
  misc_feature (93)..(93): n is a, c, g, or t
  misc_feature (95)..(95): n is a, c, g, or t
  misc_feature (125)..(125): n is a, c, g, or t
  misc_feature (140)..(141): n is a, c, g, or t
  misc_feature (149)..(150): n is a, c, g, or t
  misc_feature (166)..(166): n is a, c, g, or t
  misc_feature (189)..(189): n is a, c, g, or t
  misc_feature (212)..(212): n is a, c, g, or t
  misc_feature (214)..(214): n is a, c, g, or t
  misc_feature (229)..(229): n is a, c, g, or t
  misc_feature (236)..(237): n is a, c, g, or t
  misc_feature (253)..(254): n is a, c, g, or t
  misc_feature (298)..(298): n is a, c, g, or t
atcatgatactaaacgtacacataactactacgtaataataaacataggagacactcagataatatgcccaatangacatcattnagtctttnanatcttctcttcctctttatgggagagtatntctagacactaattnncccatctnntattcaactatagganacagattccacaaggtgctttanttgatgagacctcaagtgctgtntnctctcttgaactttnggatagnnaaacagtccatagggnncacacacaatgctatgacagaagagttgttacattaagtctttncatgggacttgagtattgtataaag

SEQ ID NO: 491311 - DNA, 847 bp, Homo sapiens
  misc_feature (3)..(3): n is a, c, g, or t
  misc_feature (89)..(89): n is a, c, g, or t
  misc_feature (92)..(92): n is a, c, g, or t
  misc_feature (99)..(101): n is a, c, g, or t
  misc_feature (114)..(114): n is a, c, g, or t
  misc_feature (210)..(210): n is a, c, g, or t
  misc_feature (228)..(228): n is a, c, g, or t
  misc_feature (270)..(270): n is a, c, g, or t
  misc_feature (282)..(282): n is a, c, g, or t
  misc_feature (292)..(292): n is a, c, g, or t
  misc_feature (303)..(303): n is a, c, g, or t
  misc_feature (317)..(317): n is a, c, g, or t
  misc_feature (319)..(319): n is a, c, g, or t
  misc_feature (321)..(321): n is a, c, g, or t
  misc_feature (324)..(324): n is a, c, g, or t
  misc_feature (333)..(333): n is a, c, g, or t
  misc_feature (354)..(355): n is a, c, g, or t
  misc_feature (358)..(358): n is a, c, g, or t
  misc_feature (363)..(364): n is a, c, g, or t
  misc_feature (366)..(366): n is a, c, g, or t
  misc_feature (371)..(372): n is a, c, g, or t
  misc_feature (374)..(375): n is a, c, g, or t
  misc_feature (380)..(380): n is a, c, g, or t
  misc_feature (389)..(389): n is a, c, g, or t
  misc_feature (393)..(393): n is a, c, g, or t
  misc_feature (395)..(395): n is a, c, g, or t
  misc_feature (399)..(399): n is a, c, g, or t
  misc_feature (401)..(402): n is a, c, g, or t
  misc_feature (421)..(421): n is a, c, g, or t
  misc_feature (445)..(445): n is a, c, g, or t
  misc_feature (453)..(453): n is a, c, g, or t
  misc_feature (468)..(468): n is a, c, g, or t
  misc_feature (495)..(495): n is a, c, g, or t
  misc_feature (510)..(510): n is a, c, g, or t
  misc_feature (512)..(512): n is a, c, g, or t
  misc_feature (518)..(520): n is a, c, g, or t
  misc_feature (533)..(533): n is a, c, g, or t
  misc_feature (535)..(536): n is a, c, g, or t
  misc_feature (546)..(547): n is a, c, g, or t
  misc_feature (552)..(552): n is a, c, g, or t
  misc_feature (554)..(555): n is a, c, g, or t
  misc_feature (563)..(564): n is a, c, g, or t
  misc_feature (581)..(582): n is a, c, g, or t
  misc_feature (588)..(588): n is a, c, g, or t
  misc_feature (629)..(629): n is a, c, g, or t
  misc_feature (636)..(637): n is a, c, g, or t
  misc_feature (642)..(643): n is a, c, g, or t
  misc_feature (657)..(657): n is a, c, g, or t
  misc_feature (668)..(668): n is a, c, g, or t
  misc_feature (728)..(728): n is a, c, g, or t
  misc_feature (730)..(730): n is a, c, g, or t
  misc_feature (748)..(748): n is a, c, g, or t
  misc_feature (752)..(752): n is a, c, g, or t
  misc_feature (782)..(782): n is a, c, g, or t
  misc_feature (842)..(842): n is a, c, g, or t
canacaaaaagataatcacaataaaatatacactaaattaaaaaaaaaatagattatagttgtcataaaatgttatattctctttttangtngggtggnnntattttgtttgcntctacataaatttctattcatgagagaataacaaatattaaaatacagtgatagtttgcatttcttctatagaatgaacatagacataaccctgangcttttagtttacagggngtttccatgaagccacaaactaaactaattatcaaacacatnagttatttccanactcaaatanatacacattcnaccaataaactganananaancatttcatnttctctttcattttgctatanngcnttttnnantttgnntnnatgcnaagtgaganattntntttntnntccttttaattgaactcanaagatgcactatctaattcatganatatacgnaatttcaggtgtttntcttcttccttacttttggcgtctacnaccagcatatcttcntngctgtnnnattcatggctgtngnnttcacggctnnctttngnnagttcctnnctatcaatcacatcggnntgctcnttgctctcatcattagctttccgcttatataatctggactnctttttnnttttnntttcagcactcttntcatccagctntctcgtttcataactgtccttcccacggctgtcccaatcagaaggcgcgttcaggtcctngngcaacggggatggccttntatncaccattcaactcctcgctttccatgtgtnaggtgatgtcctcgtctgttgcatcagggtactggatgtcaggtctgcgaaccttcttanatttt

SEQ ID NO: 491312 - DNA, 1022 bp, Homo sapiens
agcgggggctggaggtgccctgccgggggtgggggtgggctgcggggagccccggggggatggggagcgggagcgggcgctgagtcaacgggcgtggggtccctcgcggtgtgctcggggagcgcagctagcgacgaggggagggggccagtggtgaggacgggtcggcggaaagcagccgcggtggtggcagacacgaggggacgccagggcggcacagaggacaaaggggattagaccggggctcacggtgacagcaacagccgagagaacccaatacaatccggagacgagtaatcgaccagggaaagcttacaagcaggggctgaaattgtagattagactagaatgcccagaggaacacagacccaccgaagatcttgcacactaaatacatagtaatcgcctgtggtcaccaaaacgggaacacaatgcattacacattaatgtgacattaaacattaaaattcccatgggagacctggggagaatagaagtccaaccacatatccacgagacacgtagcaccagaaagctacgacttacacagggagaagaccattgcgagaccccggcgcgagaatggataccaacagaaacacgaacaaacgacacagagagaccccagcatcgcatagagccagaacggagaaagaaaggaacaaggtacaccgtcccaatagactgaccaaaatgcccaaccgagtagcacagcaacaaaagggcgcgggacaataaggcgcacacatgcgagaagcacaggggatccacaaacgaccggcaaagagtggagcgtcataggccaggaacggaaacagccccaaagtgcaaaaacaacacacagcagaacgacaatgtagataaccacacaaagaaaacttaacaacgaggaaagaagagcaaagaaactagcatcgaagacgccaacaaacagggctaaaggcaaccaaggggtctaagaaagacgaatacccagacgagaccgggaaacaccaacggatgcactagccgacgaacacaca

SEQ ID NO: 491313 - DNA, 440 bp, Homo sapiens
caatcgacatttccatcatttgggtgcacttgtgtcagctcgtcctcatgggcgagtccatctagtcgtcggcctgcaggcgtggtagtgtgtgcctgagcgacgtatgtaacccttagaactgcccagcaccttgccaggcacagtggctcactgcctgacacttggtgaggccacggcgggtggattgcctgacgcccaggagtttgagacaagcctgggcaacatggatgaaacccccatctctactaaaatacaaacaacacgtatctgggaccttgctgcgtgcacctattaatcccagctactcctgactgctgacggccagagaactcgcttgaaacccaggacggccgacggttgcactgacaacccggacggcaagaggtatgcacgcgacgccaaagatcgtacccgcaggcactccacgcctggggtgc

SEQ ID NO: 491314 - DNA, 322 bp, Homo sapiens
caggcaacagagcaagactctgtctcaaaaacaaacaaatgaaatttttaaaaaattaaatcaaattaaaattttaaagagaggccaggtttggtgactcacacgtgaaatcccagcactttgggaggccgaggtgggtggatcatgaggtcaagagatccagaccatcctggccaacatggtgaaaccccatctccaccaaaaatacaaaaattagctgggcgtggtggcacctgtaatcccagctactcgggaggctgaggtacaagaatcacttgaaccggagagatggaggttgtagtgagctgaagtcatgccactg

SEQ ID NO: 491315 - DNA, 132 bp, Homo sapiens
tccccgtcgctatcatcggcacctccaaaccacgttgttgtaactagctggtcctgcttcatctagatttcacggccaacctcctgaccatgctgtgagatgtgtctggcgacctgtttggctgtcactgct

SEQ ID NO: 491316 - DNA, 195 bp, Homo sapiens
gttatttactcgccaggtatgtggctcatgcctgtaatcaacaccttgggagcagaggtggatggatcacctgaggccaagagtttgagaccagcctggcctctggagttactttttacatcagaactggtccatagaaacaccatcctggccgcacagccactcccctcgagtttgtggcgagtgaaattacgg

SEQ ID NO: 491317 - DNA, 311 bp, Homo sapiens
  misc_feature (9)..(9): n is a, c, g, or t
  misc_feature (103)..(103): n is a, c, g, or t
  misc_feature (127)..(127): n is a, c, g, or t
  misc_feature (157)..(157): n is a, c, g, or t
ccccccccntttttttaccacccagttattaggggggctgtaaaggtattttgtaaggtgattaacattccccccccaccgtgctttaaggaagagattcctnaaaaaattgggtagctgcccctgnatagttgaaaggcctcaagaacaaaccccngcaggttctggaaaagaagaaactttgcctcaagactaaacccatcgactcccccctgagtttccagcctggtagtttgccctatggatttgaagtttgccaccccccacaattgtgtgaattaatttttaaaaataaagctatatacagccca

SEQ ID NO: 491318 - DNA, 380 bp, Homo sapiens
tctacatatagtaacagctgtcatatccactcagtccatcttgttcttcattattatagctatctctgtgatacaccagtattcttactgctagccagatgtagaaaagatcacttcttcttacagaaacattatctcttagttatagaaggcatcttaatataataaataaggcagaggctttgaagttgactgggccagtatggaatatcaggttctgacacttttctctgtgaccctgggcaaatcatatagtccaggtctcatctttctcatctgaaaagtgggaatattatttctcttaatagctgactgaaaattaaaagacataaagtaaggaaagtccctaaaatagcatctaacaaatggcaggtgcaaaa

SEQ ID NO: 491319 - DNA, 1334 bp, Homo sapiens
  misc_feature (715)..(715): n is a, c, g, or t
  misc_feature (761)..(761): n is a, c, g, or t
ccgccctcctcgcgctcgtgtcgtggttgcatagtccatttgtggccctctcgtttcccctggcggcccccctccacagccgttggtttgccccccccatgaggagccccgggcggccggtatcccacctctcggggatttttccctctcagccccgggggcccgggataacccgattttcgccccccccggcgcaccccagctttttgcccccctttagcccctctaatttttgggcggcccactgttatgaggacacaaaagatggtggaccacgaagaagccgccgggttggtgtacccgggtccccgggaattttccccggggatttttggttcggaccccccagcggttctccgggccccaagggagccccccccagggcccccttatgtggccagccccattggcggccccacgccccgggaattgggcaatgggtcctttggaagccccccaccgtggtccaccccagggacctgggcaaaccgggccgccggtgggccacaccgtggggtgtcaaaacaccaacgcgccgggcaccccgggagaggagtccccgcaagacgcatataagggcccccccggccacaatctcacaagaggcggcagcccgcaaattctgcttcacagcggcccccccgccgatttcgggggtgtccccacattccggggcaccactttcgcttggcgcgcttgcccccccacccgcgtntttcgggtatccacccaccacgaaaagtgttgccgcgcgcaccgcnggccgccgcgtctttttcacgccctctgcgagaggagagtctctcacgcggttggccccgcgcacatttcacaccaaggagaaggtgtgcccccccggagcacacatctggcacatttctctgggggagatccgagaggagaggcccggagaacacacaggtccaccgggagggtcccctgcacaggccacaaaccgtgcacagccggcctgaaaggagagtatccgcgcttcccaaactcaatccttctttcccccgggaaagccctcggcccccccaagaaagggagagaccacgtttctgcctgaaagagaactgaaaactggccaccccacgctgagaccggagccggttcaatgcccgctccggaaacgtctaataagaaaggaggaaaggctcgaggtcactcacctgagggaaagagaaagaaatttccaaagccttcgctagttctccgtatggcccgtgcccaacgcccggcttttcggcaaacgggccaaaagagcccaggagaacccccagaaccggatgttgaaaagaaaaaataaagcccccctggggacttgggatcca

SEQ ID NO: 491320 - DNA, 1053 bp, Homo sapiens
tatgcacctgcgtcgcaatgtggtcaaacaaagtttactcctgcagtgatatactatctgatcatagtttgagttcaacgcgcgcggcttatcattcgctcgtaccctgcgtcatgtactgttattatgcgacttttctccaaaaatgccatgtaagcgtactaacataagagtgcttcatggcgcatctagggagcgcgtaaaggggacttgaaacatatcctggatgcgcacaattgaccttatgccatcgatgcggcaccatcttcatccaacgtattccactcacgtatctattaaacagaacagtgggattaccagaatcccctacgtgtcttaactgtcaaattcaaattagtcatgcatgtggggacttgcacccgttgcgagagtagacctgatacaaggggggatgctatgcttttcacctccgatgccttgtgttcaccgcgaatgtctcccttatgatgtcacagatgtcgagacatgcgcagtcctcttgcccaattgactccactcagcggtacgttctacccacgtgtttgagtggcacccttgttcgccgttaataacttgacgtcacgatgaagtgtggcatcttcatgttgtatgtccacccagtatattcttactcaacgcgatgacgctgcacttggaagccgccgacatcaattgtcacttagcacagctatacgcatcgcagtatatggtgacgtagagtgcgctgccctcggtggtgcacccattgttgcctgtaatttactataactgcgtccttacagcctgtaaaggtcggggttaactaagaggcgcattggcctgtgaggaatgtgtcctacagatcacaaacatttgcgtgagtgacttgtcacaatatacatcttgttgcaccaaatacgtgacactagctgtcatacaactggaccatagggggcaacaaccggggtcccagatcaacctaatgggtatcgtctacacgattatcaaacccgacagaactacaagaaacagagtccgtgtatcagtgcttatattacgcagttcgtcatcatt

SEQ ID NO: 491321 - DNA, 371 bp, Homo sapiens
tcttagccaaccgaaagtgtggcgaatggtgggaggacgacgtgaaaattgcacggcgagtagggcgaaaagcagggcggcagtatcggtcaacatatgacccgcatcggccagcaatgccagagaaccagaaagaaaaccaccaacgacttctaccagcataaacccggcagtcacgccgaaagcatacaacaagcgacgagcattattatcttctggcaggtgtgaggacgtgtgtgagtgtgagtgcgccatgacgagtcatcccttaattattctcacttaactttatgacatcatactgcttttagaagtgaaaaattaaaagggagagactccgctctcccattattggctattttgcagggtta

SEQ ID NO: 491322 - DNA, 833 bp, Homo sapiens
cacgcgtcgggccggcaccacggggttatcgaagcatgctgtcagatgctggggtccctggtgttgaggagaaaatgcactggctgccaccggctactcctccggctgctcaggtccccaacgctccggtggccatggagtgtgcttccgtgccggaatgtgactactgggagtctcgtgggagccgctatgtgtgctgaggtgtagccacctgggtggtgcgccctggaacatcgccggccttgttctccgtgacgtgtgggcatgccaccggggggctgccagggatggacgcttcgataccaaatgcctcgcgagctgcacactatggaggactgccttcctgggtcccgaagaaacactcccaggacatggacagctgagaacggggtccccagcagggccggacctgggcatgtgcgcccatggccgctagcgactggtggttcatttgctcacagcaagagtccgtccaacaaggatgacagccactgttggaatgcttgcccgtgccaaccaatatgcaagaagtcagcagagctgtagctcacgaaggtgcagatgtccattgcaaaagcacagactaggctcggacagcacctcatggtggcagccacacacaccgaaacacaacacagagctggcacaacggaccaggccaggcagcacggagctgaacgcaacaccctgcgagaagaatccaacacgcgacacccaaaactgcccaccacacagggacacccatcctgagaacaccgcagaccgacaagatgatcacaacagagaacaacggcaaacacgcagcacagaccagaaccgccacgcgaaccacc

SEQ ID NO: 491323 - DNA, 360 bp, Homo sapiens
actgttggaggggcctttggggctgcccctttgtttggagtcactgggggcttccaagggtttccccccaccctcttttgttctgggatggctgtcgggaactgtatcccctgggttttgtcccccggctttgtatcaggcccttttttaaaactgggccccagtggggggggtttttttcctgcttttttggggcctggaaggaaagggcttccggaggaggcttttgggctggaggggcccaatggggggggcccccccctacccctttccccctggggtgatgggtggggggggtggctgcccccaacttggtttttttattttttgttccggaataaacccccctccgctccggga

SEQ ID NO: 491324 - DNA, 403 bp, Homo sapiens
acataggatattggctgacttcctgcttgtcacaattgctttttgccttcttctgtctctgcctttttagttcccaccctcccactttcctattgtatccttgtctggtaacagcattccacattactgtaattgttatttgtgtattgattccccttcacatgctctacaaaaatactaagttctattgaataccatatgtttctgccattcctctccccgtacttcctaccattcacattcttctttattctttttatataatttacaccaaaatttgaacatacccaacttattatttcaatccaacttcatcaataatgtgtcaagtcaggaattctttataatagtactgctacaagttgtactaaggagattcctttgtcagctactcgtctgacaa

SEQ ID NO: 491325 - DNA, 1553 bp, Homo sapiens
ttgtcttctcatagtatacacagatttgcgtttgggtttttgtgtggatgcagcacacgaccagtctgggggggggtgctctgccacttcgtttgtgtgtgatagtcgacctgttttctgcccgacaagttttttgccctcgagtggttgccgcccgtcctgtttgttattgggtgttgggtgggtagtacacggccgcccgtcctttttgtgtgggggtgttactcctcgcgggggttgtgtccgacgacgggtggggggggggttggtgtgtgggtgccccgtggccgtgtggtctgagccctgcttttggtgttgcatcacagctattttggtgggtgacaccaaccacatcagtacggctccgacccctcccttgtgtgtctcgcccccttctctgcgtcgccttcttctgtcgggtgaagattttttttcgtgaggggaggagaccaacgagtagcttgtgtgtgggggtgatattattgtgtagtggtattttcgcctcggcttcgactccgtttgtgtgtgtgtcgccccccgagttgatgagggcgctcccccacagggggtccccctctttgtgtgcgcgccccccacccccttctgagagtgtttgtgagctttgcgtgcgctctgttttgttctcccctcgtatgcgcccttcttacgtgtttgtgcgtttgttcgctcgcgcgcgcgtgtcacgcgccccacgtttgtgctctcgcctctctctctctcagagatggtgggccgcacccccgagttttagcccagagaggactctctctcaccttgtcgcccgcgttctctctctcaacaccaccctctcttctgtgtgggtctctctctctcagtgcgtccctctctctcacgagatttctgtgtggggtcccacatctgtgtttttctctctgtgttgtaccacacacactatactctctctgtgggcacacacgtgtgtgtgtgttgtgtgtgtttttgtggtgtgttcacagcatgtgtgtgtcccacatctgtttttgtgcggcacacatctcgcgcgtcgtcatcattgttgctgtggacgcgtgttgtatacacacgagcgcgcgcacacatatgtgttctaatctctctctctttgtgcgcctctctctgtgtgtttgcgtcacaccacgagatctctccctctctctctctcacagagatatatctctctttttgtgtgtggtgagaagagagagggcgctgtggcgcacactgtgcacagagggtgtgtggagagccgcagcgtataccccacagcttcccacaagcgcgagaagagtggggccctcgcccctcataggagagctgtcacgccacagagagggagagcaccaagaggggccccgagaattgagaccacaaaaagaggggtaagagggccacccccctccccccgttttcgttggggagaggggtgataccaccgagatttgtccccaccctcggggctcccctctttgggtttctatatttgcaccttataccttgagaatataaaaaaaaattccctttttgggaaaaat

SEQ ID NO: 491326 - DNA, 160 bp, Homo sapiens
ggaaaaggaatcttaggaggagaactttgtgagcaggtaatctgacagcccaggaggtgggctcgctgataggcatgaccttccttaatgcttaaagtcttcgggcaagactttttatcataagactttctacttctctcggtgtcttatattacctact

SEQ ID NO: 491327 - DNA, 614 bp, Homo sapiens
cgtggtggcgcatgcctgtaatcccagacactcaggaggctgaggctgcggtgagccgagatggcaccactgcactccagcctgggcgacaagagcgaaactctgtctcaaaaaaaaaaaaccacaaaacaacaaaacactttaagaggcaagaccgggctgtaagatgacggataacaaatagggaggagtccacccttataaggaaaagattgatgccagtgtggagactccagaagattatcttaccctgctaaaatatgtgcgtgggactgacgacaggtaggacttgtgatctgtccatggtcctgaacctccatgaactgttggacaatagtccatcctacctgtgaaatactgatgaccttcctcaaagttcccggaggaaattctcagaataagccccaaggaacagactgcaccgaacccaggacaccaccaaataaacaaacacaacctatatttacccaaagttctctgggaacgtcttttcccctgtggaaaaattgcccggtttgggcactgggagcaggggtcgggggcgagacagggttccccgggtcggcgaacgctccaattttcccgttttccccagaaaaagataaacaaaacaa

SEQ ID NO: 491328 - DNA, 275 bp, Homo sapiens
tctagaggatcctgatcacgtgcattgtgagtgaagaagtatatcggtatgtaaagctctatcagcagggaagaaaatgacggtactgactaagaagcccggctaactacgtgtcagcagcgcggtaatacgtagggggccaagtgtaatccgggatttacttgcgtgtaaaggggagcgtagacgggcgatgtaagtctgaaggtgaaagcccaccggttcaactgtggggactggctttggaaaactaatatagctagaagtatcggaagggg

SEQ ID NO: 491329 - DNA, 210 bp, Homo sapiens
tggtgtgtggtgtcgtctgtgaatgctaagtccatcaccctttccggacattgcaaataaacagctatttaaggggagcgctgttacggaggcgctcgttaggaggcgctgttagggctcgttacggagggtgttacggaggcgctgttacggaagcgatcgttacggacgttacggaggcgctcgttaccggagggtaaccgcagctag

SEQ ID NO: 491330 - DNA, 248 bp, Homo sapiens
agtgttgctgattggtaatattttgccgttaacgttgtgattagaaaaaaatacataattaggaggtgcaatatggcattttggtattattatgatagtggtggcaggtaacagatatcaccaaattctgccctgccattcaattctattatttacaggattcctaagtgcactgtacacactacaaatgttatcagaaaggagttatactttatgagttacttcactagcacaataagtaggtatcg

SEQ ID NO: 491331 - DNA, 418 bp, Homo sapiens
gtcgacgttctccggcgcgctagggctgaagtcgtgaaccaccgctgccggtccgagaactggctggtggcataggaccaaatataagaactgtgggttttcttagttcccggcatgagcatttgcacaggtgtctcatcggcttgaataatctgctgcccgagaaccacgtcgcgcagcatcaaccagcggctggaactgaaccccagtcacggccatctggcagccgtcggtgaggctatgcacgctaactcctcctctctttctcttcgttaagtagcatcagccatgaattcattcaaaaagaccgttcaagtcattgcactcgttgcaacgctaaatgcagcctcattgttacaggcagcgtaatcaattgccgtctacaaagcccctaactgtggctgctggaccaggtggg

SEQ ID NO: 491332 - DNA, 371 bp, Homo sapiens
atggctcctgcgtgtaattccagcactttgagaggccaaggcaagaggatcgcttgtgttcaagagttcaagaccagtctgggcaacagagcaagatgctatatctactacaggcatgcacctgtagtctcagctacctgggaggctgagagaagaggattgcttgagcccaggaggcaacagagagctgattgtaccactgcaccccagccaaggcaacagagaccttgtctctaaaaaacaaaaacaggccgggtgcagtgtcttatgcctgtattcccagcactttgagaggcagaggcgggtggatcatttgaagtcaggtgttcaagaccagcctggcaaacatgatgaaaccctaaaatacaaaa

SEQ ID NO: 491333 - DNA, 350 bp, Homo sapiens
aagatcagtgtgtatcagaaccaatttgagagaaaattgcacacgcacacacaatatgaaaaatataggcctgttgcggtggcttacgcctgtaatcctagcactttgggaggccgagatgggtgcattgcttgaccccaggagttcgacaccagcccgggcaacatggcaggactcccatctttacaaaaaatacaaagcccagtgtggtggtgggagcttgtagtccttgctactaaatggggagcgctgaggttggggagtcgcctgagcccaggaagttgaggctgcagtgagccgtgatcgctccattgcactccagactgggcgactggagtgagacctttcct

SEQ ID NO: 491334 - DNA, 303 bp, Homo sapiens
gaaccttggagccatcaggttactgttggaaagctgatgggagatgccgtaagagaaatgggttcctattctccagtgcatttcaactggccatattctcagcagtgaatgatggaggcagagctcagagaagcacgtctgaacacgtaaggaccgagaggcgagtcttcagtgaaacacccacagagagccgtttgccccttgagattcctgaggagtgtggagagcaaagaagcaaacccaatgagtcacagtgtaaattattcctattagtcagtgctatcttataagcacacatacaca

SEQ ID NO: 491335 - DNA, 249 bp, Homo sapiens
tgtcgctgctgtccgtgtatatgacggcagtgcatcgatactatagtctttgctttacatgtgtacaacgacggcagtgaatccctagtcatagttatagcttttaacctaggtgtaaaacgactgccactgtataactacctcatagtaaatatcaatagtcgaatgtcatacgagtactggtgagcactagtcttttatcacaggttgaacctgaggaggatgaactcttgagattaagtatctgta

SEQ ID NO: 491336 - DNA, 543 bp, Homo sapiens
  misc_feature (167)..(167): n is a, c, g, or t
agcggggccattggctggtgcgggagggggcgcgcacgccggcggcgggaggggccgtcacgtgatgtttgggtgcccgccccgcccgcctcgcccgccgtgagcgcccggagcggtccgcgagccaccgaggcccagctcagtgtggaggctgctggccctgccanctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctatttgtcccaagggccaggaagcgagggcctggggttgcccctgaaggcagcggatgccggagcccacctcatcaccaccattggcccgaggaaggactcggttgctgggcccatggccggatggcggggccagcgctacccgggcacgaaga

SEQ ID NO: 491337 - DNA, 107 bp, Homo sapiens
gtttgtttgttcaacgattatagtcctacgtgatccgagttcagaacgaagtaatccaagtctgtttctatctacttcaatttcctccctgtacaaatgattagaaa

SEQ ID NO: 491338 - DNA, 126 bp, Homo sapiens
gtttatttggcctggctttctattagctcttataatgattacacatgcaagcatcccgttccagtgagttcacccttctaaatcaccacgactcaaaatgtggacaatgcatcaatgcactgcagc

SEQ ID NO: 491339 - DNA, 139 bp, Homo sapiens
  misc_feature (102)..(102): n is a, c, g, or t
  misc_feature (112)..(112): n is a, c, g, or t
  misc_feature (133)..(133): n is a, c, g, or t
cggcacagttaacctgactgaacacacttatacacacacatgaacacacacacacactcgcccccagaggcacaggatacgagtggaaacagcagctctgcnaagccctgtngctccccatcattgaaatgtngctgat

SEQ ID NO: 491340 - DNA, 561 bp, Homo sapiens
cctcaaagtactctatgatccagtatctttggcatccatgtatatacgcacagtcaaatctagtatgatatataatcacgacatgctcacttgatcagggaagactcatttttttctagcatttaggattgtatatccggctgtgtccactgtctaatggtgatgtttgtaattctgtgtgcctagcaaggtctgtaggatcaaactacaacactgctggtagtatgtgtagcactatgcaaatacaaggtagtaataatgctgttactgtcactgtccttgagacatatcttgtgaatttcaggggattaagacagatgactgaaaagttgataatctgttgacataaaatctttaatttagagcttgctctgtgctatgtaatgaaaaaaagacaacgaagatatagggggtccttggtttagtctgagtataattttagtggagccacatctataagtaagttcagctatagagatttagttaatagaaataagatggtggttgaaagagaagtctgatattacagcagaatagtatagtaatttcctgctctgagtc

SEQ ID NO: 491341 - DNA, 1142 bp, Homo sapiens
  misc_feature (1111)..(1111): n is a, c, g, or t
cccacgcgtccggactagttctagatcgcgagcggcgcccttttttattttattttctggggaaagcctctcgtgccagctgaagctgccgcagcagagctcagtgagaaagcccttttcctaagggtggcctccaggagccctaaccgggcgtgcgtgggcaggtgcacgcattttactttttggctgtttggtttaaacaaacgggagagtgagttaagcccccgaggacccaggcggggtgcaacttaaccagccctccagttcaccccagccccgagccaggaagagaagcccctctccggggcagacaggcaggactacgggggtgggcgttgggttgaccaggagctaaagggggatccaggcacagcccaggggccgtgttggccaagatgaccccgtgaaggccatcatccccagaaacagtgtgtgaccctcgggacgccccagggtggtgctcttgcctgtggtgtgtgacctgtgttccctgtgcaggtggggtggtgcctcctagggtgcgtgtgcgcgttgtgtgcgctcgtgacagctcctaccgaggaccagacgctgccccagctcggcgtgtgggcatggcgttggcctgcctggcccccgagaagcccagccctaggtatctgacaccttggcgaagtggggcaaggacccctataaccacaccaccgtgccccaggtgctcaccccagttcccgcccttcacagacccctggttccacgccaggagcctatgtggcctgccgcgtaggtggacagacggcactggatggccgaacgccttgtcttccttacttcctcgggccacattcatttctccctgggaatcccagggttgggggatctgagagctacctagagagtggacaataagaccctgaaacagggccactggccataaacgattgggcaccaaatgaggacgaataaaacacctcgtggaaggagttagacaccctcggaaacccacctgggtgaggctatccggcaccaggacccgacatttctacatatgtcccagccactgctgggagacatgtacaacgtaatgcagcgacaacgcgagacctaacggacgccatccacatacaacganaaggacacaacacgaaactgcgcgataatag

SEQ ID NO: 491342 - DNA, 169 bp, Homo sapiens
caaacagagctttaatattactacaaagtttactcagatcagcctgggaaggtgagggacacatgaagcagatgctggaaaaagggtcatggcagagaaaaggtatctcgtgggaagacaatacatctcttttgacttcgtgtgctgcctcacggcactagcactggag

SEQ ID NO: 491343 - DNA, 1352 bp, Homo sapiens
  misc_feature (107)..(107): n is a, c, g, or t
tttgttggtttggtgtattgtttgctgtctgggtgtctgtctctgtcgatgtgggtagtggtgggtgtgtgttggtgtgcatttgtgtattgttgagtgtatactangaaagagaggaatagaagagatagagaagatggatgagaaataaaagagtaagagagagagaagaagaaggaagaagaaggaagcgagatgtgatgtgattgtcgtagttcgagtatcttgggatgttcttgttttgtgcagatcagtgtcgttttcgttatgttattggactaaggctactccctgcgcatggtcggcgtgtgccgacatcctcggcgtgcgtggctggacgcggccagcaagccttctggttgtgtgcggcaacccgcactctctttgtttgtgtgttgtggtagtctgccccccgccgcgttgggttttgctcggaccgaggggtgtgtctccccctaggggggtttttctcctccgcccggcgtgttgtgatgtgtttgggggcccccctcgccgccctgtttcctcacagacggttgttgtttgtcacgcgtcgccgaagagtctccacaggcgtgccctgtgtctaggtcgccccagcaccctggttctgttcttgcatagcggggtttttaccggttggtggccccctgtgccgaaggaaagtcgcttctgtaggaattgtgcggggctccggctgggaaatatgtttcttgtgagacatgtaaggtgatgcgccaactagaatagacgactgttcgaagaacaagcgcgttgtgttacacatacactgggacatgtgaaagtccgcggcaaggccaaaaaatgtgggtggaaggccctccccactgtgattcccctgtgttggcgcccgaggctgttcggctcccgccgctagatcttcctattatgtgtggcgagtgaggtggtcatattatcgccgacttgtgtacatagctctccctcggcgcctagaaaatgtccacactttctacattctgtttttgtagggtgtttctaataggttataattgtctccctcttcctacccgcgctcttctatgaatagaagtttctgctcaccaccaacattatattctctgttgcagcggcgagttaggttttaacccacctctctatttacaagataagatggcgtaaaacacacctccgtctaatttgatagagccccctcctttgttcaattctaaagggtctagaccgcaaagaacaattctgtataaccacccgcgggccacaacattactttcttgatcacacccacgcactgtgtattagagaataattaatacaaaaatagaaaaactgtatctagcaaataacagaagaaa

SEQ ID NO: 491344 - DNA, 653 bp, Homo sapiens
  misc_feature (409)..(409): n is a, c, g, or t
caggaattcggcacgtgttgaatagatgagaatttgccctttataagaagggccagtgaatttctagagcaaaaactaagggacagctaagaagttattatggttgacttcaaaagcctcaactgtgtcttttatgtccactaaacaacttaattaaaagatggaattttgactcgtgtctgtatcatacaagtacaaatagtaattttgccctatgtatgtgtaaatgttatttgtgatattgtcttatttatttaatgccctttcttatgccgtgggttttcaagtttactcatttctatggttgcaaataactctcttattatataaactttcatattataggcagaacacaatggctaaatatctgtttcatgtacttcaaagttattataagatatattataantataatatattataacatatatattatatattatatatatataacataacatattataagatttattcttcacagatctatgatggtccctcttacctgtgttttggatggccagactcgggttcggtcccgaagggagggtatgactggcttaccctcctgaatttttagccaggtttaggatttacggggggataacagaggctacctaaggtcctttccccttactttatttgggggggcg

SEQ ID NO: 491345 - DNA, 516 bp, Homo sapiens
ggagaattacccgaacaaacgaaccacactgcttcgatcctggacaggatgcaggcagattattaattctgctgtgcggggctgctaactacaacacgattggagagaaaaatcccttccatgtccgaaataaccgagtccccgactcctgctgcattaatgttactgtgcggctgtgcggcattcaatttccaacgagaaggcgatccataaggagcgggtcgtcgtgagagcaacattcggggtggctggctgaggaagaaatagtgctaggtggtagctgcagggagcccttggacattgcttttgtcgaggtttagggacttgtctttgcctgctgcctcgatgaacgagtatcagaagtggctacgaggtgactgataggggtctggtctccgtcacgcctcctcatctgggggagtggaatagtatcctccaggttccccaaagttacacggattatttttccagaccgaaaaatgtaacttagacttgtcctgatgacgagaaagaggg

SEQ ID NO: 491346 - DNA, 628 bp, Homo sapiens
aggactgatgtccataagggtcgaattagcagggtctccaatcagacagtttgagtttctaacatgagcgccccgactggcaaaatatcctgaagcgaaccactagtctgacctacacataaaatgaaaataagctgggtgcagtggctcatgcctatagtcccagctactcaggaggctgaggcaggagaattacttgaacccaggaggcgtggaggttgcagtgagctgagattgcactactgcactccagcctgggcaaacagagcaagactccgtctcaaaaaaaaaaaaaaaaaaaattccggtccaagggatggggatgtgggggcccatggacaaggaacaatccaagagaacattaggggaaccgagcacaaagagaggggaggagggaggacaccacgaggagcaccacagatgagaggacaaccactgggctagacaaggggaaaacaacaccaaattaatacataacagagaagaagaaataaacggagtgacgaacacagagacacatgtaggacacaagacaacactagaggatgaaggcaagacgaagttggataaaaccaggacaagatggaaggacgagacgaaccgaagacacaaagcaaacgacaaacca

SEQ ID NO: 491347 - DNA, 349 bp, Homo sapiens
  misc_feature (12)..(12): n is a, c, g, or t
  misc_feature (78)..(78): n is a, c, g, or t
  misc_feature (149)..(149): n is a, c, g, or t
  misc_feature (179)..(179): n is a, c, g, or t
  misc_feature (184)..(184): n is a, c, g, or t
tttgctgacggnctattcagaggctaaaaagcacatgtcagggaaagagaaaagttttgggaagatgtgaaacatcangaaatcctgcatatcgggccaggtgcgggtgtcacgcctgtaatcccagcactttgggaggcccgaggtgngaggatcacttgagcccaagagtttgagancccancctggaaaatatagtgaaatcttatctctacaaaaaataaaaaataataataaaaaagaaatcctgcatacctctcaaacagataaaaagccctataaaactgtaacactgttaccaattctatttagcacaactcacagaaacgatctattaaatcagtatatt

SEQ ID NO: 491348 - DNA, 952 bp, Homo sapiens
  misc_feature (288)..(288): n is a, c, g, or t
  misc_feature (409)..(409): n is a, c, g, or t
agcggagtaactgacgagctcaccgggttgacccagcgccagggctcgcgggggtcccgcgagggtctcggtagccgggcgcccagaggacccccggcgcggcccgattctgtgagcgccagacactgaaccgcgagaaaactgcagatagctgacggacgacctataagccaaacaattgcaagcacttgtatgtccgaggttgttgatagcagcatacatgatggcgtgtggtcacacatgtataggcagtggattcatggcattatctacatggtattcgttcgnaggcatcttctggggtaggaaaacacatggaaataatagcgtttgacagtggtgtgtggattggcaagtgggtgcacggcattcgagtctgtcaaaggaggtaatatggtgtgcgaaatgnttggaaggagaatgaggcgctttccgtcagtaacagtccgatgctgaggtagagacacctggactgaaggtaattgagaggatgaggtggtgaaatatacagatgaaggaagagatggatgcatgatcatgtatgggaagctgtgattttgcagtactatcgcaacctaggcgtagaggagagcatagagacgtcttcgtaacgtaggcaggcactattgggcccatagtcgttcgcgtggcatcgcacaagagcgcagactggaattgttgacacgctcgaagtcattccaaagaatccaaatatggaattcgaggtgatgatgtggaataacctgaaactgtgctagtattgggtctcgacacctgaagtttagaaatgaacggcaggccaacgacataaatactaggacgaatagagcgctctctaaagaggcgacatgcgtgagtccggagcatctaggggggccaagaatcggactgagaggggggggggccccggggacccaagatttgaggccgccttaaaaaaagggggttaaaa

SEQ ID NO: 491349 - DNA, 629 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
cccccccgaagacggnaactttanttnngtngannnangccntcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcagggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaa

SEQ ID NO: 491350 - DNA, 1420 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
cccccccgaagacggnaactttanttnngtngannnangccntcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacagggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaaaataaaaaacaaaagaaaacaaaaaaaaaaaaaaaaaaaaaggcagaaaaaaaaaaagaaaaaccaaagcaaaaggaagaaaaaagaaaaaaagaaaaagaagaagaagaggcagagaggagaacaagagggcgcaccacacacagccagcggggccaaacaccaccccacggcgacaacaaccgacagagagagagaccaaccctcacccaggcggagagggaggggcgcgcggagaagaaaaaaccacaaaaaacagccgaacacgcgcaacgaagcgaccacacacaaagcagaagaaaacaccgaaaagcctaagaaggaagaggcacgccaccccgccaccgggggcgacaacggcgcaccgaccacgcacgacagagcatagcaccaagcagcagaaggcggagcaaccatagacagccatcagacccacagccgaggaacacgacagacgcaccacccccaggcgcgccgaagcatagacgaacacacgagataaacaccacagtgacggcggcgcagaggaagcacacgacacatccaacgaaggaaagaacgaaacacaaagcaaaacaggccaccgccagaaacaatcagtcacgccagccccacacaccagc

SEQ ID NO: 491351 - DNA, 541 bp, Homo sapiens
cagtgcatgggagttttcttgctcgtattaaaaaaaaaatctggctaactctgggtgttggcatatttaaagtttggtgaatctgatgggagcaagagtgcgatctggcgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaa

SEQ ID NO: 491352 - DNA, 846 bp, Homo sapiens
  misc_feature (5)..(5): n is a, c, g, or t
  misc_feature (12)..(13): n is a, c, g, or t
  misc_feature (15)..(15): n is a, c, g, or t
  misc_feature (21)..(21): n is a, c, g, or t
  misc_feature (24)..(24): n is a, c, g, or t
  misc_feature (27)..(29): n is a, c, g, or t
  misc_feature (68)..(68): n is a, c, g, or t
  misc_feature (106)..(106): n is a, c, g, or t
  misc_feature (109)..(109): n is a, c, g, or t
  misc_feature (258)..(258): n is a, c, g, or t
  misc_feature (439)..(439): n is a, c, g, or t
  misc_feature (442)..(442): n is a, c, g, or t
  misc_feature (445)..(446): n is a, c, g, or t
  misc_feature (448)..(451): n is a, c, g, or t
  misc_feature (454)..(454): n is a, c, g, or t
gcggntgactcnnangacccnaanacnnnccaaacccccggttttgctggacggcgcaaaagttggcncgcaccctgctatatgcttagtacaaaaacaataacangcnttgtacaagacaataaaaataagacgaatcgactcacgcataacaaaaacaacacggcggaggcgcagctaactgattcttttggagaggcgttgcatttggggcttgccccgcaaccaggccgagaacaacaaaaactgccctaaggnagagcctgaactggttggatcgtagatcagcaacacagcgaccaaagcaatccgtttgctcttggctcccgattgggagtgtcatgaaggaagcttcgtggcgagggcgatcaacaaaaacaagaagcccgacatcaataataaaaatagagcacgcaactacttctgggggagcttcggntcnttnnannnnccngaagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaa

SEQ ID NO: 491353 - DNA, 1361 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
cccccccgaagacggnaactttanttnngtngannnangccntcggccgcgctggtgaacaggacccgtcgccatgggccgtgtgatccgtggacagaggaagggcgccgggtctgtgttccgcgcgcacgtgaagcaccgtaaaggcgctgtcggtcgcttgctgcgccgatgtgattatctgcttgaagcgggacggcgtacatcaaggggcatctgtcatagggatcattcagtccacggagcccgggctcgctggtcgcgctccacttcagtcgcaaacgggtgtggttctttccctgggagagtcccgtgagtacggggcttgtacacggaaagtcgtgatcggcagcttagtttcatatggcgctgacacgaaaggtgtcgatttcaacaacgggtggccatgtttcagtagttactttggctgggcgagagtacacgaggcccccatgtctccaagctatattgcgccgaatgtgtgacttacacgcaagtgttgtgggtcaactcgattgccctcgtaggaaggtgttaccagagtctgctcgattgactagggcttgtggacggggaagggataggccctttgggaggcaacacggtcgcgccaaaaggcctaggtcgctcggggcgccaaagttcggatgtgggacaactttttagtgtgcccaacgctgggtataatacttgctcccaaatacatcgcccattgaaggaagccctaggatggaaaaggaccacacgggtaggctcgaataaggtccgtagcccgcatgccgagcggtttgccgaacaagggagagggggtttaaagttcttccacactcctatgtgcccatagacgacaggaaggggccatggtaaggagtgatatgagaagtagaatggtgattggagcactatggagaagggtgtggggcgcggtatcaagttccgaaacaaataatcaccacaatgtcgttgtggaaagagagggctgtgggggaaccgggaggactgtttagtgggaccaatgaaattaattagacggggcgatcaaatgtaccgcgaaagaactggggttgtgagagcaagaggggaataggatacactgaagcagagtatgcgtatgcagcaccaattggatagttcccctttgctgtgggaaaggccaattcccagtaattagtgcgacacgcggttgggcaaataccactaatgccgaggggcaaatacttacggaggcgaataggcccccgatcccaacccgattttcaggtaagcacgaaattgcacccttatagctgtgggatccggtgcacacggtgccgagtctttaaatttaggcaatgagcccgagccggacaaattagtggacg

SEQ ID NO: 491354 - DNA, 1245 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
  misc_feature (370)..(370): n is a, c, g, or t
cccccccgaagacggnaactttanttnngtngannnangccntcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcattctagagggagcagtctctgcgaagggcatcatcagtacacattgcataccaggtggcttcggtgcggcagcgggcccatgtctgctcacaggagtggctactctcccgggggagtcccgatagtcgtcttatacagacagcgtacggagcttgtctcagtgtgccatgcgngtagtgggcgagtgaccaaaacgggcgcgcgacgtctctgtggtttatcgggccggcgcaaatagcacaaggctcgcaaacgcatgcgaaagcttatgtgggctacatatgttcgggtcacacttaggttcgtgggcccacacgattgcccatgtgacggggtatacaaagtgccgtggtgggcttgggactggggacgtgcatgaaatggcccttggggatgcacacacgggttgcgaccaaaaaggccttggggcacactgggagctaatcgatggggacacatctgagtttgcccaaccccggatgtattctgcgcacaaacgaaggcaccatgaatgaaacgcaaaagtaaacggaaggccaggtagttgatagcgtcctaggaccagctttcaccagagggttcctctgacaagggaaaccgagggtatcacttcgtttcgccgtttacaggaggcgccaaagtgaattggacatgaccgtttgatggggactatgggcggtaaggctttggagtatgggtgacctttggcagaaggcgtcgtttagtggcccaccggaggacattgtgtgaccatgagagtcgcccaattcccttttgaaaagaaagcggtgcttgggactcctgggagaaggaattaacgcacgaggacaattgtacttgactttaggaatggcggcttaccattaactgtaaggcgtaaaaacaaatagtgttttgcggcccccaattttgcattgggttgaaccggggggggggcaattggttggggtgggaaccaaacttcgggaaaagttggcccgttggttggaagagaagtgtccggaatttcgcggtgcttaagatggtaggaaggaggaactatcggggc

SEQ ID NO: 491355 - DNA, 162 bp, Homo sapiens
tgttgggggttgtgggacccaggaatgacacttgtgtcctcatgatgttctcacagtcaagcagaattgaccacccctcccgcagagtgggagaagggtctcctgtgtgtctgtcttcaccgcaaaggctgcttcaaatagaagtcagattgtcccttcaca

SEQ ID NO: 491356 - DNA, 144 bp, Homo sapiens
  misc_feature (2)..(2): n is a, c, g, or t
  misc_feature (31)..(31): n is a, c, g, or t
cnggcagaaaatgtaggacgactcagagagntctgactgaagcgtggtgctcacgcctataatcccagcagggaggccaaggcgggaggattgcattacccaggagggccagcttagtaagaccctgtctccctgtctctactt

SEQ ID NO: 491357 - DNA, 1238 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
cccccccgaagacggnaactttanttnngtngannnangccntcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcagggcatcgtctaaggacaatcatccacgtacctcgtggacggggagtgctgctcccttcgcctgaaggctggtcttccggggatccgtatcgcgtttacatgaaggccactatcttcaagcgattggcaagtagtagcgtccctgttgggggctaccagtgcctagagtggtacgaatcgtggtgctgcccatggaagggagaacgcgctggggaggacactgtgagcgatagctggtgcctgggcactcgaggggatacttagtgcccaccggtaatatctctcgcacaaacgctgagatccaagaaagatcccgtgtgaactgctgccctccggctccaagcaaggttatctcctcagacgcaacagtagcgtgtgcgctgtggtcgttggatggccctggcagtgatgcgcccgaattgagcaaacccccatcttgcaaaggcctggccgggactgttaccaggaaagattttaagcgcagcagacggaactgacttgggccacgaaagataaccggggggttgtgggcccatgaattcctgtggtgttgatgccatcccgtttgggaagggtggcaagcaacgcaagacacatcgtagcaatggccacgtcacaccaatcccggcaggaagaattgcgccccatggttgggcccgcaaaaggttgggatccttcatttggactttgacccagaccgggcaacgtgggaaacgttcttcccggggggaaacccaaaaggacctggtgccatggaaaggaacaccggaaggaacaccttaggctggccattgcaagggggtgctcttccaacactaagaggagtgtagccggataaaatggcccaaccatgcaaacaaccactagacacacaaggagggagggcgtgtacgagacccacaacgacaaatgtagtcacatcggaagtgggcacccccacgtgttgacccgaggtgtaccacccccgagcctttcaagtgtgacacacaacagtggagggcaccacctaaatagagagaggaacgacgcagaacaacaaaa

SEQ ID NO: 491358 - DNA, 396 bp, Homo sapiens
gtttctaccttttggctattatgaataatgctatgaaaattcatatataagtttttgcatgaacatatgttttcaagtctcttgggtatgtacctaagagtggaattgatgagtcatatggtaactctatgtttaacttttttgagtaactgccaaactgttttccgaagtggttacaccattatgtaatcccaccaatgtatgagggtttcaacttctccatatcctcgccaatattcgctctcatctgtctttcctctcttagttgtcctagtgggtgtaaagtgggtctcattgctgcccgccggactggacgtctccggggaaccaagactgtgcaggaaaagagaactagtgctgagggcctcaataaagtttgtgtttatgccaaaaaaa

SEQ ID NO: 491359 - DNA, 107 bp, Homo sapiens
ctagacgaagttggtggaatctccagccatccccaggattccctgtcccatgcctgagacagtggtgatcaggtcagaagagcaggagcagcaccacgaattcgccg

SEQ ID NO: 491360 - DNA, 976 bp, Homo sapiens
  misc_feature (976)..(976): n is a, c, g, or t
acatatcaatatctggattccttagtcctgctggactgggctggagcctaagaaagtggcccccaagtccttagtgagctaaagctgggtctgaaattggtcagtggggaggggtagcttttctttatctttttctttttcttatttctttttttttttgagatggagtctcactcttgtcacctaggcaagagtgcaatggcacaatctcagctcactgcaacctacaacctcctgggttcaagcgatatctcctgcctcagcctcctgagtagctgggattaacaggcacacaccaccaggctatggttaatttttgtatttttagtagagatagtttcaccatgttggcaggctagtcttgaattcctgacctcctgacctgcccacctagaacctcccaaagtgctgaggattacaggcgtgagccaccaaacccagtcagggaggcgtagtttatctttaactattaaatataaacccaagtttattggcagactccctttagactccctttgcctccccatctggtgctttcttggcatctacaccccaggccctgtgttggggctgcagggggaagcttgtgcacctgagatgaggctgaacgggacttggctctctgctcccttcttcagtaagccaggagcccgccctcaggcccagctctggcaagaaggtggtggaaattcctggtgccaggactacaggaggatagggcaaaacaggcatgctcgggcgtgctggtctgctgtgactgtctacagttggcacagctgtcttacttattcacctttgaggtttctaatacggttcacagtatgctcttatagctaaagaaatccatttgaagaggggcgattaagcagtagcgcgcagggggactatgcccgggccgacaagtctctgggactgactagtaaggtaacactaatgatatgtgtactgtaaatatataactttgtaccgactatcn

SEQ ID NO: 491361 - DNA, 125 bp, Homo sapiens
tgagttcatagcacatgctgctggggcatctgtcttaattccagctccttcaagtcaccgtcagtcagtgtaaggaacgcttccatgtccgcctcttgtcctcaaaaatgggctgatatttctca

SEQ ID NO: 491362 - DNA, 439 bp, Homo sapiens
caggacaatgacctggggtcccagctcccctggaggggcctcctcatgattgtttgggggttgatcccagaccaagagtggcgagtgatgtccccctgtgaatcatggccggacctttttgcccctattgtttcagcccaacattatttgacttttccctcagggggggtgggcaaaggaaaagccctgtggttttggggacttgggatccaaagttgaagacccttcagctgggtttgccctgccagtgccacaaagtgccatggcccaggaaaacaggtttttttccatttaggccaggccatccagtggccatcctccgtgtcctcccgcctcctcctggtgtgacttttgaaaaccaaaaatttgttcctgttgactttttttggggtatggaccattgtcctttccccccctcaataaattttgaaacatgcca

SEQ ID NO: 491363 - DNA, 113 bp, Homo sapiens
ccgacggggtggaatccaggtaatggcgagaacccccactcaggactggggacggaagagactctggggaggcttatgaactgtctatggggagcagctaggcggggatccct

SEQ ID NO: 491364 - DNA, 121 bp, Homo sapiens
cccttccacgctccccacaacttgctccttctccagccctgcctctcaattaaaacaatgctttcttttatcttttctttttatattgagacggagtcttgctcctgtcacccgggctaga

SEQ ID NO: 491365 - DNA, 183 bp, Homo sapiens
cccatgggtcttgtacccatcggctctacttgtctctcggctctaccttgtctctcggctctaccttgtccctcggctctaccttgtctctcggctctaccttgtccctcggctctaccttgtctctcggctctaccttgtctcgttcgttatcggaattaaccagacaaggtagagccgcag

SEQ ID NO: 491366 - DNA, 794 bp, Homo sapiens
ccttctcgccctccaaaacgacactcatgcaccagtacctgcttgaatttacaactgtgaaaagtgtgtgtggaatgtatctggctcatacacgtagtgatcatatcataaaccatggcataattataactttgtacagaaaatttaatacataggacactggattgtcccaatgaatgaataacccttcagtgcgatgaggaatgtcatctcagcattcttgactttcctagcgaatcatacatagcattcattattagctctttgcatggggctcagctatcacatcattctagaacgcgaaacaagcttcagtaatgcgttgtacagccctgcagctaccttctccttattctttgctagcatcctggtggttctctcttgcctcttaatacgactacggcacaagaatggggcacctccaatatatgaagcacatcataagctcgactaattatcctaactatatcatctacacctcctttcaccctagtacactcacgcatatttactaaactggctactggggagggcttctaagacatgtgatgttattaggtgcctagattagtaaacatgatttggaattgatctagtgtctacttctatcgatggcgatttaaagtacctgtttgttcgacacagaatcgatgggttgagtttggtatggctggtcagatattaaatcatagtgattcagcgggttaagttgattataaatgggtactttgttccaccttttgggtactaaaattatgttgctgtccaaggtaattattacataggatgtagag

SEQ ID NO: 491367 - DNA, 142 bp, Homo sapiens
agtttggggctgacactgtccaaaccttcttctctcctgtcaacagtggaccagccccccaactataagatgctacaaggaggagcacgaggtggctgtagctggagggagcaccacaaccctgctcccccgacgtccaccg

SEQ ID NO: 491368 - DNA, 806 bp, Homo sapiens
  misc_feature (50)..(50): n is a, c, g, or t
  misc_feature (65)..(65): n is a, c, g, or t
  misc_feature (73)..(73): n is a, c, g, or t
  misc_feature (93)..(93): n is a, c, g, or t
  misc_feature (95)..(95): n is a, c, g, or t
  misc_feature (97)..(97): n is a, c, g, or t
  misc_feature (99)..(99): n is a, c, g, or t
  misc_feature (101)..(101): n is a, c, g, or t
  misc_feature (104)..(106): n is a, c, g, or t
  misc_feature (113)..(113): n is a, c, g, or t
  misc_feature (120)..(120): n is a, c, g, or t
  misc_feature (156)..(156): n is a, c, g, or t
  misc_feature (158)..(158): n is a, c, g, or t
  misc_feature (171)..(171): n is a, c, g, or t
  misc_feature (176)..(176): n is a, c, g, or t
  misc_feature (178)..(178): n is a, c, g, or t
  misc_feature (180)..(182): n is a, c, g, or t
  misc_feature (187)..(187): n is a, c, g, or t
  misc_feature (346)..(346): n is a, c, g, or t
  misc_feature (360)..(360): n is a, c, g, or t
  misc_feature (373)..(373): n is a, c, g, or t
  misc_feature (379)..(380): n is a, c, g, or t
  misc_feature (382)..(382): n is a, c, g, or t
  misc_feature (384)..(387): n is a, c, g, or t
  misc_feature (389)..(389): n is a, c, g, or t
  misc_feature (399)..(399): n is a, c, g, or t
  misc_feature (406)..(406): n is a, c, g, or t
  misc_feature (408)..(409): n is a, c, g, or t
  misc_feature (412)..(412): n is a, c, g, or t
  misc_feature (435)..(435): n is a, c, g, or t
  misc_feature (439)..(439): n is a, c, g, or t
  misc_feature (443)..(443): n is a, c, g, or t
  misc_feature (460)..(460): n is a, c, g, or t
  misc_feature (601)..(601): n is a, c, g, or t
  misc_feature (620)..(620): n is a, c, g, or t
  misc_feature (627)..(627): n is a, c, g, or t
  misc_feature (657)..(657): n is a, c, g, or t
  misc_feature (660)..(660): n is a, c, g, or t
  misc_feature (666)..(666): n is a, c, g, or t
  misc_feature (674)..(674): n is a, c, g, or t
  misc_feature (677)..(677): n is a, c, g, or t
  misc_feature (730)..(730): n is a, c, g, or t
  misc_feature (800)..(800): n is a, c, g, or t
tttttttaatttcattcatttattaaatatttacaatttttttatataanaaaataaaaacatanaaagttanaaatataaaaaatataaaanananananatnnnaaaaacntgaaaanggtgtccactttggattcttacatgaaacgattcantncacattgtaatcntaaananannnaaaanggtttcctatttttttttttattttgtaccttacaaaagttaatgcattagacacttcagatgttaactgctctaaacaaaactcctaagtctgtcctatgcaatatatattttatatacatatatatttttacatagaatactcacaaagtgcaagcnaataataacattanaaaaaaaaaatanatatcnncnannnnanaatatcaaanaattcangnnatnttttttttttaattaacattaanagantttntttttccacttcaaatnaatcatatttctgtcatctccaacctaagatattttttagattgtctccgctattctttgattcaaaagcgcaattacagaaactatgaacttgacctaattctggtttttgacaattatgagacagaaataaagaaatgnaagcagttcttttctttgnacactgnccattttttaattagcatcatcctctatgntgntggtgntttcacantgngctctcctgtatgtcaaaatcattctgggtttccaggtaaatggacaaaggangatttgccttcagtgtctagaaggcaatttactttttcagctgccttaattacctatagtttaaaggaanggaatg

SEQ ID NO: 491369 - DNA, 109 bp, Homo sapiens
ccaattgttgctcttcaagcatcaaacccacatcaaattgagttccttgtctcccaaacagaatctaattctgaaaacagtcccatcatactttctgaaccctggccct

SEQ ID NO: 491370 - DNA, 109 bp, Homo sapiens
  misc_feature (104)..(104): n is a, c, g, or t
ggtgtcccgcctcttccgctctacagcggaggtggctgtggcggtggcgctggtggctgcggcggcggcggcggcagagacgcttggtcgggtcgtgtctgggncagcc

SEQ ID NO: 491371 - DNA, 340 bp, Homo sapiens
tcttatctatttatctagaattttaatacagctccgaggtgtgaagaatattatcacctaaattatatctcaggaaaaagccaggatcgggtataatccagactgtgattgtaatacacacagggtgctgtgtatgattgaaactactgactttctgtggcccgtatgcagcccagctaacctgcctcagggaaaggtgttaatgctgtgaattggcagagaagagagctgtgctccatagggtgctgccggtgctgtgctccctagccttctgttctgtcttcctccttagccagaacgccactcccttcccacatccccttcttctctccgccaagat

SEQ ID NO: 491372 - DNA, 195 bp, Homo sapiens
acaggattcgggaggctgaggcgggcagatcacctgaggtcaggagttcgagaccagccgggcaacatggtgaaaccggagcgtctactacaaacacagaaaaattagctgcatgtggtggcacgtgcctgcagtcccagctaagcaggaggctaaggcacaaaaatcgattgaacctaggatacagtagggaga

SEQ ID NO: 491373 - DNA, 212 bp, Homo sapiens
tttttcatttttagaacatgtccagtttcaccatgtgggtcctcgtgtgcatctcctgacctcacgcaatccgcccacctccgcctcccaaagtgcagggattgcaggcatgagtcaccatgcccggcctttaaaatttttttttttagagacaggcactcaccatgttgtccaggctggccttgaactcttgagccacatagatcctcctg

SEQ ID NO: 491374 - DNA, 356 bp, Homo sapiens
cattgaattgggagtcttgagagcaggtgcccagagaggtgtgtcaagctccatgcccagccctgggacacaggcgctggcctcagccaaggttcttaaaccttgggatgggatggctgggcaggcaggaaaaggcaccagccagtgttactggggtttctttgtgggttctgggggcatcatctggctgatagacgatgggtagggtagggaaatggcttcagtgtaagatgggagctgatgcccttccttgggacatctgggatgggctgtgtggactttggttctgttcccctccaagggccagttacaaggccagcaagagcccccgtcagtcccactagctcactcactag

SEQ ID NO: 491375 - DNA, 289 bp, Homo sapiens
tcctggaataccacacaagcagaaagagtgtgcagtacaccaaaaatgtagaattgtataatgaatgtatgaaaatatccaaggccgggcacagtggctcacgcctgtaatcccagcactttgggaggccgagccaggcagatcacttgaagtcaggcgttcgagaccagcctggccaacatagtgaaaccccgtctctactaaaaactacaaaaattagccaggcttagtggcaggcgcttgtaatcccagctgcttgggaggttgaggcaggagaatcgcttgaacc

SEQ ID NO: 491376 - DNA, 979 bp, Homo sapiens
  misc_feature (225)..(226): n is a, c, g, or t
  misc_feature (229)..(229): n is a, c, g, or t
gaagatttcgacaaccgaatggtcaagcatgtgatcgctgagtttaatgcgcatgcttataaaggacatctatgagaatcctgagagcttgtatagatgctctgccgtacctgcttgttgaacgatgcgtacagcgtagccctctgcattcgagctagaccaggcccacgtaattgggagattcgagttgcgtctcttatgagagggtacatctgaacattcgtnntanctccattaccgtgcccgattgagactgaatgctgacctgttccgtggcacctggaccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcagcgtaataccaccattcctacctagagccatggactactaggagcttcagctacctattctgacgaaccagtcctggtgtgcttattcaggtttactgaaggcgagcgtgccatgacaaatggataactaacctgtcttggcaagtttagaactcactaggctatacctcctgctaccccgtaggtgtctcctcagattgaaagtcactttggacattgatgccgatggtatactcgaatgtctctgctgtggacaatgagtacggggaaacaagagacacacagattactatcactaatgactaagggccgttctgagcaaggacgacattgaacgtatggtccaggaagctgagaagtacaaagcgtgcagatgagaagcagagggaccccgggg

SEQ ID NO: 491377 - DNA, 188 bp, Homo sapiens
cagagtgctgggattacagacgtgagccacttgtgcccagccacgaccttctaagagctttgctttatagtttgtttttgacatgatcttgaaagcaatttaattctaaaagtggggtttggttttggctcagtagattttcagtcatttttacggttttatcttcatgatttctcttatatatcagg

SEQ ID NO: 491378 - DNA, 211 bp, Homo sapiens
ccatgtataatgtaaattccttcagggacacacctgttaatatgaatcaccacctttctagcacaggggtattatgcgcatcttgttgcaataatcaccaccggagacattaggatccctgagacacctgcctcactcacttgtcatgtcttgcagtgcagtgctgaacagatgtctcgaattatccaaggctacagtctcgagcactacg

SEQ ID NO: 491379 - DNA, 1151 bp, Homo sapiens
ggcgtggcgagggtgcagttgcggctggtgtgctggtgtgcttggcccccagcggcttcctcgtgcctcccggctgcccttcagctgatggaagatgatggactgatgtgcacagatgcggactgctgccaggcagagttcacctgccttggaggatttatgttcagcacaagattcatgaatgtgcctgccagcgggcccctccgtgattgcccttgccttgccacaccctgaccaacacatgcgtttgcttgtgtgccatggagtgtggttgcctggcatgcatcaagtgcccagagtgatgcccattcacttgttgtgccacacatacgtgtgttgagacggcggagacatcttcttgtgcacgcattgacattccagccaactgcattcttgaacctatgataaggttgggtggtgcaccattcaacagacgtgtcatctgttggctttgcatggaggtgcggggatccttggggacgactgggtggaggaatgcgcctgatgggccccggggggcaaggaccccacagaccaagcaatgtggtgcctttggtgggcctcagcaatgaggtgagcgagttggagccaatgtgcccccatgagttgaaaacagctaaacttggggttgagacaaaatgcgaattgggccctgcatactttgattgtttgattagcaggctatgggtggacccaagcgaaaagaaacccttttcagatgaaccgtgtgtagcaaggacagaatccctcacaaaggtgtcccaccaacacattgtgatccaacatacgaacaaagggcaaaaggccatcggccaaagggacaccgaagcgagaaggattgcaacaaggactccttgattggtggtgccatacccttttccacctggacgaacccaaagtgaggacgcaatccaaacatcaaatatcccgagtggagagccaaactcgggcagggagcaaccacatggggagttagacggactgccccccgttaacacacaggattggcgtacgcaaaacggctggtttgggtgcaaaagagagccattacaccagggggagaaaggaccggaggagtttgaacaacctttggagccccacgagaagagaaacgttccaaaaaaggttagttcatcagaagcgcccgtttg

SEQ ID NO: 491380 - DNA, 945 bp, Homo sapiens
gctttaaagtgcgggccgggccgggcgtccgagggtctggtcgggagtcgggccgcgtctccgcagcagccctccgcggcatgaggcgctgccggcgcccctgccccgcgggacgtggagaaggtggaggaggaagaagccccgttgtcgccaccgttgcatgacccggcgctcctgaggccctaccccacgcccggaccctcgaggcccgccgccggggtgccgccactcgaggcatgggggttcaggcgctaaggagcgccccgtccctccgggggccccggggcgcgtacgcgcttggagccatgcccgggctgccccggcgcgcaccggaggaccctagagcgagcgacgatgggggccatggaggccgccagcggctacacggacctgcgtgagaagctcaagtccatgacgtcccgggacaactataaggcgggcagccgggaggccgacgacgctgccgcagccaggcgtagccgacgcaggcggagacgccgctggcgacgaaccattaacactgagtccggggccaagacgcaagtatcaggaggactcggagcccgagcgcagagactatgaggagcagcagctgcagacggaggaggaggcgcgcaaggtgaaagagcggcatcacagacaagatgacgccatccttacagccaggaacgagtgcgccgagaatcgaaggccccgcactggaagaggtgggtgtcacaggccaggacaagggccaggacaacagatggaccacggtgggacggggacccccaaaggaccgacaacggacgtatgaggcgaagggggacaccgaaaggggcccaaggcgtgaaacagcacggacccggcaaggaaccggaccaccccaacgatagtacagggcaaagaaacacgaatggatcgacaaagtagaggcgcgaagaccagggggcgagcacggaaaac

SEQ ID NO: 491381 - DNA, 285 bp, Homo sapiens
agtggcccgcccgggccctttccctcccctcaggttttttaggggcaaagcccccgccccccgtttggggtggtgaagtgggggttcagggggggtgctccccccctcctttaaagggcccccccattttttgggcccttttcagggggtgggaggtcctttgggccccctaggggtctttcctgggaagtgttttgggggggggtccccggggggctggccccaaaaacccttaaaaaaggggggtcctttactggggttaattaaacggggtttcccccttga

SEQ ID NO: 491382 - DNA, 132 bp, Homo sapiens
ggacccagcctctatccccagcgaatttgtgaaatgtaaacatcatgggttttatggcgtgttccatttgagaaggcattttggtgtggtccgatgaagccttggacgaggcgcgtcggacgctgggcgagc

SEQ ID NO: 491383 - DNA, 387 bp, Homo sapiens
  misc_feature (280)..(280): n is a, c, g, or t
cacgttgagcccaggaattcgagaccagcatgagtaacattagcaagactctctctaaaacacacacacacacacacacacacacacacacacacacacgacacacacataaaaccagaatactcaccagcaacccaattttgtgtccgaattgcaatctataaatgtctccaatattagtcagaggaccattatatttaatatttagagcgaccggagcacagtggctcatgcgctgtactcccaagcactttgaggaggctgacggtgggcagactcncaaggctcaaggagtgtgagacccagcctgacgcaaaagtggtgaaccccctagtctctactaaacaaaaagaaaatattagccaagacctggtggcattgcgctcg

SEQ ID NO: 491384 - DNA, 365 bp, Homo sapiens
cactgagtgttaccaggagggaccagtttttcttcatgaaagcttcttacctggtggatagactgatcagccataacatgggtagaagtcctgcgctctccattgctccatcgctggctccccctgggagtcatgccaatcatttggtctggtccccgacagaagtatccacagagccccacacaagtttcccagcatggtcattgcatagacaatcacagccaccttcccattggctccaagccacacctggacccctgcctctctggcggacctagcagggagccatcaggtgtacgactcacggacacagatgctaacttctcagctgggagatccactcggaaaccattcacccacacacc

SEQ ID NO: 491385 - DNA, 521 bp, Homo sapiens
  misc_feature (179)..(179): n is a, c, g, or t
ctgctcagcttcccaagtagctgggactacacagttgcacactcagcgggtgattttttcagcatttgaagtcgagacggggtttcaccagtgttgcccaggctgatcccgaactcccgagttcaggcgatccatctgcctcagtctcccaaagcatcaagattacaggtgtgagccancacacccagccctgtttgggtttcaatactggcctttctgcttattaactgtgtgaccttgggcgaactccttaacatctgagaaccttagtttccccgttggtaacagggttataattctcagctcacaaggttattggggtagatcacttcacacagagcatgcttaactaaccagtgagctacttattatcaaatcgtaattatttgttcccaggattctctttcccactagcccctgagtttctttctttcttttgtgcgtgtgtgtctgtgtgtagtgtatgtgttgagtatagtcttgtatttgagacagagtctttgctctcttgccaagactgg

SEQ ID NO: 491386 - DNA, 195 bp, Homo sapiens
atctgcctccgtggttagtgcgagcgtggggagtttgacgtggggcggtacacctgtcaaacggtaactgcagagtatcctaccggcgagctcagggaggacagaaacctcccgtggagcagaagggcaaaagctcgcttgatcttgattttcagtacgaatacagaccgtgaaagcggggcctcacgatccttc

SEQ ID NO: 491387 - DNA, 161 bp, Homo sapiens
cccactatggctcttgaagcatgatggcccgggcttcagagaactcaggcaaccaaggtcgaatcaggtcttccatcgtaacagttgccaatgaattaacaagcacgaggatactagtgctgagagcagcctgctgcaagcaggccacggcaattgatacg

SEQ ID NO: 491388 - DNA, 833 bp, Homo sapiens
tggcggacatcttgtggatccttgagagtggccgggccggcagagcagtgtggccgaggacaccaggtctgttctcagagacgatgtggcctgctggagactgatctgccgccatgattgtgatgtgcttattcatctataatcacaaggtgggagtgtgcttcatctccctgagatctacctgatgattgacagactgtgtgatgtgaactgcatgttgggatgcctattctggagtacaagttgttcatccatttgccctgtgtcatgcatggtgttgcgcatgcaccctgtacaccaacgatttgctctgcaccatgacttacttccacggtataaagccgtggtccaaccattaattggcttggcagcaagtacaccaatgcaggaattgtcaacgtcttgccattggtactttctgaaaatatccctcgtataagagtgttgtagacctggtgaattggtgctttgcctaccacttatgagcagagactccagcctggatgggaaacacacagtacacagtgaaaccaatattttagttgctcagtaatacttgaggactgacttggctattgatgcatatctaagcaactctttgtgcatacccaacatgagatttcccgacgaacgatgtggctgacggctagcaaacaaccccttccactcaaccggccaggacaaggggccaatcgaaagaaaggtccatgcgatcacgacacaacagaggaatgaagccagacaactggattccaccagcccagggtaacctggggcagatttgggtggctggaagacgagcggtatccaagtattcggcgggaaatgagctc

SEQ ID NO: 491389 - DNA, 191 bp, Homo sapiens
  misc_feature (47)..(47): n is a, c, g, or t
  misc_feature (51)..(51): n is a, c, g, or t
  misc_feature (83)..(83): n is a, c, g, or t
  misc_feature (96)..(96): n is a, c, g, or t
  misc_feature (152)..(152): n is a, c, g, or t
  misc_feature (173)..(173): n is a, c, g, or t
aaaaaatacttattgaaagaggatatggctgggatccaaaagcaaanaacncttaaaaaggctccgaaatatcactcctcttnatactgccctctncttatcgcctgggccttgcattgcaagatgcagatggctcggaatgtctggttctnattgtagcttctgttataatnctctctactttagagatc

SEQ ID NO: 491390 - DNA, 662 bp, Homo sapiens
ggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttatgcacgtgccaatggttgagattgatgggatgaagctggtgcagaccagagccattctgaactacattgccagcaaatacaacctctatggcaaagacatacaggagagaggcctgattgatacgtatatagaaggtatagcagattcgcgcgacctcgatctacttcctcccgtatcgtcccctgcgcgactccgagcctaccttcgcctgatcgcaggctggatcccactcgctgctcccctcgcttagagtcagctctcggactcacggtcatacccccttctcgccgcccgctcaggcaccttaccgccctctgctggcacccccggtccataacgcctcatgtcctcgtcctccgcacgcctctcgccagcgcctcgctcgccgccctcttcttctgtgtatggaccgaccagccttgtcacgcacgcccctgtccttgatactctctagattgcaacacccctctgtctctccactacagcctctaccggcccgcgtctgtcct

SEQ ID NO: 491391 - DNA, 416 bp, Homo sapiens
  misc_feature (119)..(119): n is a, c, g, or t
tgagatactttgcttcattcacaaagaacagagtcaagaagcagtgccctctggaattagtgtgaacgtgtatgtacatcactattaaatatattacttaatatattctaagttgcttntggagcagtatactgttgttttaaaaatgcaagattcagacaaattttaatattgtctcattaaaataatttaaataatggtataaaatatctatatcattaaaataattttccatagtgtttagaaaccatgaaaaagaaaacatagcaggagaaaatatgacaggaaaagaaaacctaacaaagcccagaacccacagttaaccaacactagactgacttcgttattacccattctttgttagtattggatagggaattaggataatgagccattaggcagaactgaactgagcc

SEQ ID NO: 491392 - DNA, 588 bp, Homo sapiens
  misc_feature (538)..(538): n is a, c, g, or t
ctcgaggaatatcttcatggtgttctctgtatttcctgaatttgaatgttggcctgtcttgctaggttggggaagttctcgtggataatatcctgaagagtgttttccaacttggttccattctccctgtcactttcaggtacaccaatcaaacgtaggctaggtcttttcacatagtctcatatttcttggacgctttgttccttttcattcttttttctctaatctgtcttcacgctttatttcattaagttgatcttcaatctctgatatcctttctcccacttgatcgattaggccattgatacttgtgtatgcttcacgaagttcttgggctgtgtttttcagctccatcaggtcatttatgttcttctctcaactggttattctagttagcaatttctctaatcttttttcaaggttcttacttccttgcattgggttagaacatgctcctttactcggaagaatttgttattatctgccttctgaacctactctgtcaatcctcaaacttatctctgtcaatttgttcctngtggtgaagattgtgatcttggaagaaaaaaggttctgttttggaattcc

SEQ ID NO: 491393 - DNA, 700 bp, Homo sapiens
agcgggggttttccggagcctccggtcgcgggtctaagaggactagggcgggagcggcgcggaaaaaagagaggactgcgttttggggcgttctgtcagaggggaaggacgtgtggattggagtcagactgcactcccgccctatttctgcaagtagaactcactgcctttagaaacggtcttctgaggctctgttgggaggctctaactgtattacagaggacacatttttgtttgtttttatgtgaaacattcagaagttgcttgcatcaagtgctttacaagtacactggttttcaaactttttaagttgaggaactgttttgatttttgtaaaaatagaactttacttggaagcccaaggtaggcagatggagatggcgtttttaatttgcgaatgtattctataaaatcacatctgtactgaagtactagaaataattgaggataagtcagatgtgaagagcaagaacttttgaaataggattacaactgaaggtttccatcttacattagcttcagaaaacaagaaaatgctatctttggtttggttacatagtaacaggaagtccttattcaagctagaacttgctgatgtgaacagtttcataagggctctccttaaaaagattcggtacaccaattttaatcggggaaatatacatatgagtatatctcatgtgcatatcttaaagaaaga

SEQ ID NO: 491394 - DNA, 362 bp, Homo sapiens
agccaagtcaagagtgggacatgagccctgagaagacctcaactaggagtctgcactacaccgagtcggactggtgacctcaacaggacagagcttcaaggaggcgcgcacggagcggtcgcctgcaggcctcacggagaagcttctcaggctgaggagtcgtctccgcctccggagagatccggagactggaggaagagctccgcagctgaagtccgattcccacgggccgaaggaggacggaggcttcagacactcggaagcctttgagcactcctcaaaagagcagggactggactcagctcacacgtgagatgggtcctcatcaggtgctctcgcgcaaccgaacctgagtcctcctg

SEQ ID NO: 491395 - DNA, 150 bp, Homo sapiens
aacgaggatctactaagcagagaggtccagtagagcgggatctgacgccacactggttgaaagagggacctcagcacacaaactggtaatgcctagacagctgactgtcagtatgcagaggtacgaacagctacgggccactgcaaggag

SEQ ID NO: 491396 - DNA, 546 bp, Homo sapiens
atcagttgtggttcgatcgataccctggcgcatgagcctaacgcgctgcttccctcaaggtctctctcgtcttgtgccttctatcgcgcgccaggatcttgcttatttcggggattcatctgtggggccatctgatggtctggatcatcatcggccctgttccattatctagcctttctcgggtcgtatgtataggctctcagccccaagtcgctgcggaggagcagctctaaagatagaagatcttggagctctttgcctgtccgacggtggcctcacacagccgcctgcctacttttgcgcgccgtgagggaaggggccaagctgcaggactacacacagtcattcatgttcgtgtccacacccctgtgggtggctgggtgtgcgtgtgtgtgcttgtgtgtgcgcacgtgtcggcgctcacacacaccatgctagcccactgatgcacaccagcccagggtctggcagtctttgacagcgtggggccgtctcacctggagccctggagagatctatgcttgtataactccgagggcatatgac

SEQ ID NO: 491397 - DNA, 621 bp, Homo sapiens
  misc_feature (410)..(410): n is a, c, g, or t
  misc_feature (498)..(498): n is a, c, g, or t
  misc_feature (524)..(524): n is a, c, g, or t
aatgaaagggataacaaaacaaattaaatagtatctgaaaacttcccaagtctatcaacagatttagacatctagatatggaaagctcagagatctcaaacagatactatgctaaaagatcttctgcataacacattaaactcaaactgccaaaagtcaaggacaaagagataattctaaaaagagcaagagaaaagcatctagtcacttataaagatagtcccacagactagcagtgaatttttcagcagaaaccacaggagagaatagggtgatatatttaaactgtcaaaagaaaaaaaaaaaaggaggaataaagtattcctcagacaagcaaaagctgtgggaatttgtcaccactagactggccctccaagaaatgcttaatggaattctatacctggaagcanaagaactatatctactataatgaatacacaggaaaatagaaaacccactggtaaagctaacatacaaataaggaagggaaagacacanatgttaccactacagaaaaccaccanaccaaaacattatacagtaagagagaaagaaaggaaccaagaatatgtcccccaaatcaattaataaaaatgactaaacacatatcaatatctcttt

SEQ ID NO: 491398 - DNA, 382 bp, Homo sapiens
caggtcaagacacaatggcattttgttagcccatcaatgctgatatacactagcgtagatagcagatctagctatatagtatccttatatctagtagaactttctacatctgtttatccagtcgactgatacccttctatggaggtcgcctgaaacctggatgactccatttccacattccatttgggcctgacaacatagtccttgtttgaaggcattgggacccttgcacgggcacagaatccaggatctccaggtctaagagccttctcctctcctgtcagcaccttttccaggtctcttctgggtgtctgaccaccagtgctgttcattcttcgtcgttgaggcatctgttctagatctctctgctccctttcttctc

SEQ ID NO: 491399 - DNA, 252 bp, Homo sapiens
tgctttgaaaaaaataccctttttccaagtggcgtaatacaaaaagggccgaacgattgcctttccaaacatttgccaaccctaaattggaaatgaaaatttaaacgtaaaattttgttaaaatcgcgtaaaaattttgtaaaaaaagttaattttttaacaaaatgggccaaaattggaaaaaacctttttaaataaaaaaataaaaccccaaaagggttgaattttttttcaatttggaaaattcctttt

SEQ ID NO: 491400 - DNA, 108 bp, Homo sapiens
tgttatattcagtgtctttcatagtgcctggctcagactagctttcggaaaatatttcctttttttattcccctgagacggaatctagctcttattgcccaggctgga

SEQ ID NO: 491401 - DNA, 145 bp, Homo sapiens
tgtcttaacaaagtacctttgccttagtatgtaactaccagaagaatgctgagccaactataaacactcaatatatgtatgttattccaaattgtacttattactgcttttgatactgtattacgtgccaatagtttcccaatca

SEQ ID NO: 491402 - DNA, 379 bp, Homo sapiens
ctattcaactaaagcagacaaggaccccatgctaaataaccccgctttctaacttcctaattctatacattagaattttcatgaaaactttcatttcagccagcataacaccttgcaagaagcaggcagtcaataaatatttgttaagatgatttgaagatataaacacattagctgaacattatagaaagttagcctaagggctcttcactaaacgaaaattacagtgaagcttcctctttttaaccctgctacatatttttaacatgttgtttatttccaagtgaaaggacatagccttgctagctaaaaacacacccttccccacatcactagcatcctgtaaatggtcataaatcacaattggtccttgtcatga

SEQ ID NO: 491403 - DNA, 1363 bp, Homo sapiens
ccaaaaaaatttacaaaaaatcacgcgtctcccccgctcggtagagctttgtcttgttttttcattccgtctttcattaatacatgtaatcccgtgtgtaacgtgcagtcgagcaccgtaccccgtcccgtcatcgtggaacccgtaaagtagcttccaaggaatggtacaccaaggagaagcgaggtcactatacacctggctgtcgcacaggaactcccgtagaccagacaatacgcttcgtcatctctctgcactgggaacgctcgcgcaatgcccactgacggacatgctgggaatacggatacacctagatatctgagcagagcccagtattgtcgctatttgctttctaactctatctcagtgattcgacctgttgtgaagctacgcaccatcgtggagagaccctttggaaatccctggaatgcgtagagttaacaaaccgggagtcgctaacggtgacagagaggataagagaataatatcgaaagcattcccagtaactaggtaggcagttaccgaacccacatttttcatttctcccctacaggaagaaccccgaaagtggccgtcaattgcctaggtacgcaattttccacattttgcaagcgcgtttttagaaccccgatttttccagaagaggttaccattcacccgttcgcggcggaacacattcagtacaagggcacaacataacccacttttgcaggtcattttagagtttagagctttcaatccatctttcgacccaagacggaaactaggttgccttactgagactattacttccacttttgcaactgcacttcgtatcgcccctcgaggcgagcttattaaggggacatttatagaacaaacgacaacacagaccttcggccgaaatctactcccccccaggagaaacgcgcatccattaaaataagtcgcagagagaacaccaacacacgtatgcttccaaccgcgcggactttaatcccactcaggaacacccggagaacgtgggattacattaaacgttaaaccgcaggattgccgcaacagatgccccattcaccttgagaaacaaaacgttcgctttgacaatgtcgaaaagcacacaaggcatccacaaaccagacgagatactaaatacaagattggtcccccccaaaatccggtgctgcacgttactacaaaactttctacaatctatctaccgcccgcccagtttataaacacgacaacttaccattacataggggagaacgagactgaacgagcggtgaccacacaacggtgtgatagttatagataagcccccgcattaaacttaagcgcacaccacgcccaccactatcacataaaccacgccaccacaatg

SEQ ID NO: 491404 - DNA, 240 bp, Homo sapiens
gttggggctgtcatgtctgtgtcagcagctcccggggcgacggtctgtgtgcgtgggaccctctgacgtgtcagagctcccggaccagttgactggcacgtgtctgcagcgctccgtgcaacgggacacgtggacggtgagcaccgagcctgatgtgcgccctggcggaccaattgacacaccaacctgacggaagagagagtatcctagcgagcgatggagcatacctagtaggatatc

SEQ ID NO: 491405 - DNA, 560 bp, Homo sapiens
acgaggggtaaatatggcgataagaagatgtgtatacctctgtgtgttaaaaagagaacactgtgtaaaaatatctctcttatgcaccacaaatgggttttatgaatctgtgcattctaaccggcttcttggggaaatataagtagagcaaagagaaggtaagggagaattatttggggcgcacactggtacacttaaattttggtaaccggagactttgacctatatatatactattaggcttcaatttgctaacttaacgaagctctattcaagtatcctcattttatataaccagaagaatggagtatattactttggggagactgtggtcatgaagtcaggcttttgaggggaatattatataattaaactttttcacatacacggtaacattctacctttagaactgtgtggcatatacacgggagaaatatttcccttcagctttaaatgtgtttttaaaatgaccttatcctatagggtttgttgggaattcaattaaggcttataggctctctatgagatagagaccctttttttttgagtcccctctcttt

SEQ ID NO: 491406 - DNA, 170 bp, Homo sapiens
gatcagctactaggccaggtatcagcacagaccttatcaggagcaacatatcctctacactatgctgatacgggaaagtagctatgactatcctgagagttattcagtttttatctaaactgggtacagacctattactggactggctactgacgtttaccaagaatatt

SEQ ID NO: 491407 - DNA, 530 bp, Homo sapiens
gggaaatggaaaagactcatatcagcatagtcgtcattggacacgtagattcgggcaagtccaccaatactggccatcctgatctataaatgcgagtggcatcgaccaaaagaaccattgaagaaattagagaaggaggcgtgctgagatgggaaagggctccttcaagctatgcctggagtctatggtatcaaggctgtaaagctggttgcgtgaaacgctgggtatcacgcaatgtgaatatctcctctgtgcacagtcacgaggacgcagacaagtacatatgtgactagtcacttgatgcgcccaggacaccagagaactgtatctaaaagacaatgacttacaggggacatcgtcagggcctagaactggtgcgtagatcggtgaatgagtcagctgctgggctgtcgagtgagagtttgagcaacgcttggatatcgtacgcaaccgaaattgggccagggagcctcagcacgaagcatttgcccgttcgtaggcctttaacaacgacagtggaggttgatgaa

SEQ ID NO: 491408 - DNA, 434 bp, Homo sapiens
  misc_feature (12)..(12): n is a, c, g, or t
  misc_feature (32)..(32): n is a, c, g, or t
  misc_feature (41)..(41): n is a, c, g, or t
  misc_feature (65)..(65): n is a, c, g, or t
  misc_feature (110)..(110): n is a, c, g, or t
  misc_feature (132)..(132): n is a, c, g, or t
  misc_feature (167)..(167): n is a, c, g, or t
  misc_feature (189)..(189): n is a, c, g, or t
  misc_feature (287)..(287): n is a, c, g, or t
  misc_feature (317)..(317): n is a, c, g, or t
  misc_feature (377)..(377): n is a, c, g, or t
  misc_feature (381)..(381): n is a, c, g, or t
  misc_feature (409)..(409): n is a, c, g, or t
caattcctaccnaggttaaatttgaagacaanacccagagncataaagttaagtaagttaattgnaatattggagtggagaacttatttgtctacccgaattattgttanctttgtcggacatacaccctanactgcattccctcaaagtaaaatttaagtgtggcnctgtgcctatcctctccccagnggaaagtgaccagaagaggtgtgcagtttcccaggcctggcccatacagacctcccaacaggtgcccccctgtgctgttactccttctgccaactggnagcagatggtgacccaggctctggagaagncaaggcctgaagatgggagatccctaagtggaggagaactgtgccttactgacctaaatntccnctcagtattgttatgtgagaataaatanacttgtgttgaccgtttaaaaaaaa

SEQ ID NO: 491409 - DNA, 460 bp, Homo sapiens
aatgaagagacgggagtccttctcaggattcgtaaatatcaccaaatatgattcttcatggtatctcaggaatactctaaaccggcggatgtaacaccggctcaagggattttctggagggatcaaaaacagatgccacggatggcaaggattacaaggcttcagcctctaccatatcaccaccctcttccagggaggaagacaaattcagcagatcggcttaacgtgatgcttacggctctgaagtgaaagccagcaccacttgggacttcaaagatagcatctcagcggtttcaggtgaaagggtcagcccatcgaagagccggtccttgagtccatctccaccatcacccttagaaaagaccccccggggtgaacgtagtgtgaacttctctctgaggcccattgagattaaagtctctgcagaggcagaagaagcccgggtgtctcttgaggtgac

SEQ ID NO: 491410 - DNA, 352 bp, Homo sapiens
tggcctcaggcttatacttccaattcatctgatcatttgaggtgatctgaagtctgttaggatgagtctagagcagcctttatgctaagactactgcattagtccgttttcacactgctataaagaactaactgagatcaggtaatttataaacaaaagaggtttaattcactcaccattccacatggctggggaagactcaggaaacttacaatcatggcagaaggaaaaggggaagcaaggcatggcttacatggcaacaagagagaaagtgagtgagcggggaactgtcaaacacttttaaaccatcagatcttgtgagaactcactcactatcacaagaacagtatgg

SEQ ID NO: 491411 - DNA, 520 bp, Homo sapiens
  misc_feature (308)..(308): n is a, c, g, or t
  misc_feature (314)..(314): n is a, c, g, or t
  misc_feature (316)..(318): n is a, c, g, or t
  misc_feature (321)..(322): n is a, c, g, or t
  misc_feature (331)..(331): n is a, c, g, or t
  misc_feature (334)..(334): n is a, c, g, or t
  misc_feature (336)..(336): n is a, c, g, or t
  misc_feature (347)..(347): n is a, c, g, or t
  misc_feature (353)..(354): n is a, c, g, or t
  misc_feature (361)..(361): n is a, c, g, or t
  misc_feature (367)..(367): n is a, c, g, or t
  misc_feature (370)..(371): n is a, c, g, or t
  misc_feature (394)..(394): n is a, c, g, or t
  misc_feature (405)..(405): n is a, c, g, or t
  misc_feature (409)..(409): n is a, c, g, or t
  misc_feature (414)..(414): n is a, c, g, or t
  misc_feature (430)..(430): n is a, c, g, or t
  misc_feature (448)..(448): n is a, c, g, or t
  misc_feature (458)..(459): n is a, c, g, or t
  misc_feature (465)..(465): n is a, c, g, or t
  misc_feature (476)..(476): n is a, c, g, or t
  misc_feature (481)..(481): n is a, c, g, or t
  misc_feature (492)..(492): n is a, c, g, or t
ttgcccttaacctccccgttgtgccatcataatgaatgggaatttcccgagtgcatggccctggaggcctgcttcaacatcgagttcacacgcagccacaaaaggaccggcttctccaccagcccctagtccccgtacacgttctggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccancgactncnnnatnnctgaggccnggntntcccgccctgnacgagnnccagggnctgagngtnnctaggcggtttcggggctccccnttcctctcctncctnccggngggggttttagggccngggctggggggatggganggcacatcgnnactggnttttcataacntatgntttatatggtngctttacgccaaataatcctcagctggg

SEQ ID NO: 491412 - DNA, 797 bp, Homo sapiens
tgtggaaccccagtgaccaaaggatgggccggggactccggggccccagtgcaggcctggatgtgttttggtctcccagtgagaaaaaggtgcccagtggtgtgaacaatggcttcatggggaacactggacccacctggggcagtgggctgacagagtgccccaagggacccaagggagacccaggattccctggtgcccccgggactgtgggaggcccccgggattgcaaggaaatcccccagaagattgccgtccaaccatggggacatgtagagtgtcccccagtggtgaagtgcgatggcccccccatgagaggcaccaggtgggaagatggggccccaagggaaaccacccccgggagaacacagggtttacgttggggctccagggacacatgcttgaggaccccaaaggaaaagacggtgcgtgtgtctgagatagtatccccggaaatttaccggggcagaaatgaagggaaaccaaataagagaccaacgcaagaggagacccgactttggccaagaaaggtgacacccaggacagtccaagggggaagcccagggacatgccagagggtatggccaagggacgacaagcagataagccatcgagctaacacatcacatgggtagaaggcaacaaaggcaaggaacttagcgcaagggacgacacattgtgacccggttgaggcattgaaacaaaacttcatggcattggaatacaagatctgacgtgtacttcctaaaggagcaggtgcaaaactcgtgcacaatacaaagaacatgagggcatgg

SEQ ID NO: 491413 - DNA, 647 bp, Homo sapiens
tggtgggttaaaatactggcactctatttttaaagggactctgtgcatggtattcccgggggcaaatgtgtaaaatttttaatgtaaatcgtgtggtttaaccaaaggactatcaaacctgacagcagctgggactatcgaggtcctcactgggggtggtggactggccacgctgatgctggatgtgggaagccaagccccttcagtcaaagctggggccgatctcagacccaaatggctaccaccaccaagccctgtgtcacgacggcagcggttggcagctcaccaaaaacaactcctttccgtgcctcgacacccgggccagccccagccacccgtgacggggggcgtgctccagggaaagtgccagggccaaaagcccaggctccttcacgcgggcctcttcccgtgcggggcggggcctccccaatggccttcaaatgttctgttggtgcgccagagctctgggaaatcctggccggagacaggtgtcctggcaaatgcttcttcaccgtgtagcccagttcctgggtccggcccctccagcagggggtgcttctcgcgggctggcgggttcacacgctcgccgtcgcccaggctctcggggtgcctcaagttctcgggcgcaatctccagtggcttcggga

SEQ ID NO: 491414 - DNA, 212 bp, Homo sapiens
aaaactcagccctggggacaggattgcaaagtcggggacataaatgcaaacagttgtttaaatttggggaaaaccgggcttgtgaacggtgcccatttccaaatgaagcctttcagcccttttgagtccccggcccttggtgcaatgtttgtgagttttacctgcccagcgtgtgggctggctcaatgctgaataaaatgggtttgtgtcca

SEQ ID NO: 491415 - DNA, 222 bp, Homo sapiens
cttattctgaccctatccttatgttctgacccactcttatgttctgacccactcttatgttctgacccacccttatgttctgacccacctccttggcctcccaaagcatgggattacaggcatgagctaccacacctggcccgttttgagacagggtcttgctgtgtcgcccaggctggagcgcagtgatgcaatcactggcctactgtggctttgacctcc

SEQ ID NO: 491416 - DNA, 180 bp, Homo sapiens
agccttgtctctggccctgtttattggcgccattgtagtatggtttatacgcagacaagattatccaccaatttcttattattctcatggcaataaggggcagaaaaagactattaagatggtgaattgagcaaaaagataaaaagaagtgcaggacttgatatgcgtcaattttcgttt

SEQ ID NO: 491417 - DNA, 983 bp, Homo sapiens
cagaggggctttcctgatgaaggcatcctggcagtgtactccactggccccccataatctgggcgagatgctctacaccaagcgatttggtcccaatgccatgtctggtgagcctgtccccaatgggcagatatgtaatggtgggcttggctcacgaaggatctctgctgtcacccctccattggagcacatggtggcccaggtcttcaagctgaacaggcccatggtggagacgacctccatgaggagagtgtgaaacgtcctttatcccatggcctgccgaccatcggagacatgtcagtatcaactctgcccgtgtggactgcctgagaccagtggcgtatggcttgagtctatggtaactaactaaaggagagctggtgatctgcgaccataggccttgaacctcgtggtgtctgagtactacatggagaccagtcgtgagaccgagacggtcttcgagctgtcgcattccaacaggaggagcagcgagcggcctggaaccagcagagccacatggaggacagacagagacatggggctgatgaatgccattggggcttcagcccggaaccctgccacctcagtgaccatctcagggcacccagactctggcccttcagctgcagaatggcgaaacacagactggagggaggtgcggagccacggacagcgctcagtcctgaggaaggggcaggtcagagtatggtgccaggggggaagaagcgcccgcaggatcagaggctggagcgaaggggatggaaccggggcagggagcaaggacacaggctccagggggcttggaaaaatatggtcaccgcgatccgagatcacagacggacgtgtgcgccccactacaggcccactgggggaccagcgaatgagagcacaccagactggacacggcaggggacacacacatagaaacaacacagcgacgaaggaacaaaggagcgaacaacacacacaaacacacggccagg

SEQ ID NO: 491418 - DNA, 162 bp, Homo sapiens
cggacgcgtgggctggtccctctgggcctgctgtgctcggacggaaagcggggcctgtgggtccttgtgtccctgcccctgaagaatggggctgctttgagggaaacgctgtctgctgccttcataccagatgctgattaaagtgatagcgattccagatta

SEQ ID NO: 491419 - DNA, 642 bp, Homo sapiens
  misc_feature (44)..(44): n is a, c, g, or t
  misc_feature (48)..(48): n is a, c, g, or t
tctataattctaaaggaattccatcagacagagttgtggtatcnaccncagtgtctatagcaactccagccattccacgatcaccacgagctcgagggttgtctgaatcatagccacgatgtgtcgccagatcaaaggcatctgataatccctgctggccagcgttaatgttgtccttatagtactcagtgctttctacctcagtactaagtccagcatgctgctgcatggtccaggccttcaaggtatacatggtaggatatggctcacgtctgtatggctacactcctggaagctcctcaggtaagtccatagcatctctcttggaatgcgagggtttcatagagatcccttacggggtgtgccatattaggtcttctgggtttttcccgtacagatgctgtttagccagggcagcccattctgggtgaacgggctgctgctggtgtagaagtcgccgctgtatgatccgataccctcatgattcttcggtctggcatcaagtaatcagctgtgcagtctcaaaggccaagtgtgagcttgccacatgctccagcctgggggccacaataggcttaagaactctctggtagcactgatatgcagtccgctgtgcgaaacgtcgcttccagtgttgagtgg

SEQ ID NO: 491420 - DNA, 185 bp, Homo sapiens
tctcaggatcttatacttgaagcaagggacacctttggaactactagagtattgttaagtggttgtggctcaatgctgatagcaagttgacacctaaaggccagactgatgaggcctcagatggaaataaagaacttattgtcgaactgtagtaaaggtcacccatattatgccccagcaaagaa

SEQ ID NO: 491421 - DNA, 150 bp, Homo sapiens
tggtttcgagacagaattttgcttggtcacccaggtgggagtgtaggggtgcaatctcagttcattgcaacatgattctccgggatcccagtaattctcctgcctcagcctctcaggtagcggggataacgggtgcctggcataatggcc

SEQ ID NO: 491422 - DNA, 1758 bp, Homo sapiens
  misc_feature (397)..(397): n is a, c, g, or t
  misc_feature (566)..(566): n is a, c, g, or t
  misc_feature (1317)..(1317): n is a, c, g, or t
tattcatatgtctgcttaatttctgtgataaggattacacgtgaaacgtttgagaagtgattacaatagctaatgtgacagaagtgttgaaaatgtgaggcattcagctttctcttaaccacctccttacaaaaagtgtttagtagtgtattgtggtcatttacatgtgtttaactttgtgattattgtggccctcattatatataccatatgtgtgctcattattataatagagtggtaacacattaccagatagagtatagggtagactccgtggcatttctacaggtataagcgcggatagcggtggaaaatctccagaaatttctcccctttggaggagaacagagctccgtgagagacactctctcactcacacagagaagagggccacatntgtgcggagtcgtcctctcattattaacacacacagtgtgtgcacccaagagagacgcaagcacccacacttacacatacagcgttgtcacaagagggggaaatatccacactatgagtctcacaccgtgtgtgtgtgtggaacagatagtgtctcatattatactccngagtgtcttgtgacagtgacgacacgaggcccccttgtgtgacgcgcgccgctgtggtgtgctcaaaagaatctcccccgcctgttctgttaagagaagaatatgtcgcgcggggagggtaataaaaaataatccgcgggggataagggaggagtgacaatagttttctcacaggacagactgtcggccgagaggaacaacctattctctagggcaggggtgagcggcgcatcaaaacaataaaatattttctttcactagtggacgccagcagtttttttcccccaaaagaagcgccctaataaaagaacgctataattgtcggggctaaatccccatattttaagaacaccacaaatatattctatttcgatttctgcagagaagaaccccaaatcaaacagaggggggcacccgacgggggggctataacgaattttggggattgaagggcgtctcccccaagaaagaaggattctatcccggtgtgggcagaaccgaaaagtcggtctccccctctcgtggtacaacacaagggggcgctccggatatatacactccacaaggggatcacctatcttcaatacacgactatgtccccccaaaaaaattctagccctttgtgatcatggtgtttcacccacgtgccgtctttaaaagcagtcaaagagaaaccgtgtccgagaaaaaaaactcgttgtcccaacagcggggggaaaacccccccaacaacgtattcaatcaccacgangcgggacacaaacgcgctccccacttagaacacaataccaccagcctcacaagtgtcccacaaacggtgtacacaaatttcctcgagcggaacaaaccgcggcagggatcaaacatatatttgtggaaaagagcgccccaacaaacaaaccacaggggaggagcgagacgcaactaccttagatatgaggggacaagttaaaccacaagactcgttccgcacgaggggggagtaactcgatcactacacaaacaaaacggggtgcgatgaacgtagcatcgagcaaccacgcgacatcatcatacatccgagtggtgaacaacacgaggggcgaccaccgagcagaactaaggacctccgcgagcgtatcaaccaaacctagagctcagcaactaggaggcatgcgaacatacactgctcgactgaacgacaacacagccg

SEQ ID NO: 491423 - DNA, 306 bp, Homo sapiens
agtcaggaccacgtcgttggacggcttgtatctagattaccgaacaaagaggtcatagtatagaaagtccgctgtatgggacgaagactggccgattcgtttgccaccactctggagagaaaccttatgaatgtaatgagtgcgggaaggccttcagccagagctcggacctcatcagccgtattgtatattacacattgttgtgaaacgaagtacccagaacttaatatacttacaaatctgaacagtctatacccattaaaggaataatcactcgcttcccccctgatgggagcaacgactgcg

SEQ ID NO: 491424 - DNA, 828 bp, Homo sapiens
gtgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagcctctgtccccgttccgtagtggccgatcgtatgtacctggtagagaagcacaccgcgcttcccgtgggctcgcttcactagtggtgccaccatccgactgcaaaggcggcgtcaagcgccccagaaacccctactcatgatccggaccctgagactcccctaaaggccatgaaaggtgcgcttctccgagtaaggtcactgtccatttcctggctgtcttgggcatgggccgtgcccaggccgccgccaggcccctgggagcagcttgctcggtgatcgctagccgcttcgcacgccgcatcagcctaggcccaggatggagctgaggcccgctgcctcacccctgctgccccgggcagagcctgggcacgcctcaggaacccacctttagacccccatccctgtcctcacccagactcttgccgttccctcctctgtcccttcgtccccagtccagaccacgcccgttgagccaagctgtggccacaccttcccgcgtcgtctgctgctgcagccggctgccctggacctccaggtgggaggcgtggctgagaccaaatggtttgcctataattgtataaacctatttatttctctaagtgtgggttatattaaggaataaaggccttttgatttgtagcgaaacagaca

SEQ ID NO: 491425 - DNA, 873 bp, Homo sapiens
cgcgagctggcgtatgtggctctggcgcgcggtcgtcctggctcgcttctgctcgattgtgcctggtgttgcatcgtcgacgagcggcgtgcgccgcggcttccgtgagcggacgtggcttcctctccggatctcggccatgcagctggcgcgggccagcggccgggcccccccagtcgtcgaggtgcacggagtaaccgacggagcaaagcctcaatgaccaatcttggggcctccaatggacgaccggagcagtcgacatcattgcaaggtctgcagaaggaatcaggtcaatcatctgtgctgcgccgtggcacaaaacacagcgacactaacaagcacacgacttggattgttgctgtgccttgctggcctgatctgcacatggaagtagatcagtcccgagacatggatcgtaaagtccgaagattattacgaacatgaactgcgcgacaagtgtgagggtgcgaacaacactccagtcttcatctagagggagtcgaatgggaccacagctgcgtgcctggcgtcgttgaatctccgctccgaggagacgcgctggcgcaaccgctattggttgctagggcccagccactacctgaacacttctcgtgctcatcgatgcaccactaaaccgcgttaaagatgactaggagaacaaagatcgacaaagtgccgcgcgacactgtaccttgccacggtgagaggccagactgctggatcttgtagcctggtatctgccttgaaatcccctggtagcccagcgagcaactggcaatcgatctccagcaacaatgtgcttaagaagctgtcaagatggttggtatcgaaaaactgtacgcggcaagtccggggagaggagaagccacctgg

SEQ ID NO: 491426 - DNA, 325 bp, Homo sapiens
  misc_feature (1)..(1): n is a, c, g, or t
  misc_feature (264)..(264): n is a, c, g, or t
nagtgcaatggtagttgaatgaatgtagtgggtggatgggtgaatgaatgaatcagtgggcaagtgcaagggcctgcagttttcactcccacagagcactgaatgctcagtttcacttaaatcatagataagtacttggaagaaaagtcaaaatcaatgctcccagtctgtttcttttaataatatggaagtgtttgtgctgtaattcctcaagtttacaaacccccacgtgatttctaaaacttacatccttgttattaactngacatctggccaaacccacttcttctaaggtggcaagacgtggtagcccaactgcacggag

SEQ ID NO: 491427 - DNA, 231 bp, Homo sapiens
tgatcatatcgaacgtgttcacgtagtgcaggtgctgtgaagaaaagtagagctagagtgtggagagggtgggggaatacaggcagagcaagccaggaatggactctctgaggaggtgacatgggctaatcgagaagtcggaaccaggtgtgtggcaatgggatgaaaatgctcccagtgcaggggtgaacaagcaatgcgccaatgtgctctgagtgtggtcctgagcgg

SEQ ID NO: 491428 - DNA, 1104 bp, Homo sapiens
catacccgtcatctactactaccatactattgcaggcacactacatcacagcgctaagctcgcactgagttctttacctgagtaggcctagcaactaaacatgctagcttttattccagttctaaccaaagaaaataaaccctacgtatccacagaagctagccatacaagtatattccgtcgacgccgaaggcaaccggggagtccagtagagtccggtgtcgtacggtagccgtagtcgcgtcgtgtcagacgagatagtagcgtcgtccgcggacagaggtgcagacccagtaagagccgacagtatctacgcagaacgtcgacacgtacgtacagtcgagtgtagcatgcaatacatgtaacataggcctaactacgtccacactaccacagctaacgggagactaacagccccctcctgttcacagctatacttagcaaggttaaccagccacgcctttaaccgccacacacagcgacaagacacgcacgatacaatagaagcaagatatacccagagacgccatagcatactactatacgttccgaacaccgttgtacacgccacgccaagcagagccgataagagcacaccccacacgataccgttccaagaaagtcccacgtagaatttaccaccacgaggagttacgttctaggacccgccagtacggactgtcaacagccacgggcttaagaggccccagtagtccggtaccacagatatccagaccttccttcctctacgcaacagatacagctatcactatcgcccagggcgcgagtaagcgccagacggaccaacgacatcccgacaccgcgcactagcggcaccttaacaacacaaacctcctacatatgatatacccccacaggactattaactccggcctctacctgccagctcccgatactaaagagctccaccatcttacgctctgccacctttccacagacgtctcaggcctcacccagatccaaaattcagcggcgcacattggcaccacctaacactctagtccaccgagctcttcccttacccccggacttactaacaaaagcgccgactataataccaactataatcacctacatgaccct

SEQ ID NO: 491429 - DNA, 462 bp, Homo sapiens
gggatttttctagggtgagatgggaaagatatattctggagaaaggactgtgcaaggcagaaagctgaagtcgtatgttcagaaagtgacaagagaataagcatggttctggtagggaagagtgggtagggattgatattggtatattatggtaagggttaatattgagggattttgtggaatataattgggagaatgacgccatcattttagtagtctgggaaaaatatcagtctggccacagtgttaaaatagaatggagaaactagatagagtgaaaaaaatcaggagttttgccatagttgaagcaataaacgataaggacggtagccttgtctgtctttttcatcattatattcccagtgacaaggaatagtgcttggaacagagagttgaactaatgtgcagacaggaggagggatccaagatgtatctagaaaaatagagctgacaggacttgaa

SEQ ID NO: 491430 - DNA, 579 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (31)..(31): n is a, c, g, or t
  misc_feature (38)..(38): n is a, c, g, or t
gtnntcntttgaancccgttgaactatgatnactcttngtaggaaccggcgctatggtgtggtaccccggaaattcggccattagggccggggtctctcaagcaccgccgtcgcggaatctcaggtactattggccaggcagaatgtccgcgtgaacgtcgactgtggcggctaccgccagccctgggaccgggcatgatgtgagctccttactcacctattaccgattgcaggaggtggctttgcgcctctgctcgctggaactgaggcttgtgatccatgggcgagctgactatgcagcccgattcctgagctaacaccctagaggagaagctgtactcgtgatacaggctctggtggctgcaccatctagctttagagatgtggggcactgtactgaagcctgaggcatgctgcatgactgcattgcagatatccatccgagcgcccttcaacctgatagcagttgctcatacgctctgacaagagttacatggctgaattgctgcacatattggattgtacccatcatagacgctgtgctatttaggttgctcgtccgctgctacgcatcgaggg

SEQ ID NO: 491431 - DNA, 134 bp, Homo sapiens
cataagttgtaccaaaagtatcatgggaaatatttttcttcttctttggcttgagagcttttggcattttcatagataatttataaagggcatccgatgccaggtgtgtcctcctcagaaccagatccaatgag

SEQ ID NO: 491432 - DNA, 120 bp, Homo sapiens
  misc_feature (10)..(10): n is a, c, g, or t
agtaaggaangcagacagtccctttctcacatgttatctgctaaacctagaagaagagaaattatcccaaaagaaagaatctgaaaagaggaatggtgacagtacagccttgatgacccc

SEQ ID NO: 491433 - DNA, 130 bp, Homo sapiens
  misc_feature (37)..(37): n is a, c, g, or t
  misc_feature (47)..(47): n is a, c, g, or t
cccagcctaccttgggaaagcctgcaggccaggcagnaatctcttgnaaccgagggaggaggagcgttgcagtaagccgagatggcgcccctgcactccagcctgggtgacagagtgagaccttgcgttt

SEQ ID NO: 491434 - DNA, 265 bp, Homo sapiens
aaatgtatctttccccagtacctggggatagattttttacatggactggcggtgctaagcaaggtgaaaggttctgatccctaggaaatcatgtgcgggggagtaggaaataaatgtccccaattctgaattttggccaatagctgagataacaaagagtcaccaagggctagttatcagagacaagagttaacttggcttttacgaggataggatactgggttggcattcggatttacagaaataaacgtttagggccggaccc

SEQ ID NO: 491435 - DNA, 1105 bp, Homo sapiens
cgtatagtcctagctgacgccaataatagaaaacaagaaaccaagtgggctggtattctctctatgcaaacatgtctgttttagttggaatgagctgaagagaagaacagtctgttcctgtgttcttcgatatatacacacaaacaaggagcgggcagggccgctcgatgcctttgctgtttagcgttcctccagaggtaggggacttgtaggaatctgccttccagccctagacccccagtgtattttgtccaatgttcacagtagagtagggtagaaggaaatgcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggtggcacgcacctgtagtcccagctacttgggagcctgaggcaggagaatcgcttgaacctgggaagtggaggttgagtgagccgggaccgtgccatggtactccagcctgggtgacagagcgagattccgtctcagaaaatagaaatagaaaagccatctgaagcctgtatcttccatttgtgttggcccttccagggggatgattgagcatgtggtttacaaagggcgcatttaccctttattacaagggcgtggcacagaagcaggggcgagacaacgaggacacacacaagtaaaccgtgggatcaaatagagtaacgagagcccaaacgttttcaccaaattgggtgcaacacaggtggtaaaatttacacacgagaggggaacacggtatacaaagagacacaacagacggagaaggagagagaaccacgacgtagcaaacacagaaggtcagacccaaaaagagcgtagacccgaggagaggagaaaaagtacagagaaaaaatagtagagggacacaagaaaggacaagcaaccacatagagcagagagagagaacgagagaagaggacacacaaaacaacaaaagaagaaaaatatagcatcaagcgtcacatcgctgcgacagagc

SEQ ID NO: 491436 - DNA, 536 bp, Homo sapiens
ttttttttttatattgagtaggtttttttccattggagtattggaaaaaaggagttttctaggcatggacttcttgttatatggaaaactgataaactttgttttcttgctaaaattttagtgggcccaggtagctttttaaaatgtttaatgcaaattaggctttttggactgtttagccccctttgctttcaccctttgggaataaacttttttggatttaaggcaaatctataaaaatagtgattgttggccgggcaaagtggctcatgcctgtaatcccggccctttgggaggcttaggtgggcggatcatttgaggtcaggagttcaaaaccagcctgcccaacatgaggaaaccccctttttcctaaaaatataaaattagccaggtgtggtggcacatgcctgtaatcccagctactcaggaaggcttaggcaggaaaatcgcttgaatccaggaggtggaaattttggtgaaccgagattgggccattgctttccaacctgggcaacaaaagtgaaactaggtctccc

SEQ ID NO: 491437 - DNA, 511 bp, Homo sapiens
tcttccaccaataggcacaagtcccttttcaagtgcgcgaaatgtagttttccacagaactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtgcagagccagaggagggctccggggaggaggtgcccatggagactagagagaatggactggaagaatgtgccggtgagcctttgtcagctgacccagaggcgaggagattgctggcccggcccctgaggacgatggtggccacaatgatcacagtcaaccacaggcctctcagggggattacatcctttctttggcggggcaggggggaccggagactttgcagtgtgcatggtcaggggtggtgccgaagtgtcttcca

SEQ ID NO: 491438 - DNA, 2495 bp, Homo sapiens
cttctcttagggacccggcactcgtcgccctcagtccggctcagctggggctgggcgccgtgggtctggcggttccgtagcggtcccagcgtctgtcccgccggccgggcggtcgcggcacagccgcgggaaggtgtcggatggcggttccgccgcgcggcgggcgcgccgcccacatggcggccatcagggcgctgcaacagtggtgccggcagcagtgcgagggctaccgcgacgtgaatatctgcaacatgaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggcgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggctgaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggaggagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggccccggaaaa

SEQ ID NO: 491439 - DNA, 588 bp, Homo sapiens
cgttgagccgatttctgttcccgtaccctccataaatcagcatatccgtgtacctgatcaacctccaatgcttgtgcctttgctatgatgagcaggaaacacactcccaaatcgtcgacacggggtacggggctctaatcgcatacgtgcctctttgagccaacgactgctctatgtcaccttcaccgtttgacatctcaagacaagtacagcagcctctactgacacagcagaatggcccggtgtaggcgaacttcccgtcatgttctctctggcaatcgtgcaaaataactccgtcgcagtgatataactcctgccccacgcccaagcacgacattcccagcagaatccaactcccagccccctcttgttgaggtgtaaagtgcctttattgggagacttttgtcttccagcctgtcaatcaaccatcctgggtgtggccaccatatgtgtgcgctctaggtcctcattcatgcacgatccaataggagacaccagttctgaagaacatgcccccacccaagtcacaaaataatcgaagtgggagttagatttcagagtccaggccatagcttggaccattaacgc

SEQ ID NO: 491440 - DNA, 323 bp, Homo sapiens
  misc_feature (16)..(16): n is a, c, g, or t
  misc_feature (157)..(157): n is a, c, g, or t
  misc_feature (194)..(194): n is a, c, g, or t
  misc_feature (198)..(198): n is a, c, g, or t
  misc_feature (237)..(237): n is a, c, g, or t
ggggggtgtttctcanaaggtttttatcggttctctccgcgtcacaagccatcgggtaaggcaacggattgtgcgtggggtcccctgtggctccgcggtcacaatactgagcctggaattgctgttagcaaaatatacatttgtgtcaccataaaanaccgcgccgccgcccctcgggtctcacaacaggtttnaaanattttaaatttttacccccttgttacccgctttttcggnaaggggttccttggggggcccccgggccagggcgcgggggcggtagaaagagccccaagacaggggcgcccgccttccgggtccca

SEQ ID NO: 491441 - DNA, 501 bp, Homo sapiens
ctccggggcacccagtcggggcaggttctcacgtgggagggcacagggcttcctgcaggctcggaggcccagggcggattgtggccagtggaagggaaggatgtttctggcagggggacttgtgtgggccacggctgtgcggctgcggcgttgagcacggcctcactgtccacctgtcccctaggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggccccggaaaa

SEQ ID NO: 491442 - DNA, 3131 bp, Homo sapiens
cttctcttagggacccggcactcgtcgccctcagtccggctcagctggggctgggcgccgtgggtctggcggttccgtagcggtcccagcgtctgtcccgccggccgggcggtcgcggcacagccgcgggaaggtgtcggatggcggttccgccgcgcggcgggcgcgccgcccacatggcggccatcagggcgctgcaacagtggtgccggcagcagtgcgagggctaccgcgacgtgaatatctgcaacatgaccacgtcgttccgcgacggcctggctttctgcgccatcctgcaccgccaccggcccgacctcataaacttcagtgctctcaagaaggaaaatatttatgaaaacaataaactggccttccgcgtggccgaggagcacttgggcatcccagccttgctggatgccgaggacatggtggccttgaaggtgcctgaccggctgagcatcttgacctacgtgtcccagtattacaactacttccacggccgctcccccattgggggcatggcaggcgtgaagagggcctcggaggactctgaggaggagccgtcagggaagaaggctccagtccaggcggccaagctgccctcgcccgccccagcccggaagcctccactatctccagcccagacaaaccctgtggtccagaggaggaatgagggtgcagggggcccgccccccaagactgaccaggcattggcgggcagcttggtcagcagcacctgcggggtctgcggcaagcacgtgcacctggtacagcggcacctggccgacgggaggctttaccaccggagctgcttcaggtgtaagcagtgctcctgcacgctgcactcgggggcctacaaggccacaggagagccgggcaccttcgtctgcaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggcgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggctgaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggaggagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggccccggaaaa

SEQ ID NO: 491443 - DNA, 277 bp, Homo sapiens
agctcgaccccaccgcaggttgtactggagcgtgagcgaccactgcgtctagctggggctctagagcgtgagcggccacgtctggctggcgttctggagcgtgagcggacacgactagctgctcttctagagcgcgacctgccacttctactgcctgatgatctactacgagacctgcgaccgactggagatcggcgcctagatctgcgcctagcaagcgttctagaccgagacctgcccctccggactggagctctagaccgagacctacgcctgg

SEQ ID NO: 491444 - DNA, 2808 bp, Homo sapiens
ggaaggagtggggaccgacccggggctgtgccagaaaaggtgccctcatggttacctctccccagtccctgggcccccaggtcccccccgggcaccaaggcctgtgctgggcactgggacctctggagggactagaccctttcagagccaggcctgggaccctcccgatccctgcttgattcccccattgggggcatggcaggcgtgaagagggcctcggaggactctgaggaggagccgtcagggaagaaggctccagtccaggcggccaagctgccctcgcccgccccagcccggaagcctccactatctccagcccagacaaaccctgtggtccagaggaggaatgagggtgcagggggcccgccccccaagactgaccaggcattggcgggcagcttggtcagcagcacctgcggggtctgcggcaagcacgtgcacctggtacagcggcacctggccgacgggaggctttaccaccggagctgcttcaggtgtaagcagtgctcctgcacgctgcactcgggggcctacaaggccacaggagagccgggcaccttcgtctgcaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggcgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggctgaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggaggagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggccccggaaaa

SEQ ID NO: 491445 - DNA, 967 bp, Homo sapiens
tgtactgccttggtttggagtccctctgcccgttgacttgcgttttgtttgcaggttaacccctgttgtgtgtatcgcggcccgcccttggaattgtattggttcaaccttgttggtccgctgttccctggttcctcgcggtacacttctttttgtttgccccttgtgtgcgccaattagtattggctgtagttgatgggcgggtccaccagacttctccacatgtatctttggatttcgttgcttgcccctcgtggcgcgtgtgagcccatagagtgtctgcattgtaggttgatcagcatgcgcgaacgggtgagtcgtgttgaatgaacgggttatgctgccccgcgctgccgagccgattctgtctcctgccgatggttggttctcccgccgctggaccgttggttctatatggtaatgtattcgagacgttttctcgtctccccgccgccctgctctcacaaggtcgcctatgtgacgtcatattcgacgccgtttggtgcgacctcgctgccctgcggtagaatgtgcgtgtgtggtgtagctttgttagccagttggggcggcgccagtgtccctatgtggtactgcgcccgcaatccccgctccgccggggaatattatcaggcctttgttggtgacgcacccccgcggcgcttccccattctgattacggtgggcggagtggtgcgtgaagctataatcgtataagtaggaccaaggcgccatcgcctgtacacaccttgcctggcgcggggaaatattttcttttccttatttttttggaggggtgaggcgtcatatcaatctacaatggtattgatgcaccgtgttcaaagaacaatagaacaaaaagaaaaccaataaaataaatgagacaacaaaaacacacaaagagcacaatagaaatagaccgcgtcacaacacatgaaaaacaaaaagaaaaacacacacaacataacaa

SEQ ID NO: 491446 - DNA, 3086 bp, Homo sapiens
cttctcttagggacccggcactcgtcgccctcagtccggctcagctggggctgggcgccgtgggtctggcggttccgtagcggtcccagcgtctgtcccgccggccgggcggtcgcggcacagccgcgggaaggtgtcggatggcggttccgccgcgcggcgggcgcgccgcccacatggcggccatcagggcgctgcaacagtggtgccggcagcagtgcgagggctaccgcgacgtgaatatctgcaacatgaccacgtcgttccgcgacggcctggctttctgcgccatcctgcaccgccaccggcccgacctcataaacttcagtgctctcaagaaggaaaatatttatgaaaacaataaactggccttccgcgtggccgaggagcacttgggcatcccagccttgctggatgccgaggacatggtggccttgaaggtgcctgaccggctgagcatcttgacctacgtgtcccagtattacaactacttccacggccgctcccccattgggggcatggcaggcgtgaagagggcctcggaggactctgaggaggagccgtcagggaagaaggctccagtccaggcggccaagctgccctcgcccgccccagcccggaagcctccactatctccagcccagacaaaccctgtggtccagaggaggaatgagggtgcagggggcccgccccccaagactgaccaggcattggcgggcagcttggtcagcagcacctgcggggtctgcggcaagcacgtgcacctggtacagcggcacctggccgacgggaggctttaccaccggagctgcttcaggtgtaagcagtgctcctgcacgctgcactcgggggcctacaaggccacaggagagccgggcaccttcgtctgcaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggcgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggctgaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggaggagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccggggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggccccggaaaa

SEQ ID NO: 491447 - DNA, 241 bp, Homo sapiens
  misc_feature (5)..(5): n is a, c, g, or t
  misc_feature (57)..(57): n is a, c, g, or t
  misc_feature (100)..(100): n is a, c, g, or t
cctangttcaacaaccacaaagagattccagaagtaattcagatgcgtgtgaaccanatttccttttcttcgttttcttttaactgttggggtgtttcantaaaaactattttattttcctgtgagtcttgcgagggggaagtaatgattaaatactcatgtggtcagaaaacataaactttttttataaaaatattttggacaattcattaaagggtaatttatgaaaaaaaaaaagggg

SEQ ID NO: 491448 - DNA, 124 bp, Homo sapiens
tgcacatagatcctcacacacacatgcacaaatacacacccatgcacaaggatcctcacacacacgcacaaatacacacccatgcatgcacacagacaggcatagagctgaacccgcatacaca

SEQ ID NO: 491449 - DNA, 961 bp, Homo sapiens
gtgtctggtacgttgggctggacggccaggtcccagaggctcaccctgctccttctccagggagacccttgtccccggccaatgtccctgctctgcctggcgagacggtgacctccccagtcagggtgagtagtggtggggagccgggcaggggcccagccctccggcatcctcaccgcccctccgttcccagctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggccccggaaaa

SEQ ID NO: 491450 - DNA, 235 bp, Homo sapiens
ccggaatctagaggaccccttcgattggcgggcacttagcgagactccatccctacaaaaaataaacaaaattaggctggtgtggtggcgagtgtctgtagtcctgtctactcaggaggctgaggtggaaggatcacccgagcccaacgaggtcacgggctgcgagtaagcccatgtgtcacgccacgtgcactccagcctgggccacagcaataagttgcccgcgcaatcgaac

SEQ ID NO: 491451 - DNA, 3177 bp, Homo sapiens
cttctcttagggacccggcactcgtcgccctcagtccggctcagctggggctgggcgccgtgggtctggcggttccgtagcggtcccagcgtctgtcccgccggccgggcggtcgcggcacagccgcgggaaggtgtcggatggcggttccgccgcgcggcgggcgcgccgcccacatggcggccatcagggcgctgcaacagtggtgccggcagcagtgcgagggctaccgcgacgtgaatatctgcaacatgaccacgtcgttccgcgacggcctggctttctgcgccatcctgcaccgccaccggcccgacctcataaacttcagtgctctcaagaaggaaaatatttatgaaaacaataaactggccttccgcgtggccgaggagcacttgggcatcccagccttgctggatgccgaggacatggtggccttgaaggtgcctgaccggctgagcatcttgacctacgtgtcccagtattacaactacttccacggccgctcccccattgggggcatggcaggcgtgaagagggcctcggaggactctgaggaggagccgtcagggaagaaggctccagtccaggcggccaagctgccctcgcccgccccagcccggaagcctccactatctccagcccagacaaaccctgtggtccagaggaggaatgagggtgcagggggcccgccccccaagactgaccaggcattggcgggcagcttggtcagcagcacctgcggggtctgcggcaagcacgtgcacctggtacagcggcacctggccgacgggaggctttaccaccggagctgcttcaggtgtaagcagtgctcctgcacgctgcactcgggggcctacaaggccacaggagagccgggcaccttcgtctgcaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggcgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggctgaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggaggagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttggtactcggggccgtgggctcggcccggacccggcattcggacttggtactcggggccgtgggctcggcccggacccggcattcggacttggactcgggaagggcctcctgtccctacaaggggcatgtggacagcagggacctgcgctaccgtctgtggtctcaataaagaaaccgaccacatggccccggaaaa

SEQ ID NO: 491452 - DNA, 416 bp, Homo sapiens
cctggttgctcaggtctagacagtgtggagtctgtatttgagacactggtagaggacagcgcacaacaggaatctactctcaccaaacttggcaacaccatttccagcctgtttggaggctgtaccacaccagtatgccaagtgataatggtacttgatactgtccaggcaggaagaggagacgccctgcagagtgggagcaaggtacgtagcttgggtgagcagggtggacgctcatggtaggaagcttgaggccccaggtggagcgatggtctctcagcatcccatccccctttaacctaaggtgagatgcaatcccatggggagaaaagggccacagaaaaagaatcatggtgactagtctgaggcccagaaatcaagtgagaaggccgaggcagggcctgagggcgtcgctc

SEQ ID NO: 491453 - DNA, 293 bp, Homo sapiens
cccgaggtatacggcgaccccgagggtcggacggctgctgcgtgacgagtgtgtgcatcgtacagactgacggctgagcgagttgctaagacaacgtcatgctgccgtcgggagcatgatcgatagggatctcgataacaaactcatggagacattccgcaggcttggagaacatggagcggataatgacccgagtggcattgcgctcagcacgtccacgtgacatctccagattacgggatagcctcagactcctgccaacgtttacgtgacgcttctcaaatgcatcggat

SEQ ID NO: 491454 - DNA, 2947 bp, Homo sapiens
cttctcttagggacccggcactcgtcgccctcagtccggctcagctggggctgggcgccgtgggtctggcggttccgtagcggtcccagcgtctgtcccgccggccgggcggtcgcggcacagccgcgggaaggtgtcggatggcggttccgccgcgcggcgggcgcgccgcccacatggcggccatcagggcgctgcaacagtggtgccggcagcagtgcgagggctaccgcgacgtgaatatctgcaacatgaccacgtcgttccgcgacggcctggctttctgcgccatcctgcaccgccaccggcccgacctcataaacttcagtgctctcaagaaggaaaatatttatgaaaacaataaactggccttccgcgtggccgaggagcacttgggcatcccagccttgctggatgccgaggacatggtggccttgaaggtgcctgaccggctgagcatcttgacctacgtgtcccagtattacaactacttccacggccgctcccccattgggggcatggcaggcgtgaagagggcctcggaggactctgaggaggagccgtcagggaagaaggctccagtccaggcggccaagctgccctcgcccgccccagcccggaagcctccactatctccagcccagacaaaccctgtggtccagaggaggaatgagggtgcagggggcccgccccccaagactgaccaggcattggcgggcagcttggtcagcagcacctgcggggtctgcggcaagcacgtgcacctggtacagcggcacctggccgacgggaggctttaccaccggagctgcttcaggtgtaagcagtgctcctgcacgctgcactcgggggcctacaaggccacaggagagccgggcaccttcgtctgcaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggcgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggctgaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggaggagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccggtgcgtcccccgcgcgccagccaaggggccccagccagggatgccgcggagcccaggatgtttgggggccggctctgtgaggccacctgactgtcctggtggtgagaccttccctggagccaggcgagcccacgtttgagtttcaaatctcccacctcctggctgtgtgtcctcagccaaggtacttaaccttgctgtgcttgggtttcatcctctgcaaagtgaggatgcttgtagcacccacctcacgcagctgttgtgaggattaaacgaatcaattcgcacaaggaaaaaa

SEQ ID NO: 491455 - DNA, 1280 bp, Homo sapiens
agcgggggttccctggtcagcggcgctgaggcggctcgcgggagacgctgcgcgcggggctagcgggcggctggagcgtccggcgcacggggcgctctcgggctgccggcggggacagaagcgccgatatgatacgcaaggcatggaaggctcccatgccatccctgtgctggtggaacatgttgtccaccagggtaattgccatcgacaagagtcgagcacatggtaagtatgagcaaggcttcaacatggacgaagtgttgcaagatggaagttgaatgaccttagacactattaccaattaacgaccagtatgaagccacactccgagataagaccctacgattaagtgcataccacaattttgggcccacgcatatgcgacaagtgggccttccatgttggaaacaaactggggggaatcctaattgggaaaagggggttaccatcgggaggccaaatgataggttacctaacacactaactacgttgcgaaggactggaagccattgaggaggacgccaaaataataatttcactaactgtggaccaagaagaccgcttcaaaaagatcaaaattatagcgcaaataaaaaataccccgaagcaaggaaagtcatttggcaagaacagactgaagtcgatagtggaaattccagttttgaaacctgatatcacaagaggaacgtacataacagtttagcgcaagttccgaagggcaatggattgcaagcgacccatagagacgtcacgcaattcatttggagcacaatatctcaaaacgaaattgatagggcgtagaaaccaaataacgcgttgaaaccaccggagcgcattgacgcaccaatttagaacagccccgtaataaaataggagttcaaaacccaaatagtatcaaatcgcacaaacgtggcggagaaaaaccgttaacatctaaactgagagcacgccttgacaatcgaacatcacaattgccccgaaattggccaagcatagccaaaataaatcaccactgattatccatatccactacagtatggcttaaagcggcgaaaaaacgaaaaaagcttgaagacaaacccacatacccgggacacaccaagtaccacggtggaaaaaacccgggaaaaaaacggcaaaaacaaagcggacaaaaataccacacgggacagcaaataagacaccccccgaacaataaccgtccaaaagaaaaaataacgaccacatgaaacgatcgatgcgggagaaacccccaggaacacactggaagtacaacacga

SEQ ID NO: 491456 - DNA, 1127 bp, Homo sapiens
gacgtgggtgtagggcttgtgatgccaaccctgtgcagtcgggaggcccaggcatggggatggccgggctacccagcgagctgttggctgtgctgggacagaccccaggctcccagtggccctgctctgaagcgtggctctgtctccctacctgggggcagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcagggtgagtagtggtggggagccgggcaggggcccagccctccggcatcctcaccgcccctccgttcccagctgcaccccgactacctctccccggaggagatacagaggcagctgcaggacatcgagaggcggctggacgccctggagctccgcggcgtggagctggagaagcgactgcgggcggccgagggaggtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggccccggaaaa

SEQ ID NO: 491457 - DNA, 302 bp, Homo sapiens
aatgatggtcctcagctactcaggaagctgaggtcagaggatcgcttgaacctgtgaggcagaggtttcggtgagccgagatggcgccactgcactccagtcctgggcgacagactgagacacggtctcaaaaaaaaaaaaaaaaaaaggaaaaaaatttttcctttaccctgtcaatagtaaaccagaaaaatcaggattattctgactttgaaagggacataattcctggaacaggggctcacgcattgtactctcagacctcggggaggcagagttgggcggatcgcatgaactcgggt

SEQ ID NO: 491458 - DNA, 328 bp, Homo sapiens
actaagtaaaccagaacctctgggtaatcgcaatagacgatctgtaatgtaaactagagggctggcggaaggtcagcagagaggaggagacatgatggaaattgcttgttatgttagacagggtgacacggaaactttctctcaggcaggtcatacctcacttgcagaagtgaggatcataagaagtcagctgtgttaaagatcatgcagatcaagctgatcaggcagagggaacaaaagttatcaagatcctgttgcaaacaaatagtctgtcattttcgagaaattgacatgagaccatggtaagtgagtttgagatttattctac

SEQ ID NO: 491459 - DNA, 138 bp, Homo sapiens
tgccttgagcatggagaatacggtcttgccagtatatgcaatggaggaggaggtgttctgccatgctaatacagaagctgtagacaacctctgatatttaaggagacaaccctatgtgaccagaaggcctgctgtaat

SEQ ID NO: 491460 - DNA, 173 bp, Homo sapiens
gaggataaacagagcgtacggatcgtggtggagatgggtgaaaacgacatatctgctttcacactacgagaggacactaatgatggagcggaggtcgcagatgctgaagcagatgcacgctgtccaagaacgagcaggagcgagaggcccagctgatccacgatcctaactct

SEQ ID NO: 491461 - DNA, 173 bp, Homo sapiens
  misc_feature (16)..(16): n is a, c, g, or t
  misc_feature (36)..(36): n is a, c, g, or t
tgcaaagctgaaaagntgtaacaatttctgggcggntttgaagctaaactccgtggatcacatcaaataccattcattttgtcatgttctagtaaattagttccattgtaaaaggttactctcatactccttatgtacagaaatcacatgaaaaataaagttccataatgcgt

SEQ ID NO: 491462 - DNA, 400 bp, Homo sapiens
cttgtcttattcaaatggaagtgttggccaaaacactcattatggtgatatatgtcctccttttcctcaggcctggggtgtggttcttgtgcttcgatggattctgtccatattggctttcacacaattgagagttaggtctcacatctgccagaagcattctttcttccgaaccttgcagagtccttagaatatatttcttgtgtgtatatagcacaagcgattgttcctgattggttcagaggcacagtttgtactggcaatactcgttttacatgagataaagggtgtcaggtcccccacttttggatacctcggagtcagagtggtggttctgcagagagagcgagatagacagagagagtgagagagacagagagagagagagacagagagagag

SEQ ID NO: 491463 - DNA, 152 bp, Homo sapiens
ggtttagggcaaaaatttttggccctttgttttcaaaagggggttttcttttgaatttttaaaaaaagccggtttttttcccccaaaaaggaccgggttaaaaaccaaatgtttattttttttgtttaaaaaggggggtgtttttttcccca

SEQ ID NO: 491464 - DNA, 952 bp, Homo sapiens
tacaagtggtccagtttccttaaaggacccccatctccctgaagggcaggtgcaggcagctaggtgagggcaaaaaatgtccatttgaaaatctggcccgtgatgtgaaggctttggcccaacatgtgctgtggaaaggcccccttcccgaggaaaaagttactctcgaaaccgagcgttcggggctctcctcggcgtgccgaggactccaagtttctccgccagtgggttagtgacctcgtagctccaccgtgcacaatcgtggacttcgaggggaaagaggcaaagctctcctgtggccttcggaaagaacccaagaactctccaagaaatgtgggagcgtgttaatgggtgtggtctccaaaagagggcatgcaaactggggaaaaaggctttctttccttcgagcttggctccaagctcggcgggaaccatatctccaaggggaagtgaaatatgtgcagagctcatatgacaaggctcgtgagtggagttctctttcgagggaaaaaagaatcacttcgggagtcacccacgagggccaccaaagccggccctttttataaaaaggtgcctcccagagaaatatagtggcgaggcgcccacgagaagaaaggggtgctccctcgagtgggggagctaacgtggccgcttataaatattcctatccaaaaccacaagagggggtccctcttggggcgcgagtgttgaacgcgaaaggggggccccttggcgcccttgggggcttcaagcaaagccagaggcgcccgtggtctccaaaatttctatcccaaatttccctcccttcgagggaccgaggggggcaagccggccttttgatgcctcctttcctttccggctgtcaaagcctgtggggggctttccgggggatatcttctttccccgggtgaaacaccctttcttcttttccccggggggggggggtggtcca

SEQ ID NO: 491465 - DNA, 1372 bp, Homo sapiens
agcggggggttggcgggtggggcggggcctcgccggcgccgtcaagtagcctgggggacaggccggcgcggctgggagcgggtgggcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggaggaaaaaaaaaaaagaaaacta

SEQ ID NO: 491466 - DNA, 768 bp, Homo sapiens
ggagaaaacccaaatcctggcggcaccggtgccttgtgcatgtcggggtctgacgggcactggtgccttgtgcatgtcggggtctgacgctggctccctgttgcagagtgtgactccagctgtgtgggctgcacaggggaaggcccaggaaactgtaaagagtgtatctctggctacgcgagggagcacggacagtgtgcaggtcagtgacggggtctgtgctggacgctggtggacccttcccaagtgaccatgatgtgaatggccccagcaggtactgccagggatgggaagcagttgagacccgtcctgcagacgtggctcccccagggtcactgtgcactcgccctgaggtccacgtgagacacagaagcagtgggggtgggggacgggctctgcatggccgaccccggtgtggatggcgctgctgcaccagcctctcgccggtggcctcgttccccaggtccaccgcctctgctctccctccagctcctgggtggcgattgccccgaggcttaaggccaggcctgcatggttgtgggctgcctgggtgagccctgggcgtggatggaacccggtggagaaagtgggtttcctgggcaggtgcggtggctcacgcctgttaatccagcactttgggaggctgagcgcgggggatcacgaggtcaggagatcgagaccatcctggctaacacggtgaaaccccatctctactaaaaacacaaaaaattagtccgggcgtggtggcgggcgcctgtagtcccacct

SEQ ID NO: 491467 - DNA, 395 bp, Homo sapiens
ggaatgtgcacgggcacagcatgtgggcacatatgacccagagttgtgaacacacgacacacaccaacctgtggctgagcgctctctatcccaagtcagaccggccggaagacagatcacaagtgcacgggtgaggacacccgctctgaccacagagtttggggaggctcaagacaatggtgtgctttggggaatcccttcacaaggtgtacgcgcatattggccccaagggcaccggccggaagatataagagaccgggcgggctttggttactcttaaccggttctgagttggccaagagggcactgtgccatgtgcccgcgaagagaagagacacactggtgggagaaggagaccgagagattccctttctgtgactcggcctcatctcttt

SEQ ID NO: 491468 - DNA, 338 bp, Homo sapiens
  misc_feature (88)..(88): n is a, c, g, or t
  misc_feature (90)..(90): n is a, c, g, or t
ttgcaggcctgaattacaggaaggggagaaaccaatggctcagggaatgagagccaatacctgtaaaagcagagttgggctgggcgcngnttgtcacgcctgtggtcccaggactttgggaggcttgaggcgggcagatcacgaggtcaggagttggagaccagcctgaccaacatggtgaaaccctgtctctactaaaaatacaaaaattagctgggtggggtggtgggcgcctgtggtcccggctgctcaggaggctgaggcaggagtatctgggagaattgaaccccgggggtggaggtcgcggtgggctgagactgtgccactgcactccagcc

SEQ ID NO: 491469 - DNA, 218 bp, Homo sapiens
gggaaacctgcttttttgttttaaagggaaccgagtctgctgggattcagatgaatgtaaacctccatcctcaggaagagcgaatatcctgacttattcgagtggttttgtgtgaagacactgaaagtgtgctgctctccaggaacctacggtcccgactgtctcggtgcgtttctcctcagggaaatcccatctcctacgtcacttcccctcttctt

SEQ ID NO: 491470 - DNA, 1470 bp, Homo sapiens
agcggggggttggcgggtggggcggggcctcgccggcgccgtcaagtagcctgggggacaggccggcgcggctgggagcgggtgggcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggaggaaaaaaaaaaaagaaaacta

SEQ ID NO: 491471 - DNA, 1116 bp, Homo sapiens
gcgcaggtatggagccgcaggagcgcagagagaaactccatgttagctcgcgctcggttaagaaaacatgatatggagatcatcctattccacagtatgaggtgaacccacgtgaccacagagatttcacatcacctttcatgaacgcaacagggtccgggacagggatgtctacctggtaatagaggacttgaagcatgaaatgcaacgtgaagtacgaggtcagaagccaaggtatcttcaagaccttctcatggagagtgtgaattttatcaccccgccaatctctctagcacatggttccaggtatctgaatgcttaggttgacagtgcggtggcccttgaaacaaaggatacctcgcgtagcataggattaatccctgcaggtgaactgactctggacctctggatctcgtattcgtacgcagaagtccaaaagttgaaagaactcacagcaattgaactggagacaacactttgacaaacacagacgtttaaacttgccaaaccttttaggtactccagacagacgcatgctctacaacgaaggcattgtccaaggacaagcacgaggttgccatctggtcatacagacaaggggccaaaagtttggatacaatcgtccgtcaagaacatgggaacttgtcttagcacaggcaaatgtcagaagagacacttcacgattttggaaatccaatgggcttgacaagaagaggaagcaaaactttttccaaggccccaggaaggggcaaatttgggaattgcatatcgtactgggtactccaatcccaaggtccccgttaaggtaacggccacctagttcacgaaggaaaaacgtggggcaacagaatttcacaagtgcaacgcaagaactaaatagaccccttttttggcaaacggcagacgcacagcacttctggcacaggtccccttaatatgagacagacacttttacacatgggcccggaaattccgggacacttctaatgggctcccaaaaggttcgagcagagcagtttcgggacgaacaggcaacaaggcgcagataaaccctagaatccaggcatttttggcaagccttcgcacattttaaccaaggaaacagcaggtcagaac

SEQ ID NO: 491472 - DNA, 138 bp, Homo sapiens
aattcaagcttctaacgatgtacggggacatgtgagagtaacttgcagatcatttgaccctgggaggttgaggttacagtgagcgaaggtcgcaccgctgcactccagtcttggtgatagagtgagaccctgtttcca

SEQ ID NO: 491473 - DNA, 1022 bp, Homo sapiens
  misc_feature (238)..(238): n is a, c, g, or t
ctgtgtagtcttgaggttactcgtgcaatcctatgccaaactccatgtgcctggtagaggtcaagccatcacgaacgtgcgataccacggtacatgtcgcatgcggctaggacgcgccagatgacttctcataaaggtttcagcatatgcaacatactgagttcgggagagtccttacctcaggactcctgcacgctcctggcagccggtatgcctcatatccacgtgatgcgagaantgtatatcctaaccttcaaacaggtctcctccgcgggtaacgtctgggagcgagaggactgtggggtaccgtgcatgtcagacacccacggctgttcctacgtaggaagtgagagtctagtcgtcaaggctagatacctcctggcgcacatccaaaccctgagatagaggggggacgcagcctcatgaggagggcccctcgtttacctgcgtcagtagagggctgtaataagagcatctatactaggtccatgagcgtacaagtgtcctgcttttcgtatcaagaaccatattcccttatggttcaggccatcgcttcacatacccctctatatggaaatgtcgatgtgctcaaattcgtttcttagtcagtagcctcttaaaatcgtttttgcccgaagggggaaacaaatttccttcgggcttattggatacccaatcctaaggctccattagtgtggccttcccggctctgttttggtgagcgttgcgcccctttttgagggttttatgccattacccaaggctcggctcccaggatttggcgccggcctggaaaggtaactccttccagtgggtagagaggccgcgttaaatatgcccgccgataaatggttatcccaattagcccctcgttggatatttggctgtctcacagacccttttaagttcttatcaaatcggtgctttttacgatatataaacccccttcacaagggcgccgagacgccctagagggaaacccccaagagagagggccaccttattatatttttaaccacacg

SEQ ID NO: 491474 - DNA, 1617 bp, Homo sapiens
agcggggggttggcgggtggggcggggcctcgccggcgccgtcaagtagcctgggggacaggccggcgcggctgggagcgggtgggcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagtcaggaccggcctctccgattcttacccgccttgctgtctgtctcttggatgttggcgtggcgtgggccacgcatggatccgtggccggaacacgcacacccagccaggctacagctccagagtatggatagctgccttctctccagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggaggaaaaaaaaaaaagaaaacta

SEQ ID NO: 491475 - DNA, 295 bp, Homo sapiens
ggcgatcacacccaccactaccaccgaggctgacactgggtccatttgcttcccagagtcttcctgtttgttaagaacatccacagtgacctgagaatcccttgaggagaactcattgctgacatggcatacgtagatgccgctgtgctcagtggtcagtgggggaaagcccaaagtgtccccatccactcgtaccccactgtgcagaggcccatccagccgtgtccagttgtatgagggagggggctgcccttcactcaggcacttgagcatatctccttctctgccaatgtgc

SEQ ID NO: 491476 - DNA, 1411 bp, Homo sapiens
agcggggggttggcgggtggggcggggcctcgccggcgccgtcaagtagcctgggggacaggccggcgcggctgggagcgggtgggcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgcagtcaggaccggcctctccgattcttacccgccttgctgtctgtctcttggatgttggcgtggcgtgggccacgcatggatccgtggccggaacacgcacacccagccaggctacagctccagagtatggatagctgccttctctccagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggaggaaaaaaaaaaaagaaaacta

SEQ ID NO: 491477 - DNA, 506 bp, Homo sapiens
cagcaaccgtgaatctcaaacctggagagtggcttccggagtgcgaggcggaggtggctcctgacgctaagagcttcgtgctgaaccgtgggcaaagacagcgaacaatcctgtgcctgcaaattcaaccctcggttcaacgcccacggagacgccaacaccatcgtgtgcaacagcaaggacggcggggcctgggggaccgagcagtgggaggctgtctttcgcttccagcctgggaagctgttggagaggtgtgcatcaacttcgaagcaggcaacctgatgcgtcgaagctgccaggatggatacagaattgccaacgttcccgcaagacgccggtcatcctggaggccatcgaactacatggcatgctgacggtgagttcaagatcagaatgtgtggcggctttgacgtgaaatcggccagtccagtggtccccaaataaaggcgatgctgccctctgcttccgctcgtgaaatagaaaagaatagaacacatacaagaagt

SEQ ID NO: 491478 - DNA, 371 bp, Homo sapiens
gctctattaggatccccgctgagatgacagtcggcccccttcctgtgccctcaccaggaaacccgggtgcggggtaggggggcatgctgcggccgtcttgcagccggggccagggagacccacccagggtcacacagccaccagaggcagagttccagccctgtggttcccacagccaggggtggccgctcagccctgactgttgcttggactgaccccccactgcctttccggcctgtcccctgtgcaggtgctgggggcctcccacacccgtcttcacaacaaccctattaggtagtgattcccaccaccacttcacatctgagaaaaccaggcacagagatgtcacgtacctgcctgaggtcacacag

SEQ ID NO: 491479 - DNA, 326 bp, Homo sapiens
aaaccagtcgacgcaggttttggcaattactttccagccctaacctgcatcgacccaattcaaatggttcttagaggtaacgcagttccaaagtcgcctgaccatcaagagcgatttgactcgtcgtatcaagctcagaagttctattgataactgcgtgaacttccagatttccgggccaagtgtattcaagttggagtggcgttattggtgtccaagtgtgccatgctcgcaatattcgcgtccttgcccgcaaagccgtgccctgccctgcacccaatggtcgactcggcctgcgaatttagtagtagtaggcggccgtctag

SEQ ID NO: 491480 - DNA, 83 bp, Homo sapiens
atttggcagtttttgcttttgttggtcaagaattctttacaaaacccacacacacacatccacacacacacacacgatgcctg

SEQ ID NO: 491481 - DNA, 231 bp, Homo sapiens
ggtgacctcggtgtgttacggacggcgctgttacggacgggctcgttaggcggcgctgttccggcgggctcgttacggaccgtacggaggcgtgttaggagggatcgttggcgctcgttacggcggcgctcgttacggagggtgttaggaggcgtttaccggaggcgactcgttaggggcgcttgttacggcggggctgttaaggaggacgctcgtaacggtgggctcctc

SEQ ID NO: 491482 - DNA, 120 bp, Homo sapiens
ccgtaaaggcaaaaattttttttttttcccctttttttgaaagaaaaattttaaaatccaattatgtaaatatttccaagcctttgctatttttttttggggtttttttaactcctttta

SEQ ID NO: 491483 - DNA, 389 bp, Homo sapiens
gccataaataatcgtctttataatgttcataacataatattaacagcccaaagagcgaaaataatcgaaatatcaagcgatgtatgggtaaatacatagggcatattattcagccgtaaaataaaatgatgtactgatacgtgctgtaacagggatgagccctgaaaacatgcgatatcaccgaagcgcagttccaaaggatcatacattgtatgaacgttttatgaaatgtccagaacagggaaagccatagagacggaaagtagcactggtgagtccgaaagactggaggagagagatggatggactgctaatgggaggttcttatgggggtgatgagaaatgctataaaagatggatgtggtgatggtcgcacactggtcgagatt

SEQ ID NO: 491484 - DNA, 258 bp, Homo sapiens
  misc_feature (8)..(8): n is a, c, g, or t
  misc_feature (51)..(52): n is a, c, g, or t
cgaacggngtagtcgttgagggacgtgcaggagggcaggttgagggacatnngcaggagggcaggtggagggacacagcaggagggcaggtggaggggcatgcaggagggcaagtggagggacatggcaggagggcaggagggcaagtggagggacatggcatgagggcaggagggcaagtggagggacatggcacgagggcaggagggcaagtggagggacatggcacgagggcaggagggcaggtggcgttacgtg

SEQ ID NO: 491485 - DNA, 379 bp, Homo sapiens
tcggtcccaacagtcaagcacatcagcgcacagttctctttcaagcagtactgcaatcatcatacatcagtcaagccattcaagcaaccatggatctcatgaggcaggcaagcaggggcatgcactctagcaatcatcactactggctcccaatatttgctaatgtgtaaatttagtcagctactctgagtctggtatctcatgtgtaaattggagacattagtagatcctatgtcatggggttacatgaatatttaactggtaaatgtaagatgtttaacatggtgcctcgtacacagtaagtgcttaatccagcaatcgtcctgttgatcacaaaagcaagataatggacaggtatggtgagagcaacaacaatcaa

SEQ ID NO: 491486 - DNA, 535 bp, Homo sapiens
tgaagaatagttttgctggacatgggctccttgggtggcagtatttttctttcaacactttgaaaatgtcatccccttctctcctggcctgtaaggtgtctgctgagaaatccactgttagtctaatgggggttcctttatgggtaattagaagattgtcttttgctctttttagtatatttgcttttgctttgactttaagtggtttgattataacgtgctggggagaagatgattttgcattgtatctgtttggggacctttgggcctcctgcatctggatgtctaggtttgttgttatatttgggaagatttgatctaatatttcattaaataggatttctaatctttcattctctcttcacccttggggacactgatgatttgaatattcagttgctttacactgccccatatatcatgaaggggtcgctcattcttttttattctttactctttatttttgtccgaataggttgtttcaaaagacccgtcttcaagttctgagaatctttcttttgcctgatctagtcta

SEQ ID NO: 491487 - DNA, 570 bp, Homo sapiens
  misc_feature (569)..(569): n is a, c, g, or t
tgttatacaattcagctcgtacctcataggttcgctggcacactgatggatgtgtcatggcgacaagaggagaggggctgcacaccaagactgccctgttctcacgtagaggtacaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccaccgttctcaagtcagtggtctcgtccggaagcatgatgatcatattcagttccctgcgaacctatna

SEQ ID NO: 491488 - DNA, 198 bp, Homo sapiens
gaccccttcactgttcccaagagcgaacgggaagatgaggacgacaacgtggaggggagtgtaccaggaacgagtcagaaagagataggtaagatcgataagggaagatggctaagatctaaagaggaaaatggctaagatctggagagttggacttatatggacgcatgcttcactgagcagcaggaaaagacggaa

SEQ ID NO: 491489 - DNA, 190 bp, Homo sapiens
aatcgcttccttaaactgctgactcgagctgttctcggacaccgcgaactcctctttctctttgggagtcttcaccgtgactttgatgatcttaggctcagccgggcagcagccgagccttgggcgcagcagggccgcgggaggggccggtggggccgctcgtctcgccattctcgagcatggcggccgc

SEQ ID NO: 491490 - DNA, 372 bp, Homo sapiens
  misc_feature (56)..(56): n is a, c, g, or t
  misc_feature (116)..(116): n is a, c, g, or t
  misc_feature (118)..(118): n is a, c, g, or t
  misc_feature (122)..(122): n is a, c, g, or t
  misc_feature (124)..(124): n is a, c, g, or t
  misc_feature (128)..(128): n is a, c, g, or t
  misc_feature (137)..(137): n is a, c, g, or t
  misc_feature (192)..(192): n is a, c, g, or t
  misc_feature (194)..(194): n is a, c, g, or t
  misc_feature (209)..(211): n is a, c, g, or t
  misc_feature (216)..(216): n is a, c, g, or t
  misc_feature (224)..(224): n is a, c, g, or t
  misc_feature (227)..(227): n is a, c, g, or t
agaatgtgtaacaacgaccaggaaagtgagtttcctgaaggagttctttgttcctnatcaaagaaattgatacctgttagcattcactgccaccatattttaaggagaagaactcnantggngncgcngagcagcantaaaaatggaactaaggatggtgctgatgtactgtgtggctggtagaagtggggnantatgagagatggagnnnaactngatatgcnccntggcatatttacctacttactcgtgccaacaatgaacaaccgcttcaagcgttatgccttaaaaatctgtccgtttttttcccaggtacttaaaatacaagtgccagtaagtggttcttatgtgttttggggggaaaattttatt

SEQ ID NO: 491491 - DNA, 332 bp, Homo sapiens
atatcatcctatagaatctagacagaagcattctcataaacagctctgtgatgtctgcattcaagtcacagagttgaacattgcctttcatagagcaggtttgaaacgctctttttgaagtatatggaagtggacgtttcggacggtttggggcccatggtgataaagggaatatcttcccctacaagctagaaagaagcattctgtgatacttgtttgtgatgtgtgtactcaactaacagagttgaacctttctttttacagaacagttttgaaacactctttttgtagaatctgcgaggggatatttggatagatttcaggatttaaaa

SEQ ID NO: 491492 - DNA, 493 bp, Homo sapiens
ggacatgcctccggtgaaggacctgaaggcgagagctagcgaaagcactgtagtcacagctgtcgatagttgctcgtgaaccatcagctgcaggaaacacgtacacaaaagaagcctacaagaagtacatcaaagattacatgaagtcgttcaaagggaaatttgaagaacagagaccagaaagagtaaaaccttttatgacagaggcagcagaacacaaatcatgcacatccttgctaatttcaaaaactaccagttctttaattggtgaaaacttgaatccagattgcatggaaagctctattggactaccgtgaggatggtcgtgaccccatatatgattgactttaaggatggtttagaaatggcaaaatgttaacaaatgtggcaattattatggatctatcacctgtcaatcctaactggcttctgcttgtcatccacacaacaccaggacttaagacccatgggactgaatgtctaatagagcggg

SEQ ID NO: 491493 - DNA, 163 bp, Homo sapiens
ccctggctaatttaagtttttgcagagatggagtcttgctgtgttgccaggtctcagactcctggcctcaaccaatcctcctgcctcaacccagcaaagagctcggattacaggcatgagccactgcactccagcctgggtgacagaacaagaccccatcttt

SEQ ID NO: 491494 - DNA, 138 bp, Homo sapiens
cacgaggcgacgtctcgtttctctgccagtgagcgcaccgccacggggactgagctggacgacggaagcctgcgacccccgaccgcggcaggcaccgcttccagatgctgatgtctcgtcttgccttctgcgggaaca

SEQ ID NO: 491495 - DNA, 276 bp, Homo sapiens
gagccggtacacagagtctcattctgtcgcccaggtgaagtgcagggcgtgatctctggctcccgtgttcaagtgattctcatgcctcagcccactgagtagctgggattataggcacacgcaaccatgcttggctaatttttgtattttcagcagagacagagtttcatcatgttgtccaggctggtctcaaactcctgacatctggtgatacgcctacctcggcctcccagatttgtagaatttccacaatatagttcccctatttctgtaggg

SEQ ID NO: 491496 - DNA, 791 bp, Homo sapiens
  misc_feature (55)..(56): n is a, c, g, or t
  misc_feature (125)..(125): n is a, c, g, or t
  misc_feature (186)..(187): n is a, c, g, or t
  misc_feature (189)..(189): n is a, c, g, or t
  misc_feature (201)..(201): n is a, c, g, or t
  misc_feature (239)..(239): n is a, c, g, or t
  misc_feature (266)..(266): n is a, c, g, or t
  misc_feature (297)..(297): n is a, c, g, or t
  misc_feature (299)..(300): n is a, c, g, or t
  misc_feature (355)..(356): n is a, c, g, or t
  misc_feature (406)..(406): n is a, c, g, or t
  misc_feature (454)..(454): n is a, c, g, or t
  misc_feature (456)..(456): n is a, c, g, or t
  misc_feature (488)..(488): n is a, c, g, or t
  misc_feature (495)..(495): n is a, c, g, or t
  misc_feature (527)..(528): n is a, c, g, or t
  misc_feature (609)..(609): n is a, c, g, or t
ggtttcccccttctttttttggaagtaaaaatttttttttattatagcagttacnnccccttcccacagaaagaagttaattatccttttttttaaaggaaattatatttgacagcgccaccccncccctgtgccatatcctgggaagcaggaaattgttctcctgatgctaaatagctcttcttnnanaaccaatgaagngataagtattttatcattaacgcagtatctaccctttntaattataaatattttatataaaaagnatcccccccacattttctttttcacaaaaananngatagatctgatgtagagtccaaaaaaatggaaagaatgaaaaaagcatactagnnttttcttctctggtgtgcccgcccccccccccccaaaaaaaaagcccatnatgtcttccgcaagtataaaaagcattccatcccaaaggaaagttctncnggaaacaaagaagtaaaaagagcagaagatcnccctgtntttactcccccaaaataatcaatttcaacatnngtgatatgtttttccaggcttctttgggttgatcccccactaatagatcagaatatgtatgcagttctttctttaaccctnttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactactatctgtctccattaca

SEQ ID NO: 491497 - DNA, 397 bp, Homo sapiens
aagtcacgtctgggttggggataggaaagtaggagaccacggcgtgactatttctagctccccagtctccacaggggctactcgccctggctagctgcctggttttctctctcctgggctagggagctggggaggtctgcggggctcattcctggccctgcagtatcccaacaccctgctctggggctgtccccagagctcaaaggctagtgcctgaggtcacagaggtgtgagtggcagttcaccgatcccgtgtgtgctccatccagcacacagagccagagtctcactcagtagcaaacaggcaaagctcagaggtgcggtccgcagaggtggccgtggcatgccctgtgaccaggcagggattcgctatgtcgctgtgtggtgaccactacgg

SEQ ID NO: 491498 - DNA, 150 bp, Homo sapiens
gcatttccgatgtgctttggtggccagcccgtacggatagtctggcaacatggagagaatcctgatagcacaagcgtaccatacgggtcaggacatctctacaaattactatgcgagttagaagaaaacatttgaaattaatcccagaca

SEQ ID NO: 491499 - DNA, 949 bp, Homo sapiens
  misc_feature (31)..(31): n is a, c, g, or t
  misc_feature (72)..(73): n is a, c, g, or t
  misc_feature (120)..(120): n is a, c, g, or t
  misc_feature (200)..(200): n is a, c, g, or t
  misc_feature (204)..(204): n is a, c, g, or t
  misc_feature (206)..(206): n is a, c, g, or t
  misc_feature (253)..(253): n is a, c, g, or t
  misc_feature (273)..(273): n is a, c, g, or t
  misc_feature (286)..(286): n is a, c, g, or t
  misc_feature (337)..(337): n is a, c, g, or t
  misc_feature (373)..(373): n is a, c, g, or t
  misc_feature (398)..(400): n is a, c, g, or t
  misc_feature (428)..(428): n is a, c, g, or t
  misc_feature (432)..(432): n is a, c, g, or t
  misc_feature (438)..(438): n is a, c, g, or t
  misc_feature (458)..(458): n is a, c, g, or t
  misc_feature (507)..(507): n is a, c, g, or t
  misc_feature (512)..(512): n is a, c, g, or t
  misc_feature (557)..(557): n is a, c, g, or t
  misc_feature (566)..(566): n is a, c, g, or t
  misc_feature (606)..(606): n is a, c, g, or t
  misc_feature (740)..(740): n is a, c, g, or t
  misc_feature (801)..(801): n is a, c, g, or t
  misc_feature (876)..(876): n is a, c, g, or t
  misc_feature (886)..(886): n is a, c, g, or t
  misc_feature (913)..(913): n is a, c, g, or t
tccggccctgccatgggtctggccgataaantactgggtggccttggggccgggtgggggctgttagccatnngggaggcaggggaggtctagttgccaccccacgtggggttgtacgtntgaggacactggctgggggggcagggctgggtcggggccccagggtcagtggcagagctggcacttgattccaggtctcntacntntggtgctttgtggggaactgggtgggggcgggttctgtggtagggtnttgggggatgggggggaaanacgacctatttcnggtgggactggcaacggctcccaccctccctggggacggggtttattaaantttgacatcactgttggttttttttttttttttgcncacgttttgtgaaaagttgattttnnntacccaagacccagctttcgggtttganagtncccgtnatgggagttcaagttttgtntgagctgggggggaaggggctagagcccccattcagacatgggcaactngggtntggggtgggggctcccggtttgtcccataccctcttggtcttgtntcgggtctngggggattcggggggttcagcagtggctcctaaagcagcnaccggtgcctcctccatctccctgtcctcagacagtttgggccccgggcagaacgtgtcccctcggcccgcccggccaagcacagccatccagcgtcgctgtagttcctctgtctcagggctgaagtaccagcngaggtggctctgggtgatcttgaagacatgccttctgtcaggccgctcccctgcctcgggnggtccacctcgaagccaataaggggcaggctgcgctgggctttcacatcctgaggggctccgtagatatacagcncaagggttantttcagggacacgaaccatgccttgtncaacctttgccaccttctccatgtagtcagggagct

SEQ ID NO: 491500 - DNA, 121 bp, Homo sapiens
tgtctgcctctctgggcttggtccttggtgccttatttcacttttttggtcagctcatgtttttctggatggtcttgatgttttccagtgtctgggcattaaagagtttcatgtttattgt

SEQ ID NO: 491501 - DNA, 315 bp, Homo sapiens
cggcaccattctcatgaagttggtagtgagctgcgtctcagttcctgttatgccctttgcttctattttgccactacaagtggaagagagcgctctgccatctgctgtgctggtccatatggaggtaaagatgcccttcactatgccagaatcttttctagatgatggagatctggtccttggagatgaactatatgacctgcttgattctgcatcctgaatacttatgaaactgttatgccgtcagctttagtcagaggaccccttcatacagccagtgtctctcctagcatgcccttttcgggattgctttta

SEQ ID NO: 491502 - DNA, 1269 bp, Homo sapiens
ggcaagatggctgaagtagagcagaagaagaagcggaccttccgcaagttacacctaccagtccggcagttggaccgtcgatgcgagcatgcgtggaacaagtgctcccttacggatggcagacatgatctgtcgagcgtgctatcgaagtgcagcggccatgtcgggtctggcgtgctgaacctggggcctgcggtgcggcaagcagcagtccctgctgaagcgcctgcgcaaggccaagaaggaggcgccgcaccatggaagaagccggaagatggtgaagacgcacgcgtgcgggacagtgagtcgagtcctacaccgatgaaggtgggcagctctggtgggcgtctacgaatcgtgcaagaccttcaactcaggtggagatcaagcgcctgagatgatctggctactacctgggcgacgttctccatcaactactagacccgtatagcatggccggcccggcatcggggccatccactcctcccgcttcatccctctcaagatagtggcatcaactaatcagggcgctacatgactccaatgaagaacatcatcacataaaaaccgacatgaagttccccgggtgcagactgtgggacgggacccaccagggactccaagaagcgaggcaccccagacaggtcgagagcgacgtggcccccagggaactggcgggtccggactcacaggacccgcacagacatgggtgtggaaggggactgcggacaaccataccggtggacaatggggctggtgagccccaagagaaggggctcggggcccgtcagggggcaccacgggagaccagaaggaaggggcaacaaatggggatggaacatgggcagcggggcgcacaaaaccggggtgcacatggtgggcgacggcacaacacataaaagggagagcaagcatacacgtcccgcgagaaaaatcgcgcgagacgctctgaaaagccccacaggctcgagaaaaaagcccgcgacgggagaagaccataggaaacgaggcgagaatcagggacagcgggaacaagacgggcgccgcgcggaagagaacccacagtctcgccggcacaaagacaacaacaggggcgagaacccgaggggactcagcacgcaagaagagactaacacaagagacaagacgggaaatagcaaagagtgagaagaaaaactgggagagaagggtagatcaaacatcgaagcgcgcccaggcgcagatgcacgccgcagcaggacgaacgcaaaagaacgcagggaggagcga

SEQ ID NO: 491503 - DNA, 1222 bp, Homo sapiens
  misc_feature (6)..(6): n is a, c, g, or t
  misc_feature (8)..(8): n is a, c, g, or t
  misc_feature (10)..(10): n is a, c, g, or t
  misc_feature (13)..(14): n is a, c, g, or t
  misc_feature (16)..(16): n is a, c, g, or t
  misc_feature (19)..(19): n is a, c, g, or t
  misc_feature (21)..(22): n is a, c, g, or t
  misc_feature (26)..(26): n is a, c, g, or t
  misc_feature (107)..(107): n is a, c, g, or t
  misc_feature (699)..(699): n is a, c, g, or t
  misc_feature (763)..(764): n is a, c, g, or t
cgcgcngntncgnncnggnannggangtgagctgtcgcgggcggcgcccggccttgctcaacgcccagcagtccccaccgtcgctgccgccgccacctgccctcggnccgctgcctgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggcacaccagccaccgtcaccaacgcggtgtcctggcggtccgaaggcatcaagtatcggaagaatgaggtgttcttggacgtcatcgagtctgtcnacctcttggtcagcgccaacggcaatgtcctgcgcagcgagatcgtgggctccatcaagatgcnnagtcttcctctcgggcatgcccgagctgcgcctgggcctcaacgacaaggtcctctttgagaacacgggccgcggcagaagcaattccggtggagctggaggatgtgaatgttccaccagtgtgtgcggctatcacgcttcgagaatgatccgcgaccatctccttcgatcccacccgagcggcgagttcgagctcatgtcctaccgtctcgacagccacgtcaagccttcgatatggatcgagtcggtgatcgagaagcattccccacagccgagatcgagtacatgatcagaggccaaatagccagtgcaagcggcggtcaacagccaacaacgtggagatccagcattcccgtgcccaagtgatgccgactcatcccaagttcaagaccgacggtggggagcgttaagtgggtccccgagaacagcgagattgtgtggtccatcaagtccttccc

SEQ ID NO: 491504 - DNA, 983 bp, Homo sapiens
gtgtatgttttgttttggttcctgtttggtgtgagttttttgtctggtttaggctttttggttgattttgagggttcttatggtgtttccccattatgttccctgcctttcaccctttgggtgtgtgttgtgtttcgtgagtctctgttctcttctgatccctgccatcgtgctgctctttctagctactttccagcattatgcacttctaatgttgttgtccgtcgctgtacttatgttggccttcacacagactgatgtggctaccttctcagattttacaggggatggtcaatccctttgcatttgaatgaagactttgcattcactccaagtttggtaatacgattgtacatggagttttgatcaatcggacttatctcagctctcctaggaactttaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagtactgttatggaaggctgggttaaagttatggttccagaagcttcctaatcctgattatagtatgttgttaatagatgcatacctcattacactcaatgcctgttgttaaagagcctatggggaattgctgctctttaccaaagaatggttgataggcccagtagcccatcttagttacggggaatgggaagcaaggaacgaagggttgttcaaatgcccactttccagtttggccttatgcatacatagcagacttgagtgtatgcaggatttcattatatgaccatgaggttttttgatttgtataattgttttagtaagttcaagaaagtagcgctgggaccacggtggcttcaatgccatgtaatcctggcaactttgcggaggctgcgtaccggcggagtcaacttgaagggtacgggaa

SEQ ID NO: 491505 - DNA, 474 bp, Homo sapiens
  misc_feature (60)..(60): n is a, c, g, or t
ccgcgcagctcttgttgctcaatgatcttgggggttgtgtctgttctcccccaattcttntgtggccccatcccctatttgttaaaacttacgtgtaaccccaaaattcacacttatgtcactttcccagtcatttgcgggcacgcacaggctgctaaaagcccaagttgcgtggtgcttgggtgcctgctggggtgagcgaggcaccctgccctctgccactgctcccatgttggaagcaaattgtcctttctccatctactgagggccatgcttcttgcatttgggggctcttggtgattttgctttttagatgcccctgggggaggtgccgcagtgctgttgagtgtccctggacacaggcaggctgggatgggtcccatggagagaacgtgtgttggacaggctctgccccacgtgagttcagtgtcggagaacaataataattataaagttctttaaaagaaacgtaaa

SEQ ID NO: 491506 - DNA, 387 bp, Homo sapiens
  misc_feature (1)..(1): n is a, c, g, or t
  misc_feature (73)..(73): n is a, c, g, or t
  misc_feature (91)..(91): n is a, c, g, or t
  misc_feature (95)..(95): n is a, c, g, or t
  misc_feature (99)..(99): n is a, c, g, or t
  misc_feature (115)..(115): n is a, c, g, or t
  misc_feature (117)..(117): n is a, c, g, or t
  misc_feature (192)..(192): n is a, c, g, or t
  misc_feature (198)..(199): n is a, c, g, or t
  misc_feature (237)..(237): n is a, c, g, or t
  misc_feature (247)..(247): n is a, c, g, or t
  misc_feature (250)..(250): n is a, c, g, or t
  misc_feature (253)..(253): n is a, c, g, or t
  misc_feature (312)..(312): n is a, c, g, or t
  misc_feature (381)..(381): n is a, c, g, or t
naaacagctatttttaaaaacacaacaaatacacaacacaaaacttggtaaaaataactcactatatggtacntatacgccagcatgcgcngctnatanatttatataataaaantncaaaatactcactttccataataaaaataagcttcgtagtttttgtgctgttattttacaagtatactgtaatangtctcnnccgtgtcttgtacctgtcctctccacctgtaatgttangtgtaatccncanatnaaaacgcgcgcgcgtaaaaaaggcgcgatgcgtaaaaaataaataaacatcgcggctangcgcggcgcgcgcgcgagcgcgagcgcggcgcgcgacgcgcgcgcgatttagcgcgaaaaaagcgacgncgcgaa

SEQ ID NO: 491507 - DNA, 1191 bp, Homo sapiens
  misc_feature (6)..(6): n is a, c, g, or t
  misc_feature (8)..(8): n is a, c, g, or t
  misc_feature (10)..(10): n is a, c, g, or t
  misc_feature (13)..(14): n is a, c, g, or t
  misc_feature (16)..(16): n is a, c, g, or t
  misc_feature (19)..(19): n is a, c, g, or t
  misc_feature (21)..(22): n is a, c, g, or t
  misc_feature (26)..(26): n is a, c, g, or t
  misc_feature (668)..(668): n is a, c, g, or t
  misc_feature (732)..(733): n is a, c, g, or t
cgcgcngntncgnncnggnannggangtgagctgtcgcgggcggcgcccggccttgctcaacgcccagcagtccccaccgtcgctgccgccgccacctgccctcgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggcacaccagccaccgtcaccaacgcggtgtcctggcggtccgaaggcatcaagtatcggaagaatgaggtgttcttggacgtcatcgagtctgtcnacctcttggtcagcgccaacggcaatgtcctgcgcagcgagatcgtgggctccatcaagatgcnnagtcttcctctcgggcatgcccgagctgcgcctgggcctcaacgacaaggtcctctttgagaacacgggccgcggcagaagcaattccggtggagctggaggatgtgaatgttccaccagtgtgtgcggctatcacgcttcgagaatgatccgcgaccatctccttcgatcccacccgagcggcgagttcgagctcatgtcctaccgtctcgacagccacgtcaagccttcgatatggatcgagtcggtgatcgagaagcattccccacagccgagatcgagtacatgatcagaggccaaatagccagtgcaagcggcggtcaacagccaacaacgtggagatccagcattcccgtgcccaagtgatgccgactcatcccaagttcaagaccgacggtggggagcgttaagtgggtccccgagaacagcgagattgtgtggtccatcaagtccttccc

SEQ ID NO: 491508 - DNA, 248 bp, Homo sapiens
ggggggggccccccccccccccccccccccgggggggggggggggggggaaaacccttatttttttttttccggggggggggtttttcccttgggaaatttttttttggttttttccccccttggggggtgggggccttttttttttttttttttttttggcccccccccccgggttttttggggggggggaaaaaaaaaggggaaaaaaaaaaaaagttttttcccccgggttttttttttttttta

SEQ ID NO: 491509 - DNA, 452 bp, Homo sapiens
  misc_feature (225)..(225): n is a, c, g, or t
  misc_feature (237)..(237): n is a, c, g, or t
  misc_feature (257)..(257): n is a, c, g, or t
  misc_feature (279)..(279): n is a, c, g, or t
  misc_feature (283)..(283): n is a, c, g, or t
  misc_feature (286)..(286): n is a, c, g, or t
  misc_feature (316)..(316): n is a, c, g, or t
  misc_feature (334)..(334): n is a, c, g, or t
  misc_feature (354)..(354): n is a, c, g, or t
agaagaactgccctggcaacatgcaagtacagttctagcagagacgccaaatcaactgtcaaaaccgagccactgccaccccacaaagccaggaaaagcttctaactgacaatcttgggtaagtcggccctcagcctctgcatctcccaccacagaccaaggctcccagatccccccagcccatgcactccatgtggtcccctctgtgtgctggaaaacaacggnattttgggtgtncatggggaattctgccctgnccacaggggttaaatcatggtnaatnatncaatgtgggaaattctggttcacgaacctncaaacacaaaaaccagtnatttttcccaacaaacctgnaccaactctgttattttccataaacgctggtcggctgggcacagcgatcttggcaacagattttgcgaaataaacttggtcagtggatcccagtcaaa

SEQ ID NO: 491510 - DNA, 512 bp, Homo sapiens
  misc_feature (75)..(76): n is a, c, g, or t
  misc_feature (101)..(101): n is a, c, g, or t
  misc_feature (108)..(108): n is a, c, g, or t
  misc_feature (123)..(123): n is a, c, g, or t
  misc_feature (131)..(131): n is a, c, g, or t
  misc_feature (136)..(136): n is a, c, g, or t
  misc_feature (161)..(161): n is a, c, g, or t
  misc_feature (222)..(222): n is a, c, g, or t
  misc_feature (285)..(285): n is a, c, g, or t
  misc_feature (474)..(474): n is a, c, g, or t
  misc_feature (503)..(503): n is a, c, g, or t
cttgtggctgtgtcgtgcgcgtgaccccgtaggcagcgggaggaccagctgccgcgcggggaggaggccgaggcnnagcttgagggaggccccggccctcngcgcctntgtctggcagatctntctgtganactanacaatccctgccccgccgccgggantaatcaagagttttggccggacctttgagcatacaccgagagagtgaggagccagacgacnagtacacactatggcgctgaaacaggattaataaggaacttagtgatttggcccgtgaccctncagcacaatgttctgcaggtccagttggggatgatatgtttcattggcaagccacaattatgggacctaatgacagccatattaaggcggtgtattctttttgacaattcattttctacagactacccctttaaaccacctaagggtgcatttaccaccaggaatttatcattccaatattaacccgtnatgggcagctttggcttcgataatttttnaggaatccg

SEQ ID NO: 491511 - DNA, 376 bp, Homo sapiens
taaggatccccagactgtcgacaggttggttagtgcagttggcacaaagtctatggctcacagtcagccttgatcttgccagtattcatgctactcctccaactcatctagtgcttctcctatatgtgcttgtgcagttactggcttaaccgtcaaactctgtccgggctgaattacatatttggtactgaaaggcttgggtccttaatgtgtcttatggcgaatcttcttctttcgcaggaacctttaggatagttctaatctaggagctcatgcttttatgcattgtaatatctttcttatcttgaagttattttgacttctcaattctccaaaattatatacctaaacctgtttttaaagaatgatactctac

SEQ ID NO: 491512 - DNA, 167 bp, Homo sapiens
tcagacggctgtgactgcaaggaaggtagggtgaccaacttgtctaatttgtccaagactttcccagttttagcactgaatgccccacatcccaggaaatccctcagtgccaggcaaactggaacagctgatcaccctcacctgccttggggctgctgcagaggcct

SEQ ID NO: 491513 - DNA, 763 bp, Homo sapiens
  misc_feature (363)..(363): n is a, c, g, or t
gtggcctccggtcgcccaccgagacgggtccccacggcgcacatcaagacggagcgagcgagtcccggccactacggcgacagccccgaggctcgcccgactacggttcctgcagcggccagtccagcgccacccgggcgcccccgccggacccacttcgccggctcacagggcgactatggcgacctgcaggcctccgaggcatacttagtggtgccctacccgtggctagcggcgaccacggctctcataccaggtagcgctcgcttgcgttccacgtcagcccgcagcgcggccccgtacgctccgtctacccccctgactttcaaaaccgggccccctttggtgccccctttgtgcccngcgccccgccccggagaggcccccaatttcccacggttccaaccttggggcacccgaagcgccgggttgtaaccatacaacgccctggacgccaggccccttggagaggcccgcatgcgctgcgggcgcgtaggggactcggcagggcggttcagcggggcgagccattggataccacgggcgccgagtgggtgtcgtcgactcggggctgggaaggggcgccccagagttgcgcttgaggcttccaacgtgacctgctagataggtctagcccggggataagcacgctatgcttgcccaagtggaccctcgaggctccaagataagccacatctctctgccggatgatggacctaggtctcgtctcccttactatcgtttgcttttcgagggtggtggg

SEQ ID NO: 491514 - DNA, 225 bp, Homo sapiens
cgctggcaatggagacaagcatatcccttgacaagaatctatctaccttccatagcggccaggctccactgaaacaacactcttatgctgactaacaccatcagcctcaggcctccttgaagcatctatgactccgttcagatgcaggactggatcggcacagcacaatactgtcccgctgtcggatctacaagccgtcaggaagaatctaccatgatgccgatt

SEQ ID NO: 491515 - DNA, 257 bp, Homo sapiens
accagatctttggaccttaactgcagacactccgtgagttcatcctgctccttctgtttttccacacatctttgtatggaagaattcttacttgaagtctctcaaggggcttgcctagaggagaatcacttgaacccggcagacagagcctgtagtgagccaagatcacaccattgcactccagcctgggcgacaacagtgaaactccgtctcagaaacaacgggaaatgcacaccagggggtactctgcttcatct

SEQ ID NO: 491516 - DNA, 110 bp, Homo sapiens
ggtgattagaggatccggatgaagtgttggtaggtgtgtcacgtcttctggaggtgtgctgctgcctttttgcctggagtgacagctgctttcgacactttgcatcagag

SEQ ID NO: 491517 - DNA, 256 bp, Homo sapiens
ttgagtgccgctacttgatatacctagctactggacagactgagtgccacattgattgcttgagcacgggaagtccaggctgcagtgaactatgatcgtcccactgcactccaccctgaagtgaaagaatgagaccctgtctcttagcgaaacaaaacaacacaaaaatcactgaaattaccagtgtcacccaaccttcagaaagcaccaccctaagcagtcagccgccatcaatgtcacgaatcggaacatcagg

SEQ ID NO: 491518 - DNA, 104 bp, Homo sapiens
ggctactggaaacaacccagctctggtatgacactgctgcctcatatccgggggacatgtgggctttgtgttcaccagaggtagcgccctcgactgacgatcag

SEQ ID NO: 491519 - DNA, 406 bp, Homo sapiens
  misc_feature (11)..(11): n is a, c, g, or t
  misc_feature (25)..(25): n is a, c, g, or t
  misc_feature (218)..(218): n is a, c, g, or t
  misc_feature (406)..(406): n is a, c, g, or t
aaaaatttggncttatgaaaattcncttggggaaatgtggaaatgaatgataatcccttgtcttttccccatcatatgtaaaacccctccccctccctctctatctttcccctccctaaaagatgagctgggctgggcgcggtggctcaagcctgcaatcccagtactttgggaggccgaggcgggcggatctcgaggtcaggagatcgagaaccatncctggctaacacggtgaaaccccgtctctactaaaaatacaaaaaattagccgggcgcctatagtcccagctactcgggaggctgaggcaggagaatggcgtgaacccaggaggcggagcttgcagtgagccgagatagcgccactgcactccagcctgggcaacagagcgagactcggtctaaaaan

SEQ ID NO: 491520 - DNA, 97 bp, Homo sapiens
aggtggacccctaccatggaggagaccatcaaagatcccccccacatccagctgtcttcctggatcactgtcattctctcaggtcatctttaacagt

SEQ ID NO: 491521 - DNA, 283 bp, Homo sapiens
tccactagtgtaggagtaatggcacatgcctgtagtcccatctactgaggaggctgaggaccgagaattgcttgaacctgggaggcagaggctgcagtaaaccaagatcaccactgtactcgagcctgggcgacagagtgagactctgtctcaaaatttaaaaaaaaaaaaaaaattatatgggactggaaaaggagtgccagtccattgcaacctgtggataataccagctccatgtgagggtggatctttcaattcattcaccaagcaagcatgcttttga

SEQ ID NO: 491522 - DNA, 256 bp, Homo sapiens
  misc_feature (113)..(113): n is a, c, g, or t
gatttcacaagtgtggtgttttcccaaggcccccttcccaaggtcagtgcaaacctctcactcccaagtttttttgaggccacttgcccccaagcatttcacaaaaaaccctngaggggttgggtccatttgcccttttacaagggtaaagccaatttcattaatttttgtttctttgggcctgatttgtatctctggaaggcattaattcttgaaaaatttgggtgattttccaaaaagcttttgtaaccagtta

SEQ ID NO: 491523 - DNA, 437 bp, Homo sapiens
agttgcaacgaaccatgaagacctctcccactctgcgaggatggcggggtgtctgctcatgtggttttgcgggggttatcctggtatgcgggagctgccttccaataagtgctggggaacctacagcctgagtcttggtgtgctcagtggccgagtagcacatggtgatgggcttgggagtggcacactgcagtaggctcagtgagccccggagctctgttcttgcttcttgtcttgctctactatagtacacgtgtgtatgagccatcttggtaccctgacagccatccagtgtatggcatgcctgtggcccctgactgatgtgcaggtagtgggcagcatgaacagcaacccctgggatggcatgagacttgccatcccagatccactgtggagaaccacaggccatcaatacgtgtgcagttggcccaactgga

SEQ ID NO: 491524 - DNA, 541 bp, Homo sapiens
tcaggtgatccacccaccttggctcccaaaatgctgggattacaggtgtgggccaccacacccggcccattttctcttctttacagccccgtgatccgtttcccgttgggcacagatcagtggatctacaacctgttacccagcttcccctagccaagtgaacaggtgcccctccctgaagtttgaatggtgagtggagcgacagcgatgttaagaatagttgcggttcgggtctgtctgtccaggctgttctgcagtgggactgttgcggttcctgtttcctggtctccagccgccttggcttccacctgtttccaagtccctttctctggcctacagtcagttccatgagttcctgatagttttccaatcagtttccttttgctaagttacctagaaaggatttctgttgcttacaatcagagaaccttagctgttatacgtaaggagcacaggaaacatttgcaatataagggcagggtcccctgagagctgggagtcgtgtgtaggaggggccatcctcagattaggaagaagactt

SEQ ID NO: 491525 - DNA, 492 bp, Homo sapiens
gacacttttaatattatgttatgacatgctggttcttactgtattttattaaacatgatactagttagtgggcaattaatgtgtttagactcataccacaagttcctgccttctgtgtgttatggttgaatgtcagttcagttttcaaaacatttgtagcgctatttgaattttctcatgtgtgtgccacccactggctaatctgtgacttgtagagtgttctatttcttaattcagttctcaaagactttgatatgctgactagaatcagatccatttattcatagctgtgggtaagactgggagctcataaacaactttacggtgttgctttttaaaattcttccctctccttaatattttctggctgtctggagtttctcttttcagttatctggctaaaaagctggggctttagttatctgctctgccatgcagttttgtggctgttcctaagtgacatgagcacaaacaatgggagaagagagttag

SEQ ID NO: 491526 - DNA, 127 bp, Homo sapiens
cgtgatgacgactctagaggtatccccctaggtcttcaacaggctgatgtttcaaaatgtggggtcacagaaaagacgcttctagtgctgaggtcaaagctgactgtggtaggagatggggtctccc

SEQ ID NO: 491527 - DNA, 843 bp, Homo sapiens
gaaaaacacaaggatgcccactcacaccacttctcttcaacattgtattggaagttctagccagagcaatcagacaagagaaagaaataaagggaatccaaatcagtaaagaggaagtcaaactgtcactgttttctgacaatatggtagtttaccttgaaaaccctaaggactcctccagaaagttcctagaactgataagagagttcagcaaagtctccggatacaagattaatgtacacaaatcagtagctcttctatataccaataacaaccaagcagaaaatcaaatcaataaatcaaccctttttacaatagctgcaaaaattaaaatacttaggaatatacataaacaaaaagtcaaaagacctgtacaaggaaaattaaaacactgctgaaggaaatcatagaaaacagaaacaaatggaaacacatcccatgctcatggatgggtagaatcaatattgtgaaaatgttcatactgccaaaagcagtctacaaattcaatgcaatccctatcaaataccaccatcatgtgttcacagaattagagaaaacaattctaaaatttatatggaacaataaaagagcccacatagcaaaaaaaaggtaagcaaaaagacaatctggaggcatcaactactgattgaatatactataaggctagtcaccagacagtgtggtcatggtcaaaataggccgacacgttgattagaccgaatttaccatattagcagtgttttcaagcacaaaatatggggaaggctttcaattgtggttgggcggggaagaggggcttttttaaaacggggtagataggaattaaggaacattgggggtcca

SEQ ID NO: 491528 - DNA, 270 bp, Homo sapiens
atgtgcacagaatgagaaagcctgacacaggtgcctcccgcgaagactgtaatgtgctggacttaccctttaaattattcagaatggtggtgccgtggaaaatgtgtgcctaggatgccgtctcctgcagtggacagcggcggggagaggctggctgctctctaacggttgattctcatttgtcccttaaacagctgcatttcttggttgttcttaaacagacttgtatattttgatacagttctttgtaataaaattgaccattgtaag

SEQ ID NO: 491529 - DNA, 252 bp, Homo sapiens
ggattacttattcgtgttgcacaggcggaaaattacagaaggcaggcacagtggctcaggcttgtaatcccagcactttggaggctgaggtggggggtcacctgagatcaggagtttgagtcgagcctggccaacacggtgaaaccctgtctatactaaaaatataaaaattagctgggtgtggtggcatgcacctgtaatcccagctacttgggaggctgaggcatgacaatctctgtgcaacacgaataa

SEQ ID NO: 491530 - DNA, 1334 bp, Homo sapiens
taatggggcttgggtgagggaggtaggtggtagttggtgttaaatattttaagtggggtgatgaggaactagtgtgttaaggagttatgtgggggttaatttatgtgggtgggccattacttattaacccaaaaaaggattcaaaacccagcagaagtgtgcaagcagcagtgtgaaccaggagtggctcataccttctctgtggctttcccgtggaacaggatgtgaattttacacttcactttgtgacacaagccctattttctcaagttaattatgtggtgggattgggattggctgtggtttgtgggttttgtcgcagccttaaacaataaaaatttctcaaaattaccacatttctatagttctcttacaagaaataagtggtcttataatttggtgtgtccccaattctcacggtgtagaccagttagagaggccttcacccctcgagcaatatagaggggtgttaatcacctcgcaggtttctatacaccacattgtgtgtgtgacaagaacaaagagggtgtaccccagccttttgggccacaccggagaagtgtcttttatcacctcaattaaacggcacacgagtgttgttttacacacaccaaaacacacagacaacacacacacaccccctcgcgagagcggcgcatctatcatcatagtgtcgcgcgcgcgtagccgcgcgcaccacaaaccagcgcggcgcccccacggccaccacgatggggggccccacccagaggtggtcggcccaacaactacgccgccgcttgcagataaacaccgctgacgacgcacccccccacacacccacattcaactagcggcgatggtcacccaaccaacaagaccggagctggcggcaacaacaacaaactctcgcctcgagccgcggagagaccactccaccccccccccaatattattaccgtggcggaaagaccatccccggccacaacaactcacaaacaatactacccacgaaacaaaaacagggacgcgccccgaaggacggtcggtaaacaaaccccccccgggtgggccgacattaaatggaccaccccaccatccgcgcgccacaaaacacaacacgccacgccgcgtaccaaccaccacacaaccaccacccaacgcccacccgcacccagccaacgccccaccaccccaacacagcatacacgcccagaacccacccacacgccgcaacaacgcaacccacacaagacccaccgacctaccaccccacaccccaccccactacaccactcgcgccacacacacccaacccatcaccaaacacaacacccgacaagagcacaccaccc

SEQ ID NO: 491531 - DNA, 460 bp, Homo sapiens
gtataggttcattttgacagtgctgattaagacataaccaagactgggtaatttattaagaaaaagacgtgaatgaactcacagctccaggtggttggggaggcctcacaagcatgacagaaaggcacgtcttaaatggcggcaggcaagagagaatgagaactacggcaaaggggaaacctcttataaaatcatcagccctcatgagatctatccactatcaccagaacagtatggcggaaactgcccccatatttcgattatctcccagtgcgtccttcccacaacacatggcaattatgggagctaccattcaagatgagttttaggtggggacacagccaaaccatatcaggtggggaaacggatgcattctctagggggtaggggactggttttgctaccagagctgtttatggaagctaaagttcaccctgtttcccaccgagccgctgctgga

SEQ ID NO: 491532 - DNA, 173 bp, Homo sapiens
cgacctagaggatcccatcaacacggtagtattaagttcttaagatcattttatatatatatgtgtatatatataccatggtatatacgtagtatatatataaaatgatcttagaaacttaaatacttaccgtgttgaattttcgttggaagtgaattcttatcttaaaaatc

SEQ ID NO: 491533 - DNA, 649 bp, Homo sapiens
aaacgagggccagtgtatactgacgggcaggggtagaagcgggagccggatttatatcgtagggtgtgggttctacgtcgagctctttggtagctgatagaaggctgtactgaagacagcaagtcctgaagccccagatccagaaagcaactcagggcgaagagagtagtattgttgctcatcctcataggagggggcttgcgtcaccccagggctagggtcaaactgacccaggacccagggagtatttaatttgatttcagtacttgctccattcccataaatcatgagaacatgatgcttttcaaatttaaacacttagaaacagcttattaacacatatagaaggacctctaagctttcccctgtttgcctaatatacaacacccacagacccttctgagagtctgacaggagctttaaccttgagggaagggactcaaaggtgtgcacacttctcccacagtttaagtgccttctgccaacaacttctaaggtgctggtgccaggagaggactggggaggacgttgggatggctatggggcatgtacaacacaaagcaacagagaggtcttcatgttagggaagtggctgggcaggatgccaaacccaaatgacttattgagcaattctaaaccaaacagagag

SEQ ID NO: 491534 - DNA, 460 bp, Homo sapiens
  misc_feature (79)..(79): n is a, c, g, or t
  misc_feature (180)..(180): n is a, c, g, or t
atggaatcttctgcgatacaacaattcgtatctacagaaggtaactatgtttccacaatgcaaattttcccgcgagttnctacatcctcgctactggctcacatggtttgggcttggtgtactctggctttgggtacagcttccttatcctgttctctgctttctcggcacgcgtattgncgcaatggcgcgaccattcctgaaacgtcgtgaatctatcgcccgtaaaaacctggaactttgtttcccgcagcattctgcggaagaacgcgagaagatgattgccgaaaactttcgttcactcggcatggcgctggtagaaaccggcatggcatggttctggcccgacagtcgcgtacgtaaatggtttgatgttgaagggttggataaccttaaacgcgcacaaatgcaaaatcgcggcgtaatggttgtcggcgtccattttatgtcgctggaactg

SEQ ID NO: 491535 - DNA, 315 bp, Homo sapiens
  misc_feature (5)..(5): n is a, c, g, or t
ggtantctgtggtagcaaagagaagttatttgtgcccagcattggtcacttgggtgatgcaccagatagcaggcagatgttggttcatatggcttcgtcctctttcctcctaaaataatattggctttaccatcttaactcagctgtgggtttaacgtgggtacttgtacgtccacttggcatgaattgtcatctttgcgtgttttatttaagcccctcagcccctcaatataaataaggcctccaggtatcaagatctcatattaggatttactgtccttaatttattgagcaaaatctggaaaatgtgaaagc

SEQ ID NO: 491536 - DNA, 148 bp, Homo sapiens
ataaatacgggaaaagagaacaagattactatcactaattgacaaggggccgtttgagcaagggaagacattgaagcgtatggtccagggaagctgagaaagtacaacagctgacagatgacgacagcagcagggacacaggtgtcat

SEQ ID NO: 491537 - DNA, 262 bp, Homo sapiens
tttgtacggggtatccgagtaacgtcggggcatcggatagggcgagaaagtgttgtgggaagaaagttagatttacgccgatgaatatgatagtgaaatggattttggcgtaggtttggtctagggtgtagtctggagaatatggggaatatcagttgaatgagagcctccatatggatggcacaatacatgctccatattgatatggacataggtggaacgctgagctacagacgtactacatgcccgggtacatgctagt

SEQ ID NO: 491538 - DNA, 205 bp, Homo sapiens
ctcagccttccaagtagctgggattacaggcacccgcacaccacttcctggctaatttttataattttagtagaagtgggatttcggcatgttggctaggctggatctcgaacgactgacctcaggtgatgcctgcctcagcctcccccagttgctaggggttacagatgtgagccactgaacctgggcctggtaaggcttctct

SEQ ID NO: 491539 - DNA, 105 bp, Homo sapiens
cccagggtggggctggggctggagacgacgaggaggaggaaagtccacctgtccctcctgggctgctggattgtctcgcctgccaaataaacaggatcagcgcac

SEQ ID NO: 491540 - DNA, 538 bp, Homo sapiens
  misc_feature (45)..(45): n is a, c, g, or t
  misc_feature (67)..(67): n is a, c, g, or t
  misc_feature (87)..(87): n is a, c, g, or t
  misc_feature (127)..(127): n is a, c, g, or t
  misc_feature (134)..(134): n is a, c, g, or t
  misc_feature (141)..(141): n is a, c, g, or t
  misc_feature (152)..(152): n is a, c, g, or t
  misc_feature (160)..(160): n is a, c, g, or t
  misc_feature (165)..(165): n is a, c, g, or t
  misc_feature (171)..(171): n is a, c, g, or t
  misc_feature (186)..(186): n is a, c, g, or t
  misc_feature (189)..(189): n is a, c, g, or t
  misc_feature (197)..(197): n is a, c, g, or t
  misc_feature (220)..(220): n is a, c, g, or t
  misc_feature (223)..(223): n is a, c, g, or t
  misc_feature (225)..(225): n is a, c, g, or t
  misc_feature (227)..(227): n is a, c, g, or t
  misc_feature (260)..(260): n is a, c, g, or t
  misc_feature (264)..(264): n is a, c, g, or t
  misc_feature (269)..(269): n is a, c, g, or t
  misc_feature (296)..(296): n is a, c, g, or t
  misc_feature (299)..(299): n is a, c, g, or t
  misc_feature (301)..(301): n is a, c, g, or t
  misc_feature (306)..(306): n is a, c, g, or t
  misc_feature (318)..(318): n is a, c, g, or t
  misc_feature (322)..(322): n is a, c, g, or t
  misc_feature (327)..(327): n is a, c, g, or t
  misc_feature (349)..(350): n is a, c, g, or t
  misc_feature (371)..(371): n is a, c, g, or t
  misc_feature (379)..(379): n is a, c, g, or t
  misc_feature (381)..(382): n is a, c, g, or t
  misc_feature (386)..(386): n is a, c, g, or t
  misc_feature (388)..(388): n is a, c, g, or t
  misc_feature (399)..(399): n is a, c, g, or t
  misc_feature (404)..(404): n is a, c, g, or t
  misc_feature (412)..(412): n is a, c, g, or t
  misc_feature (464)..(464): n is a, c, g, or t
  misc_feature (538)..(538): n is a, c, g, or t
gaccctcaactatcagcaaaaccaacctcaagaacaccggcaaancaaccacacaaaaatggaacanaaagaggcttgcatggacancaccccattaagaaacaacaatggactgtcccctctttgngccaatngcctcangacggacatcncggctcgnatctnaaaatngccctcttttaaacnacngcacaaanaaaagctgggtggaaaaaacaanccncncnccaacctgataaccacctttaaaaaaaaccatnaccnccttnatgccttgggaaaaggaacgcttttcnacntnaggcncaacaataaaanaagnctgtngaacgaccgtaaaaaggtaacnntaggcacccaacccaccgtantaaagacntnncgtncnctttcaaccancaacntctttacntgtactaaccgccccacagtcatcaaaagcagcaaccacaaaaaggtcttcncaaaaatcaacctcaaggaagtaaacaacatgtatcccctcaaaacagaaggctatcctgacagcctggcgcan

SEQ ID NO: 491541 - DNA, 248 bp, Homo sapiens
ccaacttttttcccccggggggggggggcggttttaaaaagggggttttttaaagggccccccccccacccgggtggggggggcggttttttccccccgaattttttttttaacccccccggggggggggttttttaaatttttgaaaaaccccccctttcggggggcctttttatgggggcccgggcccccccggggccttggggttttggttgttttttttttttttaccccccctttttttttta

SEQ ID NO: 491542 - DNA, 268 bp, Homo sapiens
attcgcggccgcgtcgaccttaattttaaaaatactttattgctaaaaaaaaggtatatacattgttattttatacataatgctattgcacacttaatagactacagtatagtgtaaacataattattgtctgtttgtttttgagacaaggtctcactcttactgggggacctgccccgataatcacgtaggttcttttctattttcctaagtgtcggctggcttgagaaataaagggactgtcaacgcggccgttaatttagtagta

SEQ ID NO: 491543 - DNA, 955 bp, Homo sapiens
gagacagaggcttccagacgaacacagggctgcagtcgcgagcaaccctctgaagaagggaattacgctttagattcttcgatagcaatgttccagtgaatgaaatatagagtgttagcccaagacaccatgtacaaaatagcccagtcctttctgacgagtaactttgggaaaacgaagctgtcagaagtttctaacttacaaactggtttgaagattctttgatgcccagacagcaagtatccaatcacttttggaggcttacttttcatgatacaaaagcaattctgtgatgacttttctcttttcaagacgaaacgaaagatgcaagctagtttgtgagcaaaggaaggccaaattgcggtccgggcggacgggctgtggacggtgcacggaacgtctcaaagatcactaatagggcgaggacacacaaactttcattcacacgaattttcccaaacgaggattgataaatcttttctttaaactcgcatttgtaaacgctgtgtttccagttatggtcaagagcaagcttagtggggcgagaaatctggcgattctgggtgtgttccataacacgtggtcttcgtaatttgtgtgataacagaggttcacccccttgtatacacaagtgttgtacaccaatttgaatttacggaattacccaccgttctcacacacgtgggttatctcccaaaagggttgccaactcttccctcagtggacctaattttaacccccctttgtgggttgatatatctgccttcactttttgtggggcattttaaccgttgggttcccgttgggggaaaccattaaaaggtgttgtttaaagaaaatttctacatcattggcccattttcaaatgggccgacccactttttcctttgtggcgcccattgtggcgatggcgttgtattcaatcaggggcgattagttggccaaccattccccc

SEQ ID NO: 491544 - DNA, 166 bp, Homo sapiens
tgaatatcgggtacaagtcatgtgtagacatccaccctcatttacttggggttaagatgtcaactactttttttaaaaaaaaaaaccggatatttattggagcacttataactaccaggccccgtgccaacgccttaaaggttttatctcctttaatcccggaagg

SEQ ID NO: 491545 - DNA, 158 bp, Homo sapiens
agctcggtacccctttttttttgatatatctttttgtgtatatggtgaccacacaacacaagcatattcaagaattggttgaaccagtgcacaataaagagtcttactaagatatgggtcacccaaatcttttacccgtctcttaacaaaacctaaca

SEQ ID NO: 491546 - DNA, 326 bp, Homo sapiens
  misc_feature (273)..(273): n is a, c, g, or t
  misc_feature (282)..(282): n is a, c, g, or t
gctcgtaccttctggagctccggcgcacatgcaggctggagatagagctgcagtcccagctcagcatgaaagcatccctgtgagggcaacctggcggagacagagaaccgctactgcgtgcagctgtcccagatccagtgtgctgattaggcagctgtggatggagcacgctggcccatgcttcgctagcggagatggagcagcagaaccagtgaatacaaatatcctgcgtggatgtagaagacgcgtgctggagcagtgagattgccaccntaccgccgncctgcgtggaggcgagaaggatgcccacactagcctcaagtaca

SEQ ID NO: 491547 - DNA, 1113 bp, Homo sapiens
ggttcacaaccgcccttttaaaatgcgccttgtgcgcttttgtgtctccggggtccgctgtgttgtcaaggtgttctgtggaacttggtgggaattcaagcttccatggggcgctggggaattgggcctctcttgaggggcgctcgggggggttccaccttggccccccatgtggtgtacaccccctttttcgcgccaccattaaccagggggtttgggccatgtgccctcgcttctggtgggcaacctcttgctggatttgttcaccagggcccatggggaattgggcccctttaattgtcctcttgcaacagtgcctggggcccaaacaaacggttgccaacctccagcagctttcccacggtgtgcacagagggctcgaggcctggtgggggcctgaacacctgctggccgaatttaatgcaacactgggcctggcccctggccccaccaaaatatccccaccccgggttgtgtaaaaggcaacacacaggggccccacgaccacgggggcctggataggccacacggaagactgggtagccccctggattcttacctctagagcacctggcaacgctgggggctggcattacgcgccctctcacccaaactttctccacctggggctttctctgcctggggccacaccacacacacaggggggccccacacatgggtggcgcgcttggcaaaaggcctccaatggaggccccggagaccctcgataatggctggccctcggcgtggggctgagaccacgccccggacagagcacaacggctccacttggcacagcctcgttcctcgtggcgggagagctgcacaggagggcgccacctgtgcacactggccgaggggctggcaagcttttcctggcacgcgctaagcccacagggtggtgctggagagcacccaaaccctatcggcgccctgcttttcccacactgctgttccctgggcctttaacccctgctggctgcttttttggaaatgtgcttttttggaaagtgagagagtctgcctgtccgggctgggacacagagactcccacaaggaccccattttgcctcctttctggggaaataaatgagtgtctgtttcagccagcta

SEQ ID NO: 491548 - DNA, 265 bp, Homo sapiens
gtaaaaaggtctgccaatctctgggcggacgccgtggcattttacacaaagaagtgtatgtgtgtgttctcacattggtcatcatatcattccatgtagagcagttaactcttctgtctcagcaataacaacaacccattacctgtcatggaccagaggggtccctagagaattgcgaaacttgttacctccacatgatgccaagggatctcgttatcatactgaccactactgactgaggactaattgatgtcccctgcatcta

SEQ ID NO: 491549 - DNA, 367 bp, Homo sapiens
tcactccatggcgggtgacagagtgggactctgtctcataaaaaaaaaaaaaaaagaatcaaaaaatcaggccgggagccaggggctcacgctggtaatccccagtacgggggggggggaggcaggaaacctggcttgacccggggaggcggaggtggaagcgagctgaaatcgcgccatggcaccccagccggggcaacaagagcaaaaccccgtctcaaaaaaaaaaaaaaaaaaaaggataaaatagacggagtgtgtttccactttaatttgtggtgttttggagtggagtatataggaaaaatgttctcaatttaaccaaaaaattgtcgcggaaaataattcgggggtaggaaagaggaat

SEQ ID NO: 491550 - DNA, 174 bp, Homo sapiens
  misc_feature (14)..(14): n is a, c, g, or t
  misc_feature (66)..(66): n is a, c, g, or t
  misc_feature (88)..(88): n is a, c, g, or t
gtaatatatgctcntctgtgtgctgtgtgtgctgtgcgtttgtgtgtgtgtatacgtgtgtgtgtntatgtgtgtgtctgtacctgtntgtgtatatgtgtgtgatgtgtgctcgtgtgtgtgcatattcaggcaggtgtgcatttgtgcatgccagtgtgtatgtatgtgcgc

SEQ ID NO: 491551 - DNA, 296 bp, Homo sapiens
gattctaccaggaacacaactctggagaggcctccagtactatcggcctcagagatcacctgcagggatgccgtgtgctcgtctgtgataccttacatgtctctctagtcgctcatggctgcccctgtagtcaatgactcctcaaggatatcaagtgggtgtgcagatgtcccagaactggctgcttggcacatagtactcgtgtgctgcattgtggacgtccggcccctggtacgctgttatcgatctagcctgcgtttgtccaggtaggacttaccggcatgaagtaaatcgaa

SEQ ID NO: 491552 - DNA, 1014 bp, Homo sapiens
  misc_feature (13)..(13): n is a, c, g, or t
  misc_feature (291)..(291): n is a, c, g, or t
  misc_feature (996)..(996): n is a, c, g, or t
tattacaaaattntctagaaaaacgaccgtcctaggcctggccaattgggcccatcggcggcggcggcggacattgtccaccgcaacaagcgaaacgtcacaagatccagcttaatatgcggggagtggcgcggtcccagcatttgttgggcccttggcatgcgtttcgggccggccagttgacccagatttggaaatccaagaaggcgctactcacgaaggtcgtgtattaggacaggaagtaggtcctcctccgtcggatcatcatttggattctcccctttgtcactnggttgaagatcatggtcccaccaatgctcctcctcgtcctcttgagaccctttctctcccgacgggagaataaacagctggttgcggccatcaacaacgcgtaggggagcagcttgcttatcctcctgatcttccgcacgtatttggttatgtggatctttccaccactgatcctgtttctctttccgattagttttggtttcgtcttcatctttatggatcgatgcttcacagttgccaaggtgaacaagaaagtccacaataaaatccaaccaatacctttcaacaccagaggcatcccgattctggtccatcgggtacaagacgaccaacaaccgatgaagacagtgagtcagtatatgacgaaactcaaccaataaagataagttaggtcacgtacccttcgacgacaaattcacttcgacgttcgggttctggacaggtatcttgtcgttcgctttttcaaagaccacctcgagctaggagggaattatgtatccgacgatcgatctataccggcaagtattatgacgtgtcatctttgacacacaacaggtgacaaaggcaaacaaaaggaggagggtggtattctctgtcaactttgagctctctttatcaaatgtaatcccaaatccatgagagcatttgtttaacccaattaaaaaaaataaaacaattagccgttttagacgaagatagcatttnttataccaaaaaaaaatg

SEQ ID NO: 491553 - DNA, 121 bp, Homo sapiens
tactcaaataacttaatgagatgaaaaactctcagcctggcttactataaaattccccacatacgggcagctacaaagtcagtcagtctctagtcctttatcgctgtactacaaacacacc

SEQ ID NO: 491554 - DNA, 924 bp, Homo sapiens
tatgttcggctaattctggtattttgtccttgagacagagtctcgctctgtcgcccaggctggagtgcaattggtgcaatctgctagcgtcactgctaagactgctcgctcgtcccaggttcgcgccatttctcctgtctctaacacatataagaacaatgtggcacaatgttagtgagaaacaaattcagtcattatcccagttgtccagagaaacttctagtgatacatactagtttacatttttgttatatacactcctgttttagccttataactgcttacagaacattcaggtgttctacgaaagccggattttatattcaaagcattttactagttttataccctactttttaaagacttaactggattatcttgactctcttggcgggcaacctagtttccatgactgctgggcatcttagtactatgagatgtaccacagtattctgatgacgttgctcactgtcagggtctcgaaggttgttgccagttactgatctattactctatagcacagtgcaggtacattcttggagctaaacctctgagtgtctgttgagctctgtaggcaggatacgagtcttgagaatcacagttaggtgagtcaccagggtgtgtgtcgtatcactcttatatgtagcacgcacgacgtgtatgtatgtacgcactttgattttgtgctcatgcagtgtgcacattcactcgttaatcgtccctatgattggacactggcgtgaacataataccaccttttgagaactcctttagaggcctggcgatacgaatcttgaggcaagcggcttgccaaataagttcccactgtagggtttaccagtggtcggcttcacgcagtggcagttccccgacaccccagaggagtgatacgcccctagaacagtccgcgaccggatggaagaa

SEQ ID NO: 491555 - DNA, 560 bp, Homo sapiens
cgtatcaaaagtcctgctgatgctgctagctcatatgtctgctgtcgactcagcctgtctggccctgattcagaatttatcaaagtcacgaatatccaaataaattgagcaggaggatgtggaatcctctccggcatatctgaggagtgctgggacccagccaggaaaccatgcaatcagaggtcattggtatagtcccaagtacaaatgtcagaaattcaggtcacagggcaagccatgacttactctcctgagaagaagagatatggaagtccatttatcagagtccagggtattccctgcgtcctatgtacaggggatccttgtacagccacttgtgtcccacagaggacgttggcctcctaaggggttgaggcaagcagacagcccggagtgctccagaggaccctctgtgttgttcacagtgtgtgacaggtgacgagggactgaaggccactgttatacctcctcaggggacctttgtggctttggggtctcctcaccggcccccagttagtgttcctcctggttccccgaatcctcctgcctgtcccttcatc

SEQ ID NO: 491556 - DNA, 112 bp, Homo sapiens
  misc_feature (7)..(7): n is a, c, g, or t
  misc_feature (38)..(38): n is a, c, g, or t
  misc_feature (93)..(93): n is a, c, g, or t
ggggcgntgtgcccacgaggcaggggcgtacctgcctntgccccacccccaaacctcctgtataagaagtaccgtattttctgcccatcatantttgtaataaaacttgaac

SEQ ID NO: 491557 - DNA, 234 bp, Homo sapiens
aagcttgtatcataaaaattctggattctggtacatctagagtggcttgaatatcactatatttaatcttaccaaagggtttttattcacacctaaatttggacaaagttaacctgttcccttatgcacaccaccatcttacataaattcattattgggcaccctttttccttttttcaggatccctttcccttgaaaggtattatatttttataccttagggccatttggttt

SEQ ID NO: 491558 - DNA, 282 bp, Homo sapiens
agacaacaccatctctgactaaaaggagtcatctgggagcccgagaatcctactcctgcccgggcacagtggctcacgcaccaacatggagaaaccccgtctctactaaaaatacaaaaaaattagccaggcgtggtggcgcgcacctgtaatcccagctactcgggaggctgaggcaggagaatcacttgaaccagggaggcagagtttgcagtgaatggagattgcgccgctgcactccagcctgggcgacagagtgagactgcatcacaagataaaaaa

SEQ ID NO: 491559 - DNA, 157 bp, Homo sapiens
tttgaggatcccggctctaccttgtctcaatggtatctgctcagtacgagaggaaccgcaggtttcagacaaggtagagcctgagagacaaggtagagccgagagacaaggtagagcctgagagacaatggtagagcgcgagagacaatggtagatg

SEQ ID NO: 491560 - DNA, 749 bp, Homo sapiens
agttctggactggagaagcccttcctgttccgtggcatgggtttagtgcttaggagtatttttagtaacagtcctaactcagtagctatgtaagcacggagcgaagatggagtcacagggcaggctgggcttgcttcccacaggaagggctgggagtggagcaggaaggaaggcctgtgtgagcggcgccttgtgtgcaactatgtctgagtaggcagccggcagcacaatgtctcccttgtaccgagtagctttctcagaaagcgctccgagatgtgagggcactgcattggtggagtgtgacaatatgaaccgcttgaccgaacagacagaaatgtacgacagtcgcaggacggatttggaaaaggccaccccagaggtggagtggacaggaccattaccacctcagccaccctggtcactatcatcaccatggacaaagtgacttgagcagaggctctccttatagagaatctccttgggtcattttgaaagctatggagggaccccctttttccaggctcagaagatgtttgtagatgtgcccgacaacacagtgatcctggatgagatgaccctccggcacatggtccaggattgcacagtgtgaaaaacgcagttactgaaactcaagcgtctgttacaccagcaggacggaagtggatcattgcatgatgttcagtctcattggcatccaatccagagccagaagaaggcgatcagatttttagaatgagttttctaaatga

SEQ ID NO: 491561 - DNA, 963 bp, Homo sapiens
ctcgtctgttgtgtaaccggttcaaaggtggccctcggtgtctcgcccccagggtcgttcttgcccgctatatcgctcattgcggacagctttctccggttcatctcgcgtccagtcaaccagccggcattgtctccatcttgaaatgcccgtggaccagaatgagaacacacctgggctaccgggagggggaacaacacccaccgggggggtctccacttgtatgaggttatatgggatgcgttatccctctctgtgcacgattgtcctctcctcaattggcctccgcgttgttggtggcgccccccgcagcaccccctgcggcaggccgtgtgtgtgaccgcacattatgccccgacgctgccgcgcatgtcttggcacgcagcgggtgccccggggccttgatggctaattcttcgcgcctcgaatgaggcccccttccctcgggttgtgtgctctccgccgattgtgacactctccgtcttccccgggctatttcgcccatgcttggtgttttttgaaacacccgtgtctctctcgtcagtgcagatttttctcgtcggtaattatagaaagttaaagagtgtttccgctcctcccggcgacgacagcgtcgcccaggatgatgtttgaacccccccccaggggtcttagatatccccagaactggtaagatgtcttgcacacgtgggcggacatagaagagtttcgagaagaatttcaaagccccccctcatgatctatctcccattatgtttgcattgcacccgcttcttggatgtataattgttcgcagtgcttctgcgaggtagcgtcgcccaaaattgtgggagatggcgaaagtccccaaaaatgaagcttcatgttgcctcctctcacagggccgcctatgggccaccgatgtaagtcatttccacccacaggccccaagacacaccacacccctttttccaccacaaaaac

SEQ ID NO: 491562 - DNA, 137 bp, Homo sapiens
gggagagcatacttacatcttcacagaaatcacgggacagggcgggtctaaggagttccactccacatagtaggcacagataggccagaaggctaatatactaacattggaagagggagaaagtcagttataaaaag

SEQ ID NO: 491563 - DNA, 279 bp, Homo sapiens
agccatttcttgcacagctttggacgcaccaaacacacaagagacaccactcggtcggccagtcacctggttctaggtggacgaataggaaagcgatgatagaaatatggctctctgacatgctctgcaatctctgaaaccagagagtgttaccgcaaaacccaggcaaaggacacaggagacacaaacagaacgccttaacaagaaccactcaaagcaaaacagcctaccaaggagtagagtgcgggaatgcaacatggcgcggtggctgggagcctg

SEQ ID NO: 491564 - DNA, 560 bp, Homo sapiens
ttacgtgagaagttttctacatgtaaaattaaaagattatatttaaaatacttctttaggatgttattcagccatcaaaaaaaaaaaccaattaaaaggtcttaccagtaaagtattattaaaagcctcattggtgggagattcgcggacttcctgggttaagctggtctggtatttacttaattggtcccctcaaccaggtgttttcttttcagccggtgactggtccggtgccatttttaaaaatagccatcattgagtaagggcttctttaaaataatcccggacaatatcttgggcataatacgacataaagacaagacagtatatgtatgttttcattccggtttggtacgagtgcctcattggtagtcatgaacagtaacatagtacccttaattaaacaatggtaatgactaatctaaggtctaggaataacctatgtcgaagctaagtagaacacttagttggggtgtcaattttctatcatgcaaacaccttagggtacccagaccactttatgtatatatatccctgaaagctccctttaatggtccttg

SEQ ID NO: 491565 - DNA, 177 bp, Homo sapiens
  misc_feature (92)..(92): n is a, c, g, or t
  misc_feature (116)..(116): n is a, c, g, or t
ctaaggacgcggtgatgatgtgcactatgctggcagttgtattttggtaagatgggattcaccatataggcaggctggtcttgaactcctgnactcgggtgatccacatgcttggnctcccaaattgtgggattacagactgacccactgcttctggcttcattttcttaaagaatt

SEQ ID NO: 491566 - DNA, 1195 bp, Homo sapiens
gcaaggagagagtgcggctgctgagagccgagccctagacaatccgctgatcctctgagtcgtgaagtccgggaggcagcgaggtggtgttggggtttggtggcctgatggcaatgccccggcaggtctccgctcattgccagtaggtgacatggatgccaatgggctcgaggagaaagtggatcgtgtggtgcggtgcctcctcgtgtttccagtgctgtaggcctccgttagaagtacagcgccttgtcttagtgcagaccttgagtggatggccatcgcaggatctcaggagtgctccacctactaaaccatggccagcgtcagcttgctagtcgcccagagttcacgagccccaatttgccaattgacgatggcttgacattcagggtgatcaggcacgctcgcctgctaggggcgtaaggtcaagcgctttaacagtccaagaattgccatccacaaacgggccctaaatgcgtgtcgtatcgatttcgtcatctaggcgtccataatgcccaaggcatgtgcccgaacgacgcaggccgaaggccaggctttaagtcccaaaatgctaccccgaacagggtccgaaatgctgcctatgattgttgcccaggcagcgaaacactggtgagttagctgctaacaagtctgagatggcttcaaggccagaatgccactactaaagtgggtccaaatgcgactaaatttctctccaggtctctcaaatgccaatgaccttggcaagcagcacggctaagagccctttcacgggtggcaatggataccactagggcccaaaagatgataccagactctgaatgtaatcacggccaagtggcacatcccaggctgccttaagatcgaccccgggttattcttgacctgacggtgcccttgcgcgaaatttcgagtgggtcccagggtaaaacagggagcccgggaaataaattcggggcagagggaccgcagcatctacactgtcgtttctcaccaccaagctgcgaatcaagaggtggcccttcttgtctgtaatcgtacatgacaaactcacacacagacagacaacggtggccctgatttgctggtctgttcttatctatggtcaacagtgctacgacgggtcacggcacacggtgagcgcgactatcagagaagaacatctgcagaggaatacggcgccatactgtgaaaa

SEQ ID NO: 491567 - DNA, 106 bp, Homo sapiens
  misc_feature (69)..(69): n is a, c, g, or t
ggtagttagagctacatcatttcggcttcttcaaagtaggcatgcataataagaggacagtcttccttnaggtcaatcagctggaatagtcagtctattttatcca

SEQ ID NO: 491568 - DNA, 366 bp, Homo sapiens
tgaaccagtggtggccttttccacagtcaacttgtccctgtggcccagtctggcatggaaccggcagtaaatctgacaccagcatgggaacagagtgcgggccctggagctttggggattgtgagggaacaagacggccaggtcagattctctcagcgtttaaaaggcccacgccttcccgggtaacaattctgggctgagttccccaggacagcattcttgtgtcaactcgctgctaccgcagctgacgacctcacatgtgatgaggcaatgccacctctccagagtgaaaagctcctaagacagaaccattctccccgagatgcttattcccttgaagtgttataaatctcccctttcttgtta

SEQ ID NO: 491569 - DNA, 746 bp, Homo sapiens
ggtcccttgtttcaaaggtatggcacaaggtaacctataagccaaggaacccagaccagttcccttacagagacacttgattagagctggttttagaccccccacccccaacacatagtggttgagagaacagcagcataagtggctggcagaggcaaggaaagaccagcagagagagagaaaggaaagagacagagaggaaaagaggaaaagagagagaggaagagacaggaagagacagacagagagtcaaggatagagagagagagagagagagagacacacacacacacagagagagagaggaagagacagaggcaaaaggaaagtcaaagagagagacaaagtcaaagagagaaagagagagagaaagagagagagatacaaagttaagaaaaaaaagccatctataccaattctaatttagacaaaacagggtcttattaatagcaaaggataattaaaatcccaaattacaagggttttctttattattattattattattatactttaagtttgaggggtacagtgtgcacaacagtgcatttttttaaaatttttttaaaggttttcaactagagtgtgctaaaagttaacgagtgtaacagtgtatatagtaaccttatattcttgtgggccttagacagtctagtccacagacacaaaaagaggtttcgtgtggaaaagagtggttctcatctgcgaaaaaaaaggggaaaaaagggggggggggaattttataa

SEQ ID NO: 491570 - DNA, 310 bp, Homo sapiens
catcatggggtctggagactttcagctttcactgtgttctgagtgagatgtacttcaaaaaaaatggttttaaaaaatttagacatgggattcactattttgatcaggctggtcttgaattcctggcctcaagcagtcttcccatctcggactcccagcgtgctgggattacaggcgtgagacaccatgcccggctgagacgtactttcgagcatacccgacaggccgttacctactgggatgaacgtgagatgggaacatgccagagtagtgtttcaactgctctagctgttcccacactcgcagttaa

SEQ ID NO: 491571 - DNA, 1716 bp, Homo sapiens
  misc_feature (113)..(113): n is a, c, g, or t
  misc_feature (172)..(172): n is a, c, g, or t
  misc_feature (1275)..(1275): n is a, c, g, or t
  misc_feature (1619)..(1619): n is a, c, g, or t
tggaagacagagttttggctcttgttgcccaggtcgggagtggtggatgggctcgatctgggtctcaccacaaacctctctgtggccctccgtgggtttcaaggcaatttctntccgtggccttcaggcctcttggagtatagcgtggggttaaatagggggcatgtgccanccagtgccgtgggctaatttgtgggtggttttatagataagagacagggttttctctccaagtgtgtgggctcgaggctgtggtctctctcaaaactctctccaaacctctcgaggtgtgcactctgtgcgcctctcctgtgtggcctctcccaagagagtgtggcgtgggaatttcacgaggtgtggtgaagccacacgtgtgtgcgcgtggccccgccgtgtccccctctctcttattttatgagggcccgctgaaatatatcaaacgagtataagaagaagaatctcaagctatctctctctttctcagctgtggctgcgccgctgagagaaacaattcttctataagaatataactaatacacgagagtctctttaatactctcgctttctctctaatctccctgtgtgtggtgtcataattctcggaggggtggtgttgttccatcccacgaggagcagcgcgtgcgtagcagaaaaagggcgagacactctgctgggtgctctaccacgcgtggtggatgaaggggtgatcagccggtggggtggcccacccgaggtgtatcaagacggtggtgctgtgggaggcgctgacacattgttgtgtaaccccacaatatcctatacaacatgatgtggcggatgcagcaagttgcggcgtagcaacacaatttataatcatcgccccgcaaatatgctggtgggtcccctataagaggtgggggggcctatataacgcctgctctacacctctttgtgaggccgcccttttgtgggggagacactctcccaacgcttttctccacaagaggagatcatctaataagggggggcgcctactccaaactatctgttatcacaccaaggagggggcgtcctcctattaaaaaaaatactccaagctactacaaatctaccttgggggacgcacttggtggaggataatacacactcctatcaaacgattgagtccgccctgtggtgcacacacatattttttccccccaaactttttgtgtgtctgcccagcggaggcagggagagggaacaacaccccaagggggagtggtaaccccccgttatgtgggtaccccgtggagnaatggggaacagcgcaagcgaaagagacagacaacatgcaatgaacaaaggacaggtaagactagacatgaaacagcatatagaatacacacaacaacggagatggaattacgaatagacaataagcgagggtaccgacagcggcaacacaaaaatatagaggaaggtaacacatcctccgtggtgagaccccacacaaaaagaacgtgtgtgcttcactcacactaataagccagagaatcaaaacagacggagaacaagaaataaatctccacatatacaccaagaccacccaacggcgttgttgcgccaaccatagagggaggtgaggtcaaacaaacatntcatcaacaccccacatcagaagcacagcaggtgacacacacacacgctgtcgggccccacatcgtagcggagtgagaagaaagtaactaacatcag

SEQ ID NO: 491572 - DNA, 738 bp, Homo sapiens
  misc_feature (5)..(5): n is a, c, g, or t
  misc_feature (73)..(73): n is a, c, g, or t
  misc_feature (77)..(77): n is a, c, g, or t
  misc_feature (87)..(87): n is a, c, g, or t
  misc_feature (119)..(120): n is a, c, g, or t
  misc_feature (122)..(122): n is a, c, g, or t
  misc_feature (124)..(124): n is a, c, g, or t
  misc_feature (127)..(127): n is a, c, g, or t
  misc_feature (130)..(131): n is a, c, g, or t
  misc_feature (133)..(137): n is a, c, g, or t
  misc_feature (147)..(147): n is a, c, g, or t
  misc_feature (157)..(157): n is a, c, g, or t
  misc_feature (167)..(167): n is a, c, g, or t
  misc_feature (273)..(274): n is a, c, g, or t
  misc_feature (738)..(738): n is a, c, g, or t
tgaanctcgacataatgccgctcaaacaaagagagccaggggctggggggtcacgggaatggagcatggagcnctanattctgaaangggatgagaggagaggtgaaaaaaaaaaaaanngngnggnggnngnnnnnggcgggtggngtttggtttngcgattgggncaagcctggggatcagggaaatttgaaacagtcccacctggccacctggtaccccctccccccgttctaagtcagtgtgaataggcagaggtcagggatgattganntagaggggctggtgggaggcctggtgggcctggctggctgcagagactggcaaggggccacctgtggcattgcctggggttggggatggctgtgttcggagcgaggggggcactgtggaggtcttgatgtgaatcaccctggtgtccatgacctcacactcgatctgcatcatctcctcatagtcccccggggccccacggcctgacagggtctcattgggggccatggcaggcatcaccagggacatcttgggccgggaggtcttgttgtggctgatggctgggagcagcaggtggtcccttcggaaagagacaacataaaatgtgtcttcccgtcggtcaattgcatccaagaatgctggctgcgaacggtctgggtggcgatatagttgcagctggcccacagaatccctttctgggggtccagggggttggatggggactgccttaactggaggtgactn

SEQ ID NO: 491573 - DNA, 599 bp, Homo sapiens
  misc_feature (3)..(3): n is a, c, g, or t
  misc_feature (412)..(412): n is a, c, g, or t
ggnggcattcaaactggacatggtacacattgggactctggctcttcctcctcattaccggcttctccttcacgagctcccatctcagtacagggctccatcatctacccgggggctccagccagaaaacggggagtcagccttacagtctcggtaacaactactccctatttccaatcaaacgcaaaggggtatgggtcctaattctaaaatccatctacttcccttccccggttctaccacatctaaatccaaagctggccatcatctcttacccatagggccacaacagtatcccggcgggtctcccggttttcactcggaccattatctacatggcagccacagggggcttggaatacttgtatcagcgggccacagggggctcacgccggtagtccctacagttggngagggggaggggggaggatcgcccgagtccaggagttcaagaccagccggggcaacagggtgaaaccccgtctctatagaaaatacaaaagtcagctgggtttggtggtgccgcctggagtccaggcactcaggaggctgaagcgggaggatcgccgagccgggagggtgagcgcgagtgagcatga

SEQ ID NO: 491574 - DNA, 461 bp, Homo sapiens
  misc_feature (4)..(4): n is a, c, g, or t
ggancgctctagagtatccccatctcctaccccacgggtttaagcgattctcctgcctcagccccccgagtagctgggactacaggcatgtgccaccactcctggtcaatttttttgtacttttagtagagacagggtttctccatgttggccaggctgagatgctgctgtctctacaaaaaatacaaaataaaattaactgggcagtggcaggtgacttagtcttagctacttgggaggctgaggtaacaggatcacctaagcccaggaggttgaggctgcagtgagctgagattgtgacactacactccagcctgggcaacagagcaagatcctgtctcgaaacaaaacaaaactccagaagtttaacaacatgtatacctcctatgtatccataggagataaacagagaaagaagtaaacctcaaagaggtcgtggggtaggaggtgggtaccgagct

SEQ ID NO: 491575 - DNA, 203 bp, Homo sapiens
tctctctgccacttcatgagcccttggtatagcctttctagctccctggcaaagtccatggcgtcaccgccccgggtagccgcgagcgcgccaacatcaataccagcctttgcgagagcttcagtagaaccatcttgcgcgttcaggttgaagttgttctggaactcttcgaaccttttaagcgtgtcgagcgcctccgacgc

SEQ ID NO: 491576 - DNA, 139 bp, Homo sapiens
tagtgtctagaggatctcaattctgcaccacagcgtaggaaagcaaagcatcagtactgtgtctctgggaaggggccagaatggctgtgcccctgctgtggacagcgaggggtgggttaaggccagtacgagggcgctc

SEQ ID NO: 491577 - DNA, 462 bp, Homo sapiens
tgagacagagttttgctcttgttgcccaggctggagtgcaatgacacaatctcagctcactgcaaccaccacctcccaggttcaagtgattctcctgccttggcctcctgcgtagctgggattacaggcatgagccaccgtgcctggcctttttcttttttaaacagggtcttgctctgtcacccagactagaggtgcagtggcacagtcatggctcactgcagcctcaatctcctgggctcaagtgatcctcaagggcctccagagtagcccaccaccatgcctggcttttttttttttttttttttgtaagtagagacacatttcactgtgttggccaggctggtgtcgaactcctgggctcaagccattgcccacctcaaagtgctgggattacaagtgtgagccacgtcgacccggccgtgaattttattatagtagtagtattcgacccggggattt

SEQ ID NO: 491578 - DNA, 384 bp, Homo sapiens
  misc_feature (249)..(249): n is a, c, g, or t
  misc_feature (290)..(290): n is a, c, g, or t
  misc_feature (358)..(358): n is a, c, g, or t
  misc_feature (372)..(372): n is a, c, g, or t
actctagtaactaattttttaaagtctaaaaacgtttagtatgtgccagtgctaaaagggaagtgcaaagaacacagctgtgatgtttacaaaagcttgtcccaaataaagaggagctgatgttttaacaattcatctccggctgaactgaaggagataagctttacaaatggagtcagggtaccagagctgcctggggaagcagactcagcaggtggttcctcggctctgcttaaagcttcctcattncatatttaacctctgaattaaaacaatttcagaaagacctnacgctgggaaccaacgtcaaacaattttcaaatggtctccctgcatggaccttcaagacttacctttnattggttaccttanaagaccggcaat

SEQ ID NO: 491579 - DNA, 878 bp, Homo sapiens
ggagtctttgaaatggggttgtttaacagaggttgatacccctctttgacaccttggttggtttttggtgggaggcagtggggctggttgatacaatcttttcctcctgtctacctgtttctggtgtctctcagctaaaaggtgtgtgatcactgattgccagtttttaggactctgtgctcatgactttccccgcttcccaacttgcttgtaccttcttagtcttcatgcatttcttaaattcttcctaggtggttctgttggctgttttggtgttgtcctaactgtgcagttcttactagtgcttggtgtattcagtaaggtagccggaaagcatggcttggaggtcagatcttggttgcagccccagttctgcctattgggctgtgtgattttgagtaagtgattaactctatctcggcttcttgtttcctcctctgcaaaatggatgaaaataatagtacttctccacatgtgagtttcaatgaaatatagcgaatgacccactgtcagcctctctgttggttcccccaacccattgagaagtctcttgcttcctccactctccagtttctcagtacagggtcctgaggtttcctcccgaataaacaataggcctggtctgacgtggggggtcattttatttggcgcttgacgtcttccatccttgggggtatagaattatagctttgcccccaaggttccactcttgactggatttcacgcataatagatagccagccaacttagcaggacaacggtcaagtacgagtaaactttaagtgcggcggggaaaccctctggcgaatatacagagagtatccccaccagggaaaaattaccttgtataatatcacattcaccgataaacaaaacca

SEQ ID NO: 491580 - DNA, 1277 bp, Homo sapiens
  misc_feature (373)..(373): n is a, c, g, or t
  misc_feature (596)..(596): n is a, c, g, or t
  misc_feature (680)..(680): n is a, c, g, or t
  misc_feature (1001)..(1001): n is a, c, g, or t
cttagaaatttggggaaaaattcttccggcccaacacccccctgtggtgggagaaacactgtggcgctttcctctgtttcacaacaatggggtgggagaaaaaaagaggtagttatatatccccccgacagaggggctaccaacacttgtgggtacaacaggaagaggaatttttgggtgcttttttggggggtttttttcgcccccctgtggcgccaccaacataaaccctaatgcgggagaatataaattggggagaagatttttataatgcgctcgccacacaacaaatggtatggagatattctcttattaaaatgtttcacacccagcgccacaggagttgggtgaaacaacacacgtaaaggagatntttcttctcacaacagagggagataaatatttggggagagtttaataaaaaagaggttggagaccgctcggtgttgttctcaacagcaggagagggagattgagcccccacctgtagatggagatattctgcacacatgtctgtgagattttttctgcacacatatagtgggagactacaacagtttgttctcgcatatagtgtgtgtgtgcataaagagacncacagatacacacactgtgtgacacaacaacccgctgggtgatcaatacacacaggctctttgtgtctcttgtcatcacaaagnttgtgagagagagaagggtgtcacaatactcacacacacactttatacatctcgagagtatcactctccacagagtggacacacagtgatacatctgcgagatctctcgagagagagagtgtgagaacaatatatattcacacaatatatagagacacgtctatatatatatgtgagaaaaatacacacgttggctgtcacacataagagattgggacacatatttatagaggcatatatatatacatatatgagagctatatatatataaactataataacaataatataattttgagaaaataacacacacactataanaagaatgtaataaacacatatgcacaaaacgtggcttaaaacaatcccactttgtgaacacacttgtttttgccacgcttatggtttgaacacctttgtaagttaatgagattccacaaattggtttaagttgggccactttcaatttttcacacttcctgtaaaaccacactccacataagagatttgtcttttttcaaagagaaatatagttttttttcctttatttgattgatggtcattgactactgaaataaaactacccattttaagata

SEQ ID NO: 491581 - DNA, 230 bp, Homo sapiens
gaggaagatgttcaaaatgtcaacctgggtaacaaaattacatgtctttttataaatggcttgccatcttgtaattttctatttggaaagaaaagttgaagcgaatggaagtatcggaagtaccaaataatgttggcttcatcagtttttgtacagtctcataagtagttaataaggtgaatttaatgtaggcttttattaatttgtaattaaaataacgtgtgcagcta

SEQ ID NO: 491582 - DNA, 163 bp, Homo sapiens
ctggtagcatgtagacaatgttacaagtggaataagcctaacgggtaaagctcagagaagggtcggatctagagagaatggggaggcctgagtagggagtaggggggccttgatccacacacccatacccctactgtagacttgcattagctgtgtcagggtc

SEQ ID NO: 491583 - DNA, 269 bp, Homo sapiens
caggcagactcgcagtctactcatggagctagcagtgtgccggtgtgtaattgtattccgcgatagagatggggtctcaccatgttgcccaggctgtaattcagtgacatgatcactgtttacttcagcctcaaatttctggggccaaagcaatcctcccacctcagcctcccgagtagctgggattgcaggcgtgtatcaccatgcctggctaatttatttttggtagagacagggtttcttcatgttgttcagttaggtctacctgg

SEQ ID NO: 491584 - DNA, 242 bp, Homo sapiens
cgctgtgattacaggcctgagtaaaaatctttaagaaaaattggagtctaaaaaccttcaaggatttccccaagaagaatttctgttcaaccttccagctccttaagtgctaggatgatgtctggaagcagaggaagtagtttaaatgatacctatcactcaagagactcttcattcagattggattctgactatcagtctacatcagcatcagcatctgcgtcaccatttcaatctgcatg

SEQ ID NO: 491585 - DNA, 996 bp, Homo sapiens
  misc_feature (800)..(800): n is a, c, g, or t
  misc_feature (803)..(803): n is a, c, g, or t
  misc_feature (805)..(805): n is a, c, g, or t
  misc_feature (948)..(948): n is a, c, g, or t
  misc_feature (959)..(959): n is a, c, g, or t
gtggttgtgacacgaacgttggtgccagagctgtgaacacccaaatttttcttataagctttgtgtggctcaaagggtctttacaccttttaatagcggaaatgtttcaccccaggaacggtttaaaaagtggtttaagggctgttaccacccaaaatttagttggaaatctggggtagtgaacccgcattttgggaccggcttggcccgaaatatgaaacctgatgttggttcccaaattatggtttacccgagtataatgtgcttatttagccatgtgcttggtttttaaagagaattctccccttgggaaaaaagtagcctcgtttgaagtgttacttccccctaagcgtaaatgcctggacatagctcttgggccaaccctgttaaataaattgttttgaatgttttttgagcccccagcaccaataatgttttaaagttatcccccttgctactttactgatcaccctttatccattcctgagcaccctttgcctaaatttaaaaaatgtagccacttccacatttgtaatttaatttctctccctctgcccacaaagatttttctaatactcgcttgtacccaccccacgagagaagagtcccaaacacctactcacgcttttcttgcacctgaggaaattttttccccctaccattgactcctggcctacatcagccaaacttaacccttggtggggtttggatttgatagcccaattagttctgtgctggttgcaaagaattgatatttagatggtttttaatacccagcagattgtcttcctttatattgngtncntttttatgttgcatgttgcttttgttatcagcctgattttttgctccagtatatgatagttctgctgatgttttgtttattgggcagacatatcttcattaagagtttttggaaaactcatcaaattcgatgaatacattttnttcataacccntttggaattattcctaataaaatgataaaatacgtaa

SEQ ID NO: 491586 - DNA, 711 bp, Homo sapiens
  misc_feature (327)..(327): n is a, c, g, or t
  misc_feature (457)..(457): n is a, c, g, or t
gaggtggctcagggcccccccccagctatggacgaacggctactggggccgtcccctccaggcgggggccgggggggcctgggattggtgagtggggagcctgggggccctggcgagcctcccggtggcggagaccccggtgggggtagcgggggggtcccgggagggcactgagggaagctagaggacatcgggggacgattcgtgctaggcgagatatatgacgcatcgaccgacctaggagccgtggtagcgaggccccaggccgaagaaacacggcccctaaagtgcgcagcctgacatgaagctcgttgctcttcgtttagncagtcccgtgtgtgagaatccaaggtaggaagaatcgtgagcttcaggcgattgcaggcatgcgtcccagtgtacggagagagcacgtgtgtgatcgctcgactagacatgaatgcgtcgtttggagctnaacagtttgcttctggtcagcagtggcttgtggctgggcccccgagacaagtggggcgggctcaagcatgcagtcagactgctagcctgctgcgagcctctgtgtggtgtgtgtgtcccctgaacaactcgcatcgaacgactcggactatcggcagcgaaacttgcccagatccgtcacatataccactcggagctggagaagtatgagcaggcatgtaatgagttcacgaccatgtcatgaacctgctgagg

SEQ ID NO: 491587 - DNA, 884 bp, Homo sapiens
  misc_feature (32)..(32): n is a, c, g, or t
  misc_feature (67)..(67): n is a, c, g, or t
  misc_feature (91)..(91): n is a, c, g, or t
  misc_feature (94)..(94): n is a, c, g, or t
  misc_feature (100)..(100): n is a, c, g, or t
  misc_feature (107)..(107): n is a, c, g, or t
  misc_feature (109)..(110): n is a, c, g, or t
  misc_feature (112)..(112): n is a, c, g, or t
  misc_feature (116)..(116): n is a, c, g, or t
  misc_feature (118)..(118): n is a, c, g, or t
  misc_feature (123)..(123): n is a, c, g, or t
  misc_feature (135)..(135): n is a, c, g, or t
  misc_feature (146)..(146): n is a, c, g, or t
  misc_feature (160)..(161): n is a, c, g, or t
  misc_feature (163)..(163): n is a, c, g, or t
  misc_feature (169)..(169): n is a, c, g, or t
  misc_feature (173)..(173): n is a, c, g, or t
  misc_feature (208)..(208): n is a, c, g, or t
  misc_feature (211)..(211): n is a, c, g, or t
  misc_feature (227)..(227): n is a, c, g, or t
  misc_feature (233)..(233): n is a, c, g, or t
  misc_feature (235)..(236): n is a, c, g, or t
  misc_feature (240)..(240): n is a, c, g, or t
  misc_feature (254)..(255): n is a, c, g, or t
  misc_feature (257)..(259): n is a, c, g, or t
  misc_feature (261)..(261): n is a, c, g, or t
  misc_feature (264)..(264): n is a, c, g, or t
  misc_feature (269)..(269): n is a, c, g, or t
  misc_feature (280)..(280): n is a, c, g, or t
  misc_feature (289)..(289): n is a, c, g, or t
  misc_feature (296)..(296): n is a, c, g, or t
  misc_feature (302)..(302): n is a, c, g, or t
  misc_feature (307)..(307): n is a, c, g, or t
  misc_feature (310)..(312): n is a, c, g, or t
  misc_feature (315)..(316): n is a, c, g, or t
  misc_feature (320)..(320): n is a, c, g, or t
  misc_feature (326)..(326): n is a, c, g, or t
  misc_feature (340)..(341): n is a, c, g, or t
  misc_feature (344)..(344): n is a, c, g, or t
  misc_feature (354)..(354): n is a, c, g, or t
  misc_feature (369)..(369): n is a, c, g, or t
  misc_feature (376)..(376): n is a, c, g, or t
  misc_feature (382)..(382): n is a, c, g, or t
  misc_feature (389)..(389): n is a, c, g, or t
  misc_feature (394)..(395): n is a, c, g, or t
  misc_feature (412)..(418): n is a, c, g, or t
  misc_feature (421)..(421): n is a, c, g, or t
  misc_feature (425)..(426): n is a, c, g, or t
  misc_feature (430)..(430): n is a, c, g, or t
  misc_feature (445)..(445): n is a, c, g, or t
  misc_feature (456)..(456): n is a, c, g, or t
  misc_feature (464)..(464): n is a, c, g, or t
  misc_feature (468)..(468): n is a, c, g, or t
  misc_feature (501)..(502): n is a, c, g, or t
  misc_feature (517)..(517): n is a, c, g, or t
  misc_feature (530)..(530): n is a, c, g, or t
  misc_feature (540)..(540): n is a, c, g, or t
  misc_feature (545)..(545): n is a, c, g, or t
  misc_feature (548)..(548): n is a, c, g, or t
  misc_feature (554)..(554): n is a, c, g, or t
  misc_feature (688)..(688): n is a, c, g, or t
  misc_feature (691)..(691): n is a, c, g, or t
  misc_feature (693)..(693): n is a, c, g, or t
  misc_feature (836)..(836): n is a, c, g, or t
  misc_feature (847)..(847): n is a, c, g, or t
tgactggctgtcaaatgagctttcaaaacgtnaaatgaaattggatatctaaccaaggacatgtttnaaaaaattggtctaggcttgttanaanaaaatnagtttgnanntnggtnantaaanagtatctgggantggttgggaanaatattaaacttanncncccccnattnttgtttaccgagtataatgttgctatttccccccngcncccccccccccccacncccccngnncccnccccagccccccgnnannncnccncccanaagcgcaaatncccgcccanggccccngccccnccccnggnnnggnngccngggggnccccccgagccccnnccnaataatgttntaaagcccccccccngcccccnccccgntcccctnccccnncccgaggccgtttgctnnnnnnncantgtnncctnccctttgtatttatntctctcccttnccaaaaanattntctaatactgcttgtaccaaccagagaaagaannaaaacactacccagnaaacttgcactgnaaaaaaattnccccnaanaaaaanacctggcctacatcagccaaacttaacccttggtggggtttggatttgatagcccaattagttctgtgctggttgcaaagaattgatatttagatggtttttaatacccagcagattgtcttcctttatattgngtncntttttatgttgcatgttgcttttgttatcagcctgattttttgctccagtatatgatagttctgctgatgttttgtttattgggcagacatatcttcattaagagtttttggaaaactcatcaaattcgatgaatacattttnttcataacccntttggaattattcctaataaaatgataaaatacgtaa

SEQ ID NO: 491588 - DNA, 1222 bp, Homo sapiens
gcgccgatggcggagtggaacgtgcggagtgctcctctagagaatggtgtgtggtgtgctgactctggtgagcctggagctttgtgcactgaggagtggctgcccattaagcagtcaatacctcaccaccaaggagcagtttcaccaattcctggaatgccaaatgggcagtgagaatgacttgcctggtgaaacctgagtgtagtgatgaccctgcttggcaactgacgcttgtgcttgcgcctatgagtgctaagctgtgatcctgactagtgatggacttggaccatgaccggctgtgaccgtggcatgatctggacgtgacgtgcatgcagaatgccctggtggatgcatgctacaagaccatcacgaaagagggcagccctggtgagacacaacaccaacaggtgcccagtgcccacaatgatagacatgcctcacagaaacctaccagaccacacgacaccatgagcatagtcgtacccgtactctctataaaagtacccaggaggagggtcaagcgcgtatgactgaacaagcttcgtactctgctttacagagtggtttgtactactgcctagccaccaggcactatgatcttctgacaagccagaaacaagttagagtgggcacggcattaaacacgttggaggaaagcacgccaaaatggcctagagttgctgaacaccattagtgtctgccccccacaccatgcccagtagccactgattaggccgtaccatataacatagaatcggactcacatgtttcatggtgccccaggaagattagtcccccacgtattaagcgtagtggacgaggttatgagaccctatcttgcccataggcactctcacgcaggcacataggatagtgatagcacctcacatcagcatactatggagcgtgtgccccactggaatagggtgcacacaatcgaaaacaagcccattgggagaatagcccaagagcgaaggcggacacgcataggcggccagaagacacccccaggccgaggaaagtaaaccacgcaaacggacaccctccacccagggatagcgcaaactactccgggccaataccgcagcacccgatagcagtaccaaacaagacgacgcgcagtgtggaacaagaccaaggacgagggatccttgacagagggaaaagagcgcggccagaaagagacgacccaggccacaaccagaaagcaacggaaagcaca

SEQ ID NO: 491589 - DNA, 116 bp, Homo sapiens
  misc_feature (4)..(4): n is a, c, g, or t
  misc_feature (103)..(103): n is a, c, g, or t
  misc_feature (116)..(116): n is a, c, g, or t
cagnactttctggtcagccgatgggcaaaggtctttcaaaccgacttctttatgacttttttttaggggcccggaatgctttgatccgaagggttaaggggtnccttctttaaccn

SEQ ID NO: 491590 - DNA, 485 bp, Homo sapiens
ggggagcggagagcggaccccagagagcccgtgtagcagccccaccgcgtctgtcggcctagttaccatcacaccccgggaggagccgtagctgaccgtatccggccccagtcatcactcaccgcaaccatgagcagtgaggcctgagacctcagtagccgtacagtctcccttgcaagcacggacagcagggtcccaggcgtgcgaaaactggaagcacagtcatcggggaatggggagggaaacacggtgctgtatccactccctgtctctctgctcttgcgtggctgtgacaaccctggtctcacttgatgcatcgtctaggttgttcttgtcggaccctctgtggagtccccatcaccagttttcatcctgagaccaaccaaggacccatgccattggcctcattgtcccttggcacacttgtagagcacaggtgaggggctaggacctgaaggtattggactgttcaacaatcagtcata

SEQ ID NO: 491591 - DNA, 253 bp, Homo sapiens
tttttgttttgttttgttttactttgaagaatgggcattggaggacaagatggagaaaatcatgaatttacttttgaaacttttgagtttgaaatgcctgtgagacatcctgaataggcagtggggcagataggcttaaaggatacatttgggctagagggaaaaaatgtgtgagtcatctgcatattggtggttattggaaccacactggcagggctgacattgattctcctgcattacttttttttttttt

SEQ ID NO: 491592 - DNA, 424 bp, Homo sapiens
  misc_feature (397)..(397): n is a, c, g, or t
tagcggtggcgtacactacggcgtcggtacgccgtacgcggttccggcgggtgctggtggctactgctggtggggctgctgcggctctagtttttggtgccttcttcgactactggccccttagggccaccagccggttcgcgggggcaggcctcctcgggcgcggcgggtggctggccttccgggtgttcgtcctgtaagctggtttccggtgcgacgctcgtacgtacgggtcgtggtgctggcgtttccgtagcgtacgtcggactgcggtagtacgtacggctcctactccctcgttcccttccgcctggttctgtacgggttgtccggtcgccctgatctacttcactccactgcccacgtcttcgcctgctgaggctcctctcgcgtcgcnctgacggactgaacgcttggacctggc

SEQ ID NO: 491593 - DNA, 211 bp, Homo sapiens
tcaacagctctctcagtacacagctggagtataagtaatagttagaacttccttacgagtaatcataggtagctttgtcaaacaagactaagttattagagcttgtcccgaactttgcctttggaccacttctacttttaggacttgcccccggattagtacactgggtctttgtctttctaggccgactttccagcgtcatcccccgcga

SEQ ID NO: 491594 - DNA, 139 bp, Homo sapiens
agccctcagccggtttctcaggccgctctagtcaataaaccataaagatcagactcggcgcttcttcactatccttctctccgtggtttcgccattagcttccggctatccggcggcaggggccgagttttcttcgaag

SEQ ID NO: 491595 - DNA, 823 bp, Homo sapiens
ggggacccgctggcactcccgcgcgtactcggcgcctgagcgatactaaaatgtctgatgatgctggtgacaccttagccactgagacaaagcagaagttactgagatgcctaatagtgattctttacctgaggatgcagaagtgcatggtgattcagctgcagtttcacatgagccaacaccaggtgaccccagaggggaggggcatgaaaatgcaagctgtgccgggtgcaggggtgccgccaatgtgggccccctgtgcaagcctcaggaatgccaaagggccctggagccccccttctcaaatggagaccgtgactgaggatacacttgtgctgaatgtatgggattccgtcagccttgggagggaagaacccaaggatcgggaaaatacccgttgaagaacaagaattatctgcctggtggattccccctccaaaggtgacgcgaaggatggggccaggctggggatccgggggcaaaatcttctgctgtcgtcaggcattcttgccaacaagtaaggtcatggcatgggaccggggcacgtccagggaaaaaagcaggaggcaattctaacggggttccagtggttggcacaattccgtgatcctttctgaagggaggccaaacccaaatacttgagaaagcgggagttccctgaagattggaggcaaggattaggggccctgaagaaaggcccaaccaatttcccttttataaagcctctcggggtatggtggttgcgcatcccagtgtggtgccacacccccgtgacaactgtcttaactggggcgcttgagcgttggaactcactccggcaaaa

SEQ ID NO: 491596 - DNA, 410 bp, Homo sapiens
ctggtggcaacttcgaaaaactgtaagtcgcagggaatggcgcaaccaccacaatcaacgacaccatcgacaaggttgatgtagtcctgaccgcgaccaccaccgttggcgaaggcggcaatatcgtctacaccgccagccttgtggataaaaacggcgcaccggtgaccaacatcaccaatccgctcaccgttactttggacaacggcaagaccatcaccatcggcgtaaaccaatcgagcggtagcgtttcggttcttgctcctgatgatgtgtacaagggcgaccaaactgtcaccaccgctatcaaaggcgtgaccggcggcgagcactttgaaaatctggttccaggtactaccccagttaacacgaccgttaccgatacaccgggtaccgacaacaccacgact

SEQ ID NO: 491597 - DNA, 133 bp, Homo sapiens
ggggcccccaaaatttttttttttaaaggggggtggcccaaccccttgcccccttttttagggggggggttttttttgggggtttttgggccccaaaaaaaaacccttctttttgggggggggccccctttta

SEQ ID NO: 491598 - DNA, 119 bp, Homo sapiens
cgctggcactgactttgccttgaacacactgggggaccctcccccacaggcctttaattgagaacccttctctgtaagtgtttgcttgtgcaaaagggaacagggacaaccctgtcggt

SEQ ID NO: 491599 - DNA, 620 bp, Homo sapiens
  misc_feature (62)..(62): n is a, c, g, or t
  misc_feature (170)..(170): n is a, c, g, or t
  misc_feature (172)..(172): n is a, c, g, or t
  misc_feature (176)..(177): n is a, c, g, or t
  misc_feature (189)..(189): n is a, c, g, or t
  misc_feature (202)..(202): n is a, c, g, or t
  misc_feature (207)..(207): n is a, c, g, or t
  misc_feature (235)..(235): n is a, c, g, or t
  misc_feature (246)..(246): n is a, c, g, or t
  misc_feature (276)..(276): n is a, c, g, or t
  misc_feature (295)..(295): n is a, c, g, or t
  misc_feature (403)..(403): n is a, c, g, or t
  misc_feature (462)..(462): n is a, c, g, or t
  misc_feature (618)..(618): n is a, c, g, or t
aaggaccagtctgcagagggatcctttggctggaacgaggaggctccacacggccgttgcanctaccgcagccaggatctgggcatccaggcacggccatcacccctccgacgctcttctgggtgtggctgctggttccaggaacccaaggcgtgaacgatggtgacatncncctnnccgatgggggcnccaccaaccaggnccccntggagatcttctacagaggccagtgggncactgtgtgtnacaacctgtgggacctgactgatcccaccntcgtctcccggcccctggncttccacaaccccacccaccctctccccacacctcccttcccccaaccatcaccccccatcatcctccaccacctccactccaccccaacccacccctcactcccccnctccaactccctcccctccctcaacaccaactccacccaccacacacaccctggtgtcntctccaccaatgaaaccaccaccacccacaccctccacctctccaccgacctctcccacccccttcccacatctttgacacccaccgcccctcccacctctccatcaccctcaatctccacccccaccaccccctccccttcgggggccacacggnca

SEQ ID NO: 491600 - DNA, 898 bp, Homo sapiens
  misc_feature (404)..(404): n is a, c, g, or t
gattccttcatcgttcagtgcaccacctactgatctggggaacagtgaatctgactgattgcctgatctggtacttgtcttcaatgagtggtcattcattctctcgctgtgacagtgcctgttagcgtgcctgttcctctgggcatcccgtgtgctgagagtatccgccaggggagattgctgtcctggagacagatacatcccaccatgatcagtgatcaccccaatctgtcaacaagatcaccccgcaactggctgagttcggccgtatcagcctataccgaccagctggcacaccagtccagcagcaccaatatcttcgttctccccagtgagcatcgcatacagccttggcaatgctctccctggggacacaaggctggacactacacgatgaaatcccnggagggcctgaatttggaatctcacaggagcattccggaggctcagatccatcgaacggctttcctaggaactcctcccgtaccctctaacctaggcacgacaggcatgctcgcgtagctgagcaccggccaattggcctgttcctcagcagagggcctgaagctagtggataagtttgcgggcaggatgtgtacccagttgttccactctgaagccttcactgtggaacttcggggacaccgaagaggccaagaagcagatcaagcgattacgtggagaagggtactccagggcccacatgtggatggggtccaaggagcttgacagaggacgacagggtttgctctggtgaattacatcttctttaaaggccatgggcgagacccttttgctcgtcatgacaccgaggaggaggacttccacgtggaccaagtgaccaccgtgaaggtgcctatgatgaagcgtcaggcatgttccaccatccagcacggta

SEQ ID NO: 491601 - DNA, 461 bp, Homo sapiens
gtttccagctagtgagtttcatcttcaaccagggatcaagagatgtgtggaggttccatatattgtgagtcgcaatgtattccttgtcactgatttctagtatcattccatcgtgattagaaaatacttagtattttgcatactttcaaacttttaaaacattaatatttgtttagcagcctaatacactgtatactgtggacaatatcccacacgctcttgaaaagaatgtgtattttgctgttgttgggttggtgtctgcatatgaccattagatctaattggattatcatgttgttcaagtgctctctttcctattgatctggtctctgtattattaacattgaggtagtgaggtctccaatgatcatcctgaaactctatttctccctttaattctatccttttttacttcatatgttttgatgctctgttgttaggcacatatgttttaaattatt

SEQ ID NO: 491602 - DNA, 393 bp, Homo sapiens
atattacttattcacaggttagagaacactatgttacatctcattacactctcgtttctttacaatccttttaagctctgtgtggtgtgtatctactcaggtagcagtgttacaactggtattgatctacgccacgataattatcatgaactacgtcatttactgtctataggttctgactgcgttatctcgctcgcatgattagtttgagctcgatgatacctattcttaactgttaaaaggtctataagttactttagtattacctctgtgtgagaccatggaccacgtttctaactcagcctttgtggtacgtcttcggaaacatggcttaaaaatgatctatatcatagatcccttttattagtactgtgtccgatagctgataggaat

SEQ ID NO: 491603 - DNA, 209 bp, Homo sapiens
ggtggttggggtatgctactcataagatatcaggctgtcttccaactgaaatctcatgttctcagtacgaaaaactgaaatcacattgctatgtaagggaagtgctattcacccagtaaaacccaaaaagccaatggataatgctgggcattttggctttcttgaattttctttgaatacttgggaataagctgggttgcttgggaata

SEQ ID NO: 491604 - DNA, 138 bp, Homo sapiens
aatagtatatacagcttcaatcgagatcttctcataacttggcacttctgggcgccatcacctttcagccggatgtcctcattttctccctcatgaaactctaaagttagctgttatccagtttacagaactgcaata

SEQ ID NO: 491605 - DNA, 251 bp, Homo sapiens
ctgtatgactgttgctacagcagcgtgcgatcggtgcacatcccgggcctttgtccaaagctagagactgcgctaccgctataccgtagcttggaaccgttcgaacgatcttgtcggccatatagctgcttgctgacctgcctgtagccgattgcgtggcttagtcctcgttgtcaacccatgcacttcgagattgcgccagatcattcgaccggcctggaaggactccgtcacacgctggtcattctgcc

SEQ ID NO: 491606 - DNA, 322 bp, Homo sapiens
tcggtctgtggtgacacaataaggaagggtcccaggtgggtaagccccaagtgagaacaataatgaacaatgattgtatgaacaatagttagaaacagctaatcacaaacaacctgcgggcacaatgacctcattccacacgtagcacccttcagcaggaccctataaaactttcctccagcccctgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 491607 - DNA, 906 bp, Homo sapiens
  misc_feature (386)..(386): n is a, c, g, or t
  misc_feature (455)..(455): n is a, c, g, or t
ttttaccacaaaaaccctggtagtagcctgtttatggcttaacctagcaggcacaaatccaaaacaattttacaacatattaaagggccacaataattacaggaataaaatgtccaataaaaagtacaaaataatgagtgacagggatcaaacccgttgtggacattaacaaggcattcctcagttttccctacgtgcatgccattttctctttattcataggaaccaccgttatacgctattcaaccccaggaccacagggaacacggaacagaaaaacctatcttcccacctgtggaaacgcctcagtgggttgccacttgacggacaacaacacagggcgacgtttatggctctgggtttctgcaacgtgaatctcccttganaaaacccgctgcaccaagctctcccgcagtctgtgagtgccgtatttatagaaaatttctctgatttancacgtgcaacattgcctgcgtgattctgaactcctttgtgggccccaacttctacagccgtgctctcctttgtggcacaaaactaacgaaacctaatttcgtgcattctccacagtgcacgacatctgacccgacttttccgtggtgacacagggaagcctcttcagcacgtgtaaccagtctggtttatcgctctctatcgtggtcccaggtcacacattgttgtcccagtcttcccatcaaaatggtgcccccccttcgtggccgcctatcccggccctttggcggggcccaccgcgcctgcgccttcatcgtgcccgcacccgaccagccggcctccccttccgcacccactcccccgcgggctcgcgacacccacaacccggcgcgtttcccttccacgctgtgcccccccctttgcctcacctcacccactgcgttcagcgacatc

SEQ ID NO: 491608 - DNA, 464 bp, Homo sapiens
acatccataaattacacataagaaaaacaaattcaaaaaattcacagtgatgctgacagtaatacccactcatgggaaacatcccgtaaacctgcctgttgccatgccaatagagtgactgcactggtgacatctgtttgagcatgcttagtgtggctggtacgacatgccacccgttgtgcatacactttgtacatcagggagtgaagagaagggttttctagattattgggggaaggtaaaattggagatttttttgtagtccctttttcgatggggtgtgggggttagatactcagctaatgccctaaaataccatgtataaaaacccctgaagtacttgtgtggatgtgtaccgtgtgagtgtgtgtctgtactacgtctggcactcacaagctttgtcttctgaaacttagtgaatccttatctcttacacctccagaagtatttgaacaacatttgaa

SEQ ID NO: 491609 - DNA, 269 bp, Homo sapiens
cagtggaggcggcaggatctcctgctggtgcaggtccagctggctgaaagcagctccaccggcgcgcctacacttgcacgattgatgctccctaggttgacgttggtcaggtgcttcgcaaactagccaggccgagaaggctccgcatttacacccggctgcttttctgagggcattgatcttatcctccgtgattgtcagctcatcgtcgtgccgaatgagggccgagtatatgctggcggtctggagagtctgaaggcggtctggat

SEQ ID NO: 491610 - DNA, 516 bp, Homo sapiens
  misc_feature (417)..(417): n is a, c, g, or t
  misc_feature (482)..(482): n is a, c, g, or t
gactcttgaggatacccgacctcatcagccagcagtgtgttgttgctcccctgaagaggtccttcacattccttgtaagttggattcctaggtattttattctctttgtagcaattctgaatgggagtttgctcatgatttggctctctgtttgtctgttaatggtgtataagaatgcttgtgatttttgcacattgatttgcatcctgacactttgcctaagttgcttatcaggttaaggagatttggggctgagatgatggggttttctaaatatgcaaccatgtcatttgcaaacagggacaatttgacttcctcatttccaattgaataccctttatttctttttcttgcctgattgccctggccagaacttccaacactatattgaataggagtggtgagagagggcatccntgtcttgtgccgtttttcaaagggaatgcttccagtttttgcccattcagtatgatattgactantggtgtgtcataaacagctcttattattgagatc

SEQ ID NO: 491611 - DNA, 818 bp, Homo sapiens
gactagttctagatcgcgagcggctgcccttttttttttttggaagtttggggtcgtttaattaaaaaaactcaacagggataaaaaaacaagcattttacataatgcatacattctcaacatctgcagatgagataaataaaagaaggctaaagcagacatactgtgtatggcttctcttgggtaagttaccaatatcctcggcagaaataaaatatgttaaaaacaaaacccagggtcttaaaataattggtcccttagtattaacaaagatattcagcaataatacagtagatgtagttttcaaattgacaagaatgcgataatactttattctctgaggggtaagtagctgctttccaaaattaaggctgatgagagccaacctttttttcgtagctacctttttgcctgggcttctttttgttaatcatcacattcaaactcccagagaccattctttgggaaactctttttcacatccaaaacctcttatcagtttcacaccatctatcctggaccaattccatttcctatgaggcaattcatctcatctaaacttagtgcccccaaataaaaagaaaaaaggaacaaaaattcccctgaattgtgctctaatggaacagacactattatacaaatcggggcgtctattaaaagcaatattatacggggtccagaactgaaggaggaaaactaaaggggccattcaattatattagcaggagatccatgtgcttaactatatacctggtttgttattgtgctccccaggtttctttaaaaaaattacttgattgtgtccgaaaaattcaggg

SEQ ID NO: 491612 - DNA, 384 bp, Homo sapiens
ccaaataaaaaatccttcacatattaattctgaggttctttcagagagatgtaaatgtgcaatatttaggggatttctgacgctgaatcatctctgttgcatgggagccagagaatagcagcaataagactagattaggaaggaatccaaagcttcattctcctagctctgtcctctattaactgggagaatttggggaaggctttttacttctccaagtctgtgtttcctcactcagaaaatatgaataaaaatacctacctgactagattaaaagaatattataaaggtatatcataaattgctaagtactctgtacctgttaagcaatattatgcctagaaaaatagttaataaaaggattaattttttctccttaaaaaa

SEQ ID NO: 491613 - DNA, 364 bp, Homo sapiens
  misc_feature (24)..(24): n is a, c, g, or t
agatccactacagcagctatcagngtcagagactttcatgtaggaatatctagctatactactttttctatattctattctgtagtgagacagagtctgctctgtcatccatgctgacgtgcactgaagcgatctcggtccactacaacctccgcctaccggttgaagagattctcgtgccttagcctcccgagtagctgggactgcaggcatgggccaccacaccaggctaattttttgtatttaagcggagacggggttcaccgttgttgcccagggtggaattgaacttctatgctcaggcaatccattcgcctcggcttaccaaagggctagcgttacaggcatgagtcaccgtgtccgg

SEQ ID NO: 491614 - DNA, 128 bp, Homo sapiens
cacgaggcaaactttaatttatcagaaattttgtttggaattcttacattctcaatgtgagccaatctgggacccactgccccacccagaagtggaccagtcctgggggcaggggacagagggatggc

SEQ ID NO: 491615 - DNA, 898 bp, Homo sapiens
tgacaagtgtccctgcttttattaaaaaaaaaagaccccaaaaaaaaactcttttttttgaaaatttaaaaattttcttggtccctgttggtattatttggtggttggtcagggtggttccttggcgaggattatcgcagcggtttcttttctcttccccccaccctacctatttctacacggcgggttgggggcgcggtgttgtagaaatctgcgcctcctttctttgagagatagtgactcgcgtgctcttcacagcgggcctctgagacgaggtttggcccagccccgaggggtctgtgggacgcctgggagggtgtatggtgcgcccccatccgtgtagaggggtttcccgctgtgtctaacacccagcgggtttatagagaggggtctctcctggggaaaacacacccgcgggagggggtgggtctatctcgtgggtaatatctaattttcctttggaagtgggaaaacacttctcctctaactaggagaggagaggaggggaggccaaaatgttgtggggaacaaatatctctacgcagagcacaccgagagagcacaagcgaggggagatagaaccaccaaccggctgttgtaccaagtagaggtaatgatgagaagaagcaagtgtaggggggaggaagccccccaacaactagaagaaaagacagccccccctcctgttcaggaggaaaagtgttgttgttgctccccctccccaacaaggtattttatgcagaggataaagtgccctctcatcagcgggagcaaaaaggggctcacacacgtatttggcgagaagagagaacaccctggtgggagagagaacccccataggggttagacccccccagtgcgaaaggagtgttgtggaaaactaacacaagagctggtg

SEQ ID NO: 491616 - DNA, 151 bp, Homo sapiens
ttgttgagttgtcccagccatctgctctttagtcccgggagaggaacagagccaacgggacacagggtgggtctcggtagggaatcacggtgaggtctccagaaggaccgggccgccagccccttcatcaacatctccagtggggataccg

SEQ ID NO: 491617 - DNA, 840 bp, Homo sapiens
taattgtttggtttttttcccggggtccccaaatttttttttaaaaccattgggcttgggggggaaaaggggaatttttataaaaaactccccccacccgcagtagtaaggaagtcgagcaaaacacatgtgcggggcacaggcggagcgtggtgtcaacaagaacaaacaaaaaacacaaggcgggggcgccgcacacaaaataaccaccccgcggggggccaccactgatagcagcgcacaccaccagcgtttttgtgtgaaagaagggcgtctcccacagacgagagggctgcgtaataaaacagcagacgcgccagcgacacgcggcgaatatataaaaagaaagcgccgagctagcgagacgaggaaacaacaggctgcacagaccgcgtgaggaatatcttgcgaggaaagagcacacaccactcccatgcgggcggcggggcacccacaaatagtgaggcgccacaaccacaccccagcagaaataatcacaagcctcgacaaggaagacaaatactacaacaccatcatccgagcgaggtctagagcggggtgaacaacccaacaccgagagcgcagatcacggagacagctgcgagcgatcacgaaaaaaagtgccgctcgcacccacgacggagcagaactgatactcgattgagaagcaacaaaaatatatactcacccagcagcgcgagccacttatcatacatccacacaaccgactagcacaataatatcgcagacacacaaccacaacacacaacagaccactcaaacacacaagcactaccagacaacacacaatacagactaggcacacaaccaaacaatcaa

SEQ ID NO: 491618 - DNA, 462 bp, Homo sapiens
gacgtcttcatgtatagagcggtacctggcgcagaggaaggtcggttgtgttcctggatgagatcaagccctcctcggaccctgagccccagggccgtgcgcatgtttgctgactacctcgcccacgagagtcggagggacagcatcgtggccgagctgggacgagagatgaacaggagcgttggacgtgaccaccaccacgttcctggtcatggacgcctccatctatctccacgaccagaacccggatgccgccctgcgtgcgctgcaccagggggacagcctggagtgcaaagacatgacagtgcagatcctgctgaagctggaacgactggacctagcccggaaggagctgaagagaatgcatgaactggacgaggatgccaccctcaaccagctcgacaatgcctgggtcagcctggcaaagggtggtgagaagctgcaggatgcctacctacatct

SEQ ID NO: 491619 - DNA, 104 bp, Homo sapiens
ccagtgtgggaaggagaccacatggctgcactggggctcggaggaatttctacggcaactgcttcgtcatctgtgggtgtgctgtatgccgtggatagctacaa

SEQ ID NO: 491620 - DNA, 181 bp, Homo sapiens
ctctgaggatcccctcgatgttttctgctctgcgtcaccttctgctctcctgatatctctctgccagtcgactccgacagagaaaactccgtgcactatgtggcctggatcacaacagctgcccgctcccgttccttctgcacaagacctttcttctcagtgcctgtacgggctctatcga

SEQ ID NO: 491621 - DNA, 705 bp, Homo sapiens
  misc_feature (55)..(55): n is a, c, g, or t
  misc_feature (78)..(78): n is a, c, g, or t
  misc_feature (88)..(88): n is a, c, g, or t
  misc_feature (145)..(146): n is a, c, g, or t
  misc_feature (149)..(149): n is a, c, g, or t
  misc_feature (239)..(239): n is a, c, g, or t
  misc_feature (328)..(328): n is a, c, g, or t
  misc_feature (419)..(419): n is a, c, g, or t
  misc_feature (602)..(602): n is a, c, g, or t
taaaaatggagagcatcaagaaagtattgtgtgagagaagattgatggaaatganaaagttgaggttgcgagtaatangtgagagagngtgatatatgaagaaggtggctaaatatacatcttataagaccaatagctaaaaagnngancatgtacgaatagaaaatagtgaaagaagtgagtgaagcagaaaatttaccgagttcattcactcaacaaatatttatcgagcacctctnctgtgccagagaagtttacacatgggacagagcagtgaacaagagaaaggacaaaggtccctgccccaaggagcttacattctattggngaggggcaaacaataaacaagttaattatgaagtattttagacggtgataagtactactggcaaaaaagaaaaagaagagttaagtgaggngatcaggagtgagggatggggagctcaggggctgggggggtctcatcagggaggagagatttgagcaaagctttgaacagattcaggtagttgaccacacagagcaggggaaattgccatggtgcggcggaggggcaggagaaggccaagtgggctagaacagaaagagcaagggaccaagtngtgaggaccctggaggccttgaacaggactttggcttttaacctgagaaccattgcagagctttaaggagaagagtgaaattttgacttatgttttaaaaagg

SEQ ID NO: 491622 - DNA, 831 bp, Homo sapiens
  misc_feature (452)..(452): n is a, c, g, or t
cggctgtacggcggaagtcttgattgcgggtgggggtgagggggctctctagcttgcggctgtgtctatggtcgggccctctgtcgtgcagctgctccggacgagtctcgggtgtatggggccgtaggaaccggctccggggccccgtatacgggtcgtccccagcagtatcccgggctggcgtgagggtctcccttgatctgagaatggtacctctcgatagtgacggccagatgagctgaaccatttggtgttctggtgcctatgggacagtgttacaaaggaccgtgatccccacagtgggcactttgtgtgcctcaagagtgtgagagtccccaataggaggaggatggtggtaggaggcacttcctcatcagacacagttcgtgaggtggctttagcgtgaggcacgatgctggcacgggccttttgacgtctactcccatagatgnttgcatccgagctagaatggtaccggtactgttggcgcacatgtgccccgtaatgcatgaaaccgtggtgcaaggaaattcaaggggcataaagtccacctggggttgggcttatggaaatgggcaacttgggttaggaaccgcgaagggaacgcattagaaggtgatctatttacttcgtaggaggtaaaccaaaattgcggcccaagcaccttcccccaaaagcggccaaaggtgggcctttaggggcgccaatgggcctcccggaaaaaagaacctgggaattaccattaacggggtaatttctttcggaccttgggccggacgccaaaggtatctccattagaagcgcagagggcccttaggaattttatcccgc

SEQ ID NO: 491623 - DNA, 1246 bp, Homo sapiens
acgtgctgtggctctacagtgggtctgcccttgccacttacccaaacattcatcaagtttttccccttcagatctgacagtgcaataggacagacgtgatggactgttatacagaactactcagtgtttatgttcctgggcacggaaggtaggagttctgtgcacttaagagccagcggtcacaaaccctttgtgatattctaagagacagagtgagaacgtggagacgcgggagggaatcctagacttatgtaaccctatatctatgaggacttgacacaggttctgctgagttgtcactgctgctccagactcaccatagagatgctgcctccacttaaccatcctgtcatgggtctgacaaacagtgggtctgcagatagtgcccacaaaacccatgtgactggtctgaaggacccagagcataaaggtctctcaggaaaacatgtacagaaaccgtagcagccggtacagaatagctgttctccaaacactttatacccaggttaaaagcgtggtcgataggcatacgtgcaaggtaaccacgtacagaaagatactcaagacgaactggaggttatccacctcatgggtatgacccatgggctgagacgatgaaacgggacaccgacatcttcgagcataactgaaacctacccaaccataactgtgtagccagccgcaggaatactcagggccctacagcatataccacaaaggaaagaaggagaattaccagttgaggcatatttacaaaacaaaaacacatgtggataaaatactgctggaaaatagaaaccaagctaacaagaattgatgagactaaaccccacatgatggagaatacatacgatagggataagtaaaatcggaaccagaaagaacaacgtataaactttgagcctacagcaagtagtagaacgcaaaaaatgattgagtcagtaaaaagacaagatgaaggaagagcagagtacacgccgggcaaacaagtacaacacaccaaacacaaacaagcaccagaacaaagacgacacgaacggacaggaggacggacgaaacaaacgaaccgcaaagcgcagacaaccagaaaacgccaagaccaagacgaaaaagcagcggtgcatacgagcagcagccaccgagacaggccacacagaacaccacggcaaacacacaaccaagaagggcaagcagaaagagcagaagagaacaaaagaacgcacaagaacaacaaacgacgaaaaaa

SEQ ID NO: 491624 - DNA, 116 bp, Homo sapiens
cgggggggattgagatgggacggatccaactttctctctaccctgtattctatgttctcttcaacatgtaaccaatcagtatcttgtccatatagtcaacccatcgatcggcctca

SEQ ID NO: 491625 - DNA, 541 bp, Homo sapiens
  misc_feature (369)..(369): n is a, c, g, or t
gatctagaggatccatgggtgctcatcccccaggtccagcaacaaaggcatttcctttcttttggaaaagaagggggaaagttccaggaaacataggtacccccagagcatgtgggagccagaagggaaggagcttcagctagaccaggaggaaagagccccatggattgagatcttcctggggaactcaacacccagcacccagggacaggggaagggggctatgggcactcagaaggaggtgatagggatggaggctgaggtcacaggggttctgctggttgcagagggtcagagagcaacagaggggactcacaaaaaggaagcagagtggagtcacgtccagaggctgctgatgcccagccccangagggctgtagagggagcagtatcagggagcaggcaggggtcggggggctctagcatcctgggggagccctgggtccttcagggacacgcaacaaaggaagactctaccgtggagaatccacaagtgcaaacagaagtgacccttgtggccagaggggggatggagcaccca

SEQ ID NO: 491626 - DNA, 685 bp, Homo sapiens
ggtgggggtctcctgccggtgtggtgctggcctctggaggtgggcctggcagcagtgacccatcattgcgcatggagacccatggggcaccaatgcttcaatgcggccatcacagccggccagactggtcaccacttcccagacaatcacaccagtgtggcccagagacctgggggcccagacggtggcccctcgggcctggagtgcatagcaggtgtgccagattcactctgaagtggtggaggaccccgaggctgtgagcgctgtgcagccagctcctggatgatgagcgtattctggtggagcctgcctgtggggcagcccttagccagcccatctactcaggcctccttcggaggctccacggccgagggctgcctgcccccttccctgagcttcagttgtggtaatcgtgtgtggaggcacacaacatcaacagccgagagctgcaggctttgaaaacccaccctgggccacggtctgaggggtcccaatcctggcccccaagacccctgagaggcccctggacagtcctgtgtttggatgaggaggacatcagtgctggcagatggcagatggaaactgccctgtgcaactgtgctggctgcctcctgaaggaagccctcctggactgctttttttggctttccgaccactccggcccaattaacactttttgaattga

SEQ ID NO: 491627 - DNA, 202 bp, Homo sapiens
agacggttctcttctgatactcttctcatatgctataggtattttttttttaaacaccagaatctctttaagtcttaaacaaaagggtagtcggcccggggcatacaggggtccggcgtcccgtgaacccaaccaaccacagatcaaacatattggaggaaaaaaaaattcccaaaaaggtccggaaagagaaaaacttgga

SEQ ID NO: 491628 - DNA, 422 bp, Homo sapiens
ctactgacatacggtggaccgctggataatcagctgttacaaggatgtatatgtggtagtctggcccagttcaaaagttaaagacaagtacctggggatattggtttttatttctttttaactcttattttaggttcaggagtgcatgtgcagctttgttaaacaggtaaattgtgtgtcacaggggttgcgtgtgtacagatatttggtcacttgggtaataagcacagtatctggtaggcaattttttgattctcaccctcctcccaccatccatcgtcaagtaggccccaaggtctgttgttcctttctttgcatccatgtgtactcagtgttaagctcccacttgtaagcgacaagatgcagtatttcgtttccagttcctgtgtaagtacagttaggataatggctttcagctccag

SEQ ID NO: 491629 - DNA, 213 bp, Homo sapiens
gggcccccgggatgggggcccggggaacctttggccggggggaaagggaggggggcaaccccccaaactgtttttttacggggggcgggtttaaagggatttgggggccccccttggccttcaaaaatttggtttccaaattggccattgggttaaggtgggtccccggggtttttttgttttttttgggggcatttaaggggtttttttgga

SEQ ID NO: 491630 - DNA, 838 bp, Homo sapiens
aactgggccgcaagtctttgtgtcggtatcggcctgatggtccgcaacccaattgggatttcgcctctccagagccccttctgcgcacattttcgccgggaaatctgcccagggtacaggctccagtgtaaccatgctggtgggataccctgttgacgtggcataaaatactgttccgtcagtatgattcaccttgggtgaaagcccaccgaaagtctggaagatcccctgtgaaagatttcatctggactcccaccagacacccgctggcccagctctcacgtgcaccggatttccgcaccccgagcccgccccagcccttgcttccatattttccccctcccgctcattaaaccttttagttttttgttaaaaaatttaagaccctgaagaaagcactaggaaaccccccaaaattgaattttgctggaaatttaagtttgagagcacgcccgcccagaggaaacaccacttgggtgggtaaacactgttgtgctttttaatttttttcccgtaagatagtccaccataattaaatttggaccacagagaaaaaatggttgtcaatacaatatataaaagtaaagtctagaaaaaattaaaagtttttgttttgagcctaaattcacgagttaatataaaaaaatggaatcaccacgtaatttgtttttacatattttgaaaattaaataacccttgaaatgataaagtgccagaaaataatgtgaataataatgttgagttttctagtccctcttctgatcccttcatcctggtagcttatatcctgttttgctgcataataaataattttattctcccccttgggaaataccca

SEQ ID NO: 491631 - DNA, 455 bp, Homo sapiens
agcggcaagaagcagcccttctgtgacggctcccacttcttccaacgcgactggcgctagtctccacgatcaagttcgaaggcccaagtagacccagcatggtaggcagctcgtgtaccgtgcagagcacacgtcgagaggcgccacgtagctgcgtatggcagcccacaggtagtgagacgctgtgcaggaaggcagagagtgggctccccagctctgagggggctgctgctgtccagccacaggtgcttggtccaggcctctgacaggcacccccttctgtgggaaaggaaacaggtgctgagcccaagagactctggtacccactgctggctcatgaaggaagaattattccttataacctaaaagtctccagtctggggcaggcgggagtgggccctggttcaatgtttgctgatggggaagatggcaaaaacaagcctgcccaaccagag

SEQ ID NO: 491632 - DNA, 178 bp, Homo sapiens
tatttaaatctgtgttggtttttaattagggagaaagagtctcactgtgtggcccaggatggagtgaaaggaatggtccgggcccaccgtaacctccacctcccaggtccaagtgatcctcaagcccaccctcctgagtagctgggattacaggcctgtgccaccaccccggctaatt

SEQ ID NO: 491633 - DNA, 495 bp, Homo sapiens
  misc_feature (382)..(382): n is a, c, g, or t
  misc_feature (476)..(476): n is a, c, g, or t
ccctggcagacataggaggcggcgatcatgccgcccagcaccagcacacccagcggcaccatgaaccagagaacagcagcaccatgatcgcgacgatgacgaacaggccggctcgtcgccaggtttcaaatgggcccagtagcccgacaccacgcatccgataaccctcccagagaccgggcggaaggcctcatcgcgagaccgcgccacgctccaattgtatcaccgagtgatgtctgtctagtggtccgctacccggcgatcttgaggttgatgcgaccggcgaagatgtccgagaacaggtcatcgaccgaatcatcggcgatctccctgatgtcctcttcctgcccctcgccggcgatgacggcatccatcatggccngcgacgaggcagcccggagcgccgatccaaggatgacaagctcccggtccagagcgaacccgatacccgtctgcttggggctttaatgggggcncgcaagagggcacacactt

SEQ ID NO: 491634 - DNA, 518 bp, Homo sapiens
  misc_feature (6)..(6): n is a, c, g, or t
  misc_feature (62)..(62): n is a, c, g, or t
  misc_feature (69)..(69): n is a, c, g, or t
  misc_feature (74)..(74): n is a, c, g, or t
  misc_feature (88)..(88): n is a, c, g, or t
  misc_feature (174)..(175): n is a, c, g, or t
  misc_feature (183)..(183): n is a, c, g, or t
  misc_feature (193)..(193): n is a, c, g, or t
  misc_feature (208)..(208): n is a, c, g, or t
  misc_feature (214)..(214): n is a, c, g, or t
  misc_feature (228)..(229): n is a, c, g, or t
  misc_feature (232)..(232): n is a, c, g, or t
  misc_feature (240)..(240): n is a, c, g, or t
  misc_feature (425)..(425): n is a, c, g, or t
  misc_feature (501)..(501): n is a, c, g, or t
tctgtncaggccctggggggggactgggcctgggtgggacccagagggtgtcctgggtgggngcccctngtggncagcgctgccagcnttctgtcgcttcagcgtctcctccaccttctccttgaagcgccggttcttctgcttgatcttggccagctcagccttgcgcttggnntccaggtnagggtccttnccctctaggtttagntgcttncgtttgttgttttnnttnttttcgtnaaagtgggccgcctccagtttgtatctcacactctcttcgcaccacgttgacctgtgtgaggttctgttgcacctcggcctcttccacggagaactcctccagcttcttctctgcacgggccgtccggccgactcggtggatgtagatcttgggggagcccgggggtgttgtggttgatgaccanctgtaccgtaggaatgtccaggccccgggaggccacgtctgttgcgatcaggatccggtagatgctggacttgaanttggctagggcggcaaa

SEQ ID NO: 491635 - DNA, 410 bp, Homo sapiens
  misc_feature (36)..(36): n is a, c, g, or t
ggcgaggcgggacggaggaacagaagatgcagattnttgacaggactgctgtctacacaaaagcaatttagtcgatttcacgcggactccgtgtgcgaagcctcgaaccgacgccgctcagtctacctgcctacccgcgagtacccgtctgaacagatcatcgtgacagaaaagacaaacattctcctgttttagctgcatcagcaatgggacaaaaagaacgctgtcaagaagagagaccatgagcaagttgagctggaaggcgagagctccgacactccccgcaaggtggggcggaaggacagcccagacatgcacggaggacacttaagactctcaactccacaggcgcctcctgccaggtctgctcctcggtcgcccacccgcctgcccgccgtaccaaagcacag

SEQ ID NO: 491636 - DNA, 169 bp, Homo sapiens
taagacatggtcaatcagagatactatagacatattgttctgtcccttcgcctaaaggtgcttctgttgagtaagtgtcctctatgcttatcttgatctctttgctctgatcttcctgcagcttcagaattatgtatcggatttcttctctttactttctaataacttg

SEQ ID NO: 491637 - DNA, 454 bp, Homo sapiens
  misc_feature (295)..(295): n is a, c, g, or t
  misc_feature (352)..(352): n is a, c, g, or t
tttcatggcgaccaggacgctctgcatccccagtagcaggctgagccgagggaggctgggtatggccgccccttttggctgtgggagccgcacctcttcctcttccggcccccgtagcaattaggtttctttgcaggagatgaagccagactgctcatcattccagacatcttcagcgtgctacacccagaacaagggcattcgaaaataatgaacagggatggtgagcgccagtatcttttccatatcagtggtggaggtggatgtgaactctcctccaagaggtatctccaanggagattccaggtcccccagtgtttattatagtcacgccatcttaggctcttgatcncacatcaaataagaggcagataaattcttccattctgaagggagcactacttcttaaagcaaacctatggtgaaaatataacaatatgtcacttctaaaaaa

SEQ ID NO: 491638 - DNA, 166 bp, Homo sapiens
ttgctgtggctcagagaaggtgatcacgatctgagcttttgccaggagcctgcctcttttcccacagaaacaacatcgcatttcttcctcatcttcttgtccctcctcagagtctgctgctggtggtgggctggtgtctcctcatggagcaccagtggctcgtggg

SEQ ID NO: 491639 - DNA, 501 bp, Homo sapiens
agacaagtgtggacactggccccttgcctcctgccggcaaagatccccagctgacaaattgagagcatccaccaagggctgcctgagatcacatggatgcctggagccacatctcagcactggcctcgcatggagccatgggggaagcccactcgcccacctacccaccaaaccctgtgtgcagacagtcctaacaaatgcctggaaaaggacaattcctgtcttgcagatcctgacagcccagaggaagggcaccttaccaaccttgaggagtcaggaaggcaacctggagggcatgcccaagctgggttttgacggttgcataggagttcaccagacagactcaggatgggccgggtgggagaggaggttttgcaagaagaaaaggcaggtgccctggctggacagaatgacaaatacaatgactgggaggagaagagggaagtgaaggacaaaagaagggaaggacaaagaaatagaaacaggagcagaaactgtacc

SEQ ID NO: 491640 - DNA, 480 bp, Homo sapiens
  misc_feature (16)..(16): n is a, c, g, or t
  misc_feature (58)..(58): n is a, c, g, or t
  misc_feature (60)..(60): n is a, c, g, or t
  misc_feature (63)..(63): n is a, c, g, or t
  misc_feature (150)..(150): n is a, c, g, or t
  misc_feature (160)..(160): n is a, c, g, or t
  misc_feature (190)..(190): n is a, c, g, or t
  misc_feature (213)..(213): n is a, c, g, or t
  misc_feature (216)..(216): n is a, c, g, or t
  misc_feature (235)..(235): n is a, c, g, or t
  misc_feature (326)..(326): n is a, c, g, or t
  misc_feature (358)..(358): n is a, c, g, or t
agaagtgatccggaanttccaagatggaaccctgaaccttctggtggccacgagtgtngnganggaggggctggacatcccacattgcaatgtggtggtgcgttatgggctcttgaccaatgaaatctccatggtccaggccagggcgtngccgggcgantccagagtgtatacgcgtttgtagcaactnaaggtagccgggagctgaagcgngantgattcaacgaggcgctgnagacgctgatggagcaggcagtggctgctgtgagataaatggaccaggccgagtaccaaggccaagatccgggatctgcagcaggcagccnttgaccaagcgggcggcccaggcagccaagcnggatgaaccagcggcacagtttcccagtggagcacgtgcagctactctgcatcaactgcatggtggctgtgggcatggcaagcgacctgcggaaggtggagggcaccaccatgtcaatgtga

SEQ ID NO: 491641 - DNA, 815 bp, Homo sapiens
  misc_feature (786)..(786): n is a, c, g, or t
ggggcctacttgcctacttgacgccgccggggccggactgacagaacaagcgccaaacaaaaggctaacaaaccggagccaccataaacaggccagacacactttttaaaaaaaaatgctttgatgagaccacacacgacaaggtccatttaatgaactttagacagcgacactaggaaccaacgaccaagagaaccaaaattgcctgaagatggattcacgggccacgggttttacctgaggcaacctaatacgcatattgattatcttggaacaactacatgaagcggtttacttgtggtagatacgataaaaactagatgactaagccccaaggcgtgtatacctcccatgacagaatgctgctgcatggacaacattgcatatactagacaaaagactacgttgattgtctgactaccagaggaaacattggttgaaccctgtcggcctggttcttccaaaaaacgcatcaatctggaaccgggagaacgattttggtcaggtatcaaaaggaacttcaactcttggaaaaaaagagggagattatcacctgagaggggccgacttatgaactcggggaaatggacaatacattgagtcacccaacttttttgccggcacctaaaacgcctttcccccgatgaagcctctccaaaaaggcgccgctcaaaaagcataacgccgaaaaagcccactttggggttggaaaaatcttgggccctaaaattgaaggaaaatttcttggaaaaacactggaaaaaaccacattttaacaacgggatnttggtacccccccccctttttcggttggg

SEQ ID NO: 491642 - DNA, 582 bp, Homo sapiens
ggtgatgtatccccaacactttgagtgcaaggcaggcacatcacctgaggtcaggagttcaagaccagcctggtcaacatggcgaaaccccatttctactaaaaaattagccaggcgccatggcgcatgcctgtagtcccatgtattcaggaggttgagacaccagaatcacttgaacccagaaggcagaggttgcagtgagctaggatcgcaccactttactccaacctgggcaacagagcgagagtccgtcctttatgggtgggcactgtggctcaagcctgcaatcccagcactttgggaggctgaagtgggcggatcacctgaggtcaggagttcgagaccagcctggccaacatggtaaaaacccgtctctactaaaaatacaaaaattagccaggagtggtggtgggctcctgtaatcccagctacttgggagggtgaggcaggagaatcgcttgaacccgggagatgcaggttacagtgagccaagatcacgccactgcactctagtatggaagacagagtaagattctgccttttttttttaaacgtcttctagaaggggaaaaacttctctca

SEQ ID NO: 491643 - DNA, 736 bp, Homo sapiens
tattacacgagtaggaatagacgtagacgacacgagcatattttcacctccgctgaccataatcatcggtatccccaccggcgtcaaagtattaagctgactcgccacactccacggaagcaatatgaaatgatctgctgcagtgctctgagccctaggatacatctttcttgtttcaccgtaggtggccatgacatgggctcgtcattagcaaactcatcactagacatcgtacatacacgacacgtactacgttgtaagcccacttcacactatgtcctatcaataggagctgtatttgccatcataggaggcttcattcactgactttcccctataactcaggctaaaccctaggaacaaaaccatacgccaaaaaatccatttcactatcatatcatcgggtaaatctaacttcttcccaaaaacaatttctcgggcctatccggaatgccccgacgttactcggactaccccgatgcaatacaccacatgaaaaatgctatcatctgtaggctcattcatttctcataacagcagtaatattaataatcttcatgattgagcagcttcgttcgaaggaaaagtcctaatagtagaagaccccctccagaagctggagtgactatatggatgcccccgacctaccaaaaatgcgaagaaaccgatactaaatgtgacaaaaaaggaggatcgaaccccaagtggtgcaagcaaccaggcaccaggactcgac

SEQ ID NO: 491644 - DNA, 475 bp, Homo sapiens
gaagccaaatccctgggagactaacccacaattttttgagaattaaggtattcttggagcccgcactggtcgttattgatcacatctgtgtgaagccaaagccccgtggttgcccatgagaagtgtccttgttcattttcacccaaatgaagtgtgaacgtgatgttttcggatgcaaactcagctcagggattcattttgtgttttagtttaaaaggcacccttatttttaaaacccctgcttcacgtccctatgttgggaagtccaaatttgtttgctttttttgcagcatcatttccttacaaaactgtccgggggacaaaatgacaattgaaatgtttttttgaaaaaattactttagctgccctaacagtccaatgcttgttaatggttaaaataggcagggcgaaaactactttgtaacttttaaagttttaaacttttcaataaaattgagtgagacttataggccca

SEQ ID NO: 491645 - DNA, 305 bp, Homo sapiens
gctcactcagggagctcggattttaagacactagcctgctgatgctcccagctgattaaagccactcccttcactatcttggtgtctgaggggttttgtccgcagctggtcctgctacagtgagatgggaaattttttaaattacatttttaggctgggtgcagtggcttactcctgtaatccgagtgctttgggaggccaatgaaggatgcttacttgaagccaggggttcaagaccaacctgactacatagtgagaccccatctctgcaaaaaaaaattttttttaagtaactgccttttaat

SEQ ID NO: 491646 - DNA, 310 bp, Homo sapiens
aacgggtgatgcggttggttccaaaaaaaaaaaaaaaaaaaggggtggccctttctgggaccgggggtttcccccggaaacatccaatttggggccagccaccaaaaaggcccggcctttaattttattccaaaaaccgggatgggggggaccttaaagagcccctttccggggggccccccaatttttatttgggtttggaaaaaaccgggaaaaacggtctttggttaaaaaaaaaaaatttccccccgggtttccttccccggataaaccttcaagggccgaaagggggaaaaccggggtttgtttt

SEQ ID NO: 491647 - DNA, 293 bp, Homo sapiens
gggggggcctccttaaaatttgcacctggcaccttgtgtgtctcaccctaatcctggccctgtccatgactcagtcttcaaactaccccattaaagatctcttccaatcaggaaaacataaaaaggtcttttcctaggcagttagttcagacacagcaggtgagtgcaggtatagcaggcaggtgcaggtacagcaggtgggtgcaggtatagcaggtgggtacaggtatagcaggtaggtgcaggtatagcaggtgggtgcaggtatagcaggcgggtcaggatcagcagag

SEQ ID NO: 491648 - DNA, 493 bp, Homo sapiens
cacatgtgccaccccctaccttccgggtcccagcaattcccatggctttggttggggtgagtgctggatgacctaggcgttgggtcctagccatgcaggagagacctggagggttggcaaagccaagtctggggctgtcaggcctgggtgccccttcacagggacggggaattgtagactgagtagcagaagggagccctcaggcacaaggatcatgaattacaaattgcaaattacataaaggaaaaatcagagcccaaaggtgggcctgcaattattaatgtaatgttcttaagttctctttctgctttcgtttctgcctgctttaagtctgctgttacttttctacagagataaaatccactgtttgcatccaaccatttctttttattgtttgtgtaaaccaatgaatttgtattactatctcatggctggagttctgaagtaaaaccatacttttgcttgagtgtgtatgtgtgtatatgtgcacata

SEQ ID NO: 491649 - DNA, 1127 bp, Homo sapiens
  misc_feature (613)..(613): n is a, c, g, or t
ggaagaacctgcaggttcattcttgaggtgagtacccccatcggttcggggtccatgtgcccgcgctcagtgcacagtgcatgaggtgggccccaccatgactgagaacggcagaagatggtgtgtgcgccctggctgcgtgtgtctgggaacgtcctccttacgaactgtgatcgcgcttggagtctggcggggggtgtccgagcgcgtgaggcccacggagggaagagtctccatctttactctctcgtggcgtgtggggctttctagtgtgccatgcactcgcctcatgggactggcacgcgctggtggtgagctaagcacatgcccctagcgaaacgatttacgcattgaggaatctgccttgctgcgatcgccagggctagaactgtaggtccttctaacatgggcttgcgttgagagcataggcggccctccgaggcttggggtgccttggcatactacgcgccgcgctgcatcgacccttgttccgtcggtcaaacgcctttgttgagctcttaatgtcgaacaaacggccggaaacgtgctatattcgaaatagtatctcctcgatacggggaccgaccgactatttcaccgcgagggtgggaancgaagcgcgtaccagtcgcttcagaactaggcaccccctggagggtaggacgtcgaagtccagtgaggcccgggcatcaatcgaggttcgcggggcgtcccgatctccgttgctcatgaggcacgctgggagaagcgttgctcgaaaggagagtatgtttacggacaaccgatcttcaattgggggaaccaataaagaagcgcaagaccagtcgtggacaggctcgttgtggactttgttccgaccacccggtgtaccgggcagaacggtgaaaggttaaggcgaccgtccttgggatttcgccacgaggctggacctaccaagaaacgtaaattcgacaatgccgtacatggggcgcaactacttcgacgtgaagcgtagaaatgggccgtgggttggttctttttcgcgcgcggaattacaaaaggggcggggcacagacatgcctctcgaggttgcacgcaggttggccggagcgctgttccgttccctgcggtttgcgaagggcccatcg

SEQ ID NO: 491650 - DNA, 893 bp, Homo sapiens
gctagagctagcccctaaacccattccaacttactaccagaccaccttagccgaaccatttacccattaatcacgtataggccgataggaaattgaaacctggcgcaatagatatagtaccgctagagggagatgggatgaaaaagttgtgataccgaaggctataatatagctagggactaacccctataccttctgcgataatgaattacactagtaaataactttgcaaggagagcctaaaagctaagaccgcccgataatcagacagagcgtaatcttaagaacatgtgaagaggagcacacccgtctatgtagcataacatcagcatatgtgtggtaggaggagtatatgtggatgatgaagaatcaggttcaacctctcactgtcttacttgcttcccagtctcgatagccttggcatctggaatgggtccggactgtccatcctctgccggttcaggccaggtgtctcttcggttctgggcaaaggtgggatggcttatgtctatgtacgtttgcaggcaaatgaccttcgatcggaggcttcggtgggattcagccattatgctatggtcctgtggctgcgacactggcgccgtgtccaaatctacccctatgctaaaggtctactcggtcttaatggtgatgtcaccgtacgcgctgatccatcgtctaggaggtgcgactgatgcaactcatgtggctcaggtgggtctcgaccgcctcggggtcggacttcgggccgcgaatccccctccgttgggtgcgcctaccggaaagggtgggggccgactggcttcgcttcacttgcctgacttgaggtgtgcttcggaaccgtgcgacgcgcacttcagggggcacacgcaatccccactccagctcacgggggc

SEQ ID NO: 491651 - DNA, 1894 bp, Homo sapiens
  misc_feature (1071)..(1071): n is a, c, g, or t
  misc_feature (1122)..(1122): n is a, c, g, or t
  misc_feature (1655)..(1655): n is a, c, g, or t
tatgttgctttgtttcgatagtcgatcgtagttggaatgaagaatatggtgagctcagcattatagaagtgttttttgctgttcactcttttggtttggggttccgtgtcttgtttgtctgcacgtggcttgttttcttcttgtgtggtgctatagtctctctcgcttcgttattggttgtggatgtttcgctcatgctgctcgttgattgctgttgtggttgtgtggtgctacgctcgttggcgttgtgttgcctaggacggcttgtcatgtctcgtgtggttgctcactgtattatgtctccgggtgggtctcattgtgtgggatagtggtggtgattgatgattcgccctgagggtgtggtttctatttgttgtgtttgtggtctccgtgtgtgctttctcgggtgtgtggtccgcaccagcgtgtgggtagatgcagctgcgcgctgtgagagcgggtatgtgctgttcttctcgctggatttggggggtaactcgctcgctagtgtcatattgttacacagtggttgtgtgatgcggttgcttgctgggttatcacagaccactgcgcgtgtctgctgcggggatcctcccgtggtgtcccgctctgctggttgtgttgtgcgctgagagggggtttccgccctggtgtcatggttctgtcattgggcactttatcctttttggcccctatagtggatttgtgtggcgcaagctgtgtgtgttgttgacccgcccgaagtggtagccccctcgagaccaggttgtgttgctgcagcatctgggggcccacaatcgcctccggtggcccccgtcgttatgatgattttgttgggggtcgggttcgtactcctggttggcctcgttgttggtgtgggagaagttgctggtgtggagaaagagggtgtggttttgtgtggtgccttcggcctcagtccgggtgagttgtagacgccctctagccttgtcctaagagggttcttgcgtgttgtttagtaggccccacctgctgcgggggggattgccactactattagttctgtgacacctcaactaatgggggattagnagccactgtgtccgccccccctctggaagtgggaagatagtggcgactaancctctcccacgggagagcacctagtgtgttctccacaaggttgtgataacacacatccgcacagaagtgacaattagttgtgttgaatttgagccctagaagacgccacagtaataggggtgtgcctcccatattgaagtcgtctcgccctctttggggctcagtcttgtgccgattgtgtcgaggccgccaccctgtctctttggggggttttttggttggcttagagatggagttgtagctgcgtgtgaccccgcacaggtgccccgagacccgttgtccgccctccccctggggttgtggtgataaggagattggtggtgtgcgtaccacgcgagtgcccttgtccaacacagaggctttcccgggggagccgcttatctcccagggagaatatctggccaccaccggttggagacccagaggtaaccccagagcgtccatgggttgtaagagttatagcttctcagaaatgtgcccttcttgtttgtatagacacttcggtgaagtggccctgcgttgtgcccgacttnggatgttgggacttgcggaacttgtgcctgcatgggattgtctggaatgaaacagagcaccctggtgacacctgcgtgttaatgccaaggtgccatagtgagatgtaatggacttgtggtgtattatatggctcacccctgtgtagagacttgtttcggatttccttgttcccttctgtaattttgtaaaaaccttttaactggtagaaccttggaatataagtaaagtggggtttaaa

SEQ ID NO: 491652 - DNA, 1139 bp, Homo sapiens
ctttgagactcacatgactttctggtttggggtctggtcatttccctttcaatttttgaatctccttctctgttcagttggcttggcaaagtaccctctgttctcatgtcactaattcctgctctaggtcatctttcctttgtgcagcccacattcccaccatcctgtgaactttgttgtacttggtgttgggcaactggtgagtgttgtgacaggctcagacctgatccttcctcaggagcaattggagaccacaaatttaaagcagaaatacctgttaaaagcttggctttccttatatgagtgaggctcccagcttgggtgtggcctcctgggctcacggatcagcttgctgggccagagggggtcttagtaatgtgctagagagacacatgctcccttctcatcgtagagagcctgcatgctgagaggctccctttagacacctgcctctcgctggcttttcctttagacctagccaccagtgttttgaatcatggttttgttttgtttttgcatgcaaaaaccagaacatgacttagaaattaaaaaaaaaaaatcctactagccaagtgactgcctgcagaggctcttcattaacatttgggctgatcctgcttttgacttattcccataatggcccagttttgaagtcagccaagtccttttgtccttgacaacatcatgcagtggaaatacggtgagttctagattcttatgggacagcatgcagccctagaggaaaaattgacttcttgggtatgctgagaaataagacagtaaaatggcttcagttgatgcaaggggattttagttaaaaattggttcaggatttttaaattttattttattttttggctgggcgcggtggctcacgcctgtaatcccagcactttgggaggctgaggtgggtggatcacctaaggacagcagttcgagaccagcctggccaacatagtgaaaccctgtctctactaaaaatacaaatatcagccaggtgtgatggcacatgcctgtagtcccagctacttgggaggctgaggcaggagaattgcttgaatccgggaggtggaggttgcagtgagctgagatcatgccattgcattccagcctgggcaacagaacgagactccgtctca

SEQ ID NO: 491653 - DNA, 867 bp, Homo sapiens
accaacttgcatttaacaaacaagaacttcgtaaagtcattaaggagtaccctgggaaagggaagtatcatacaaggtctagataacctctacaaggaaagttgataaacatttatgtgaagacagagaacttacttcaggtggtgtggccactccatgcaagagtgaatttagtacgccagctataagcactcttgaaggtctggatagcgtcgctgttgatccctggatcgtggtgtaacaatggaattcactattcaggacattctggcattattgttccagcattgcaacagtcccacttaaaccttgtgaaagaagaaaagataactgaagtgaagcatttgagtaataacagacagcatataccaaaagtaccaagcaacgtgtttttgagaacccagacttaaaattttatgtattattaaagtgttagataaatgggtagtaccatacttacaaatatttaaatgcaaaattaccagactatatagcagtgtatttgccctatagggttgcataataagttaagcattcatgtcagcataaaaggcttgagacatttgtcgatgacctggatgggaaatgttgccttagtgtactaggctgcttgtgttagaggtggtaggtcctaatgaagcaatgcattggggaggtgcgtaagaatagaactaatacatctgctggctgtattaatcatgtacgtaattaaaatactgggacaaaagtgtttgtaaaacctcaggaagttgtatacagagaaagagggtcgtgggaggatcagtgggaacaaaagttgaggaatagtgctgaacatatggtaataatcaaagtgacatgggagaaaaagaaacaaaatgggaagaa

SEQ ID NO: 491654 - DNA, 284 bp, Homo sapiens
  misc_feature (74)..(74): n is a, c, g, or t
  misc_feature (153)..(153): n is a, c, g, or t
  misc_feature (155)..(155): n is a, c, g, or t
  misc_feature (164)..(164): n is a, c, g, or t
  misc_feature (236)..(236): n is a, c, g, or t
  misc_feature (268)..(268): n is a, c, g, or t
gagacggtctcactctcacccaggctggattgcagtggtgtgatctcgaccaactgcaacctctgcctcccacnccgcaagctatctgcccacctcagcctctggagtagctgggacgggactacagcacctgccaccatgactggctaattntnttttgtatnttttgtggagatggggtcttgccatgttgctcaggctggtctggtctcaaaactgctctgggctcaagtgantgtcccactttggcctcccagagtgctgggantaaggtgtgagatact

SEQ ID NO: 491655 - DNA, 1034 bp, Homo sapiens
acttacatgagtgcgcgtgtgtgcggagtcatcgagagggcagaggtaggagcatttgcacccgaagtgatagttagtcacatctgaagctgaaattatgcaaaaatcgctgggcaagttgatataccatatgtgtgtcctatcatattaattgttgaaatcatgaattgagtagaagggtgactaattagatcaagacatacgagaagatgagaagtgagagctaagtgttgcaagaatcatgcgtattgtggcagcaatcgctagtagaaacatggagaataaccgtgggacagtagattctactgaaggtttagaatgactgatgtgggatatgggatcagattggtaattcaacattgaagttatctgagcaagtgaatcggtgacgaagaagaatgatagtagtcgcgtacttgggagcgacaatgaaactgtcagagaaaggaatgcccggatgatgattctgtacttaagggatctggtgtagtaaggggttaatatttgatttcgggtaaggcagaagaacttgagggcactggttgatgaaacggtaaccttggggatttacgaacgttataagcaagcatggaacgtagaggttccgattcgcaagatgaatgccaagggcatttgtggtgatgattgcattgggtggatggggacgccttgagacttgattgaagaagtatgtcacctaaattgaatgtcatgcgcaatgcagaagcgatgtttggtaccagacatggtgtcagagatcgtcttggggcctacaaaatgcagaaatcacgggccgctcgcccttaggacaagacaccttcagcctcgtcaaaaagggtatgctccaccgtactgtccaaacacagcattatgcgtggataggtagccccacaggactgcaagaacatcccaggtctcccgacccgtaacctacaacggccggggggcaaacacccgaggggagacaactgatacagaaacaccggggatgtagccaccccggaaaatccaaaggcgctctggagggaaaccgg

SEQ ID NO: 491656 - DNA, 379 bp, Homo sapiens
  misc_feature (12)..(12): n is a, c, g, or t
  misc_feature (118)..(118): n is a, c, g, or t
  misc_feature (120)..(120): n is a, c, g, or t
  misc_feature (125)..(126): n is a, c, g, or t
  misc_feature (133)..(133): n is a, c, g, or t
  misc_feature (136)..(136): n is a, c, g, or t
caataaattgtnggcattgatacgataggtcagctgtcgccaacgtcacacttcttcaaatatttgggagtggcggatgtcaacggcgctataatgcaagaaatcgagcgctttcttncntctcnngatcctnagnttctatgtgtccgcgggaaatggggaaccggaaagacttacaattggaagactatcgccaaggcagcaaaactgaaagatggcggcgtggcaatgaatacctacgcctacatctcgctcttcggggtgaattccttgggtgacttcaaaatgcagatcgtccaagcgacggtcccacgctcctccataggcgacccaaaccctgccaaccgctggattgcgatcaatgaccaacaatttattg

SEQ ID NO: 491657 - DNA, 419 bp, Homo sapiens
gctctagaggacctttatatgcgtctcatcttcgttaaaattttgatttttttcatcatggatgttggcaataattttaacttttaacaaatgatggcatcaaactattactaattaatggaggtgggttttttggcacttctttaaaatatggtgtctagagcaagtgcctgccccccctcaacctagtctcagctctggatcgggcaaaatcaccctttctaaaaggattatcacaaagcgtcagtgacagtgtatgggagctgaatgctgtcattttgagatactaacttattccactgtagacaatttccttatatccattgacttgcattcatatgctaagttggtttcctatattccctgctctccagggaaactcagaacaaagagtaaaatccttggctttgagttgcaaa

SEQ ID NO: 491658 - DNA, 154 bp, Homo sapiens
ctcaagacctgaccagaggcagaagcaggaagcagcggtctcacaaagcactttcttaaaccttgaaaatctccaagagaaaaatatttggggaaggagggaggaaatgtgtcccttgcacaccacccctgaagcacatggcagaagcaggaag

SEQ ID NO: 491659 - DNA, 105 bp, Homo sapiens
ggccactcctggagcttacatgtttgaccacatggagagctgctgcttggagagttttccccgtgcattcaccccagctgagcatgtgtgaccacagcctgtcac

SEQ ID NO: 491660 - DNA, 299 bp, Homo sapiens
gttaggtgccgctgttgctgctcgtgttgaatctagaccgtagccagacatgggactggaggacgagcaaaagatgcttaccgaatccggagatcctgaggaggaggaagaggaagaggaggaattagtgataggactgaggctttcagtgcatacttggcaaccttggaaggcaggaatgtgaacttttcctactacttagcatcagaattgaatgggagacgcattctgcatttctgtcggcagttggctctacagctggcttctgcacggatccctaacaacagtagagagcatgc

SEQ ID NO: 491661 - DNA, 295 bp, Homo sapiens
agagccggtccggctctttgtggctcgttggggtggctcgtgcgtgtggctcgttggtaatactaagttgagatgatatcatctacttcaaattcctccctgtacgaaaggacaagagaaataaggcctacttcacaaagcgccgctgcccacgaagggtatctcttccggatccgcctaatctactccacctcaatcacactactccccatatctaacaacgtaaaaataaaatgacagtttgaacatacaaaacccaccccattcctccccacactcggcacttcgtgggcag

SEQ ID NO: 491662 - DNA, 262 bp, Homo sapiens
ccgacttgacgcgtctcctgagcagctgggattacaggcatgcacacaacccaaataatcttctatctttagcaggacaggtttctccacattggtcaggcgtggtctcgaactcccgacctcaggtgatcctcccacctcggcctcacaaagtgctgggattacaggcatgtgccgccacgcccggcctaattttctaattttttttttttaactgaagaaggaccccagggaacgtcaaacaggggcctatagccccatg

SEQ ID NO: 491663 - DNA, 297 bp, Homo sapiens
taaaggaatttgatctaggtacactggttgccctcttatctctgtcatcactttaaatatatggcttattgttccctgtctatagttccttcggtgggtcattctaacacctaaagaggtgtcaattctaattcatacagagtttttaacctctaggtggtttactttactctataatctcccacagaacctttcttaaggttctgttacatgcatttatatagagtaagttttgtatgtttcgatgactttccttttatttttctttttgaaattttttatctatttcttctagtc

SEQ ID NO: 491664 - DNA, 331 bp, Homo sapiens
gtggataagaggaagaggttgtagggatttgggaagaacctttattattccctggaggaaaagacaaatctacttccctggaaatcaccctcgtaatcttcttccaccctcatgaacttaaatatgaactgcatcctttttttcatcttcttttcttctcctagtgaatatgatctccaaacccttattttttctttgaactgttaaatttccactcatggacgatgcaggcaacatatgcaatctctgagaagatgaaaattgggacctcttattatctaattgacctagctggactcaggaaaccagggaagaagtctatgcaggcatt

SEQ ID NO: 491665 - DNA, 410 bp, Homo sapiens
ggggggtccccccgggggccccagggggggggggaaacctttttttctttgtccccccccttggggggggcccggtgaagttttccgggaaaaccccttattttttggggcccgggggggggaagggcttccgggattccccccaaaacccccggggggggttaatttgggttttttttttttccccccgggggggtttttggtcccccccccccccaattgggttccgccccccccaaaggggttttggggttccccaattaaccgggccccccctcctgggccccaaatccggcccgccctttccccctttgggttctgcccctttaccccccccttttttggtttttggggggaccaaattttttccgcccgccccttttttctttaaacttttttttggggtggga

SEQ ID NO: 491666 - DNA, 459 bp, Homo sapiens
tggctaagaatgggtaacatgactcttgttggattgttattttttgtttgcaatggggaatttataagaagcatcaagtctctttcttaccaaagtcttgttaggtgtgtaatagttttggtggctgactgatcattttgctaataaagattttttactgctaaaatggaatttgtttggagttccccttaagccagtaaagagagtattaggcactcagtaaaatctgccatataaagaagttgtaattgtttgttgtgtatgttgtttcttcaatgcccaaccatctgtggtccgatttacatacgcattttaggtgccacagccataagttcagagatagatttcccaaccagacattgggtcactccctggtcaccttgccagtgcattttattataagggaatctggtgtagccaatgggaataaacctgggtttctatagacccagttctgaa

SEQ ID NO: 491667 - DNA, 922 bp, Homo sapiens
agaggggggaggggaaactggggtgaagaacggggagtgcggcagggtaagggggtgggggcctggcgggggcaatcacggcgagagctggtgagtccgccggggctccgttccggagcgaagggaacgcgtgcggctgcgccgtgggcaagtgcgggaggggacggggacagcgacgcggcagggcaggacggagtcgaccctgtaaggtagacgtggcgccgtgcaggggcgcgtcctgcctgggcgagaggtgccctggcatgagggccgccgccgctgcgcgcgaaactgattgcataacttcaaatgggactagaaggttgggtagaaagacttgtgtgaattagggttgggaaatatcagggtagtcatgataatctgcattacggggtacactgtagagggagaggaagactctgttatgtgtatcacatttgtggtgaccaatgaatcttcgcggatagagaaatgtttgtggtggtggttcaagagtagaagaagactatgcgaagcattatgtggaagagctacaaattttcgcttcacgcgagcaaagatgcccagtccctttgaactgatgacacatttttgggcactttaatcaagtggtgggagttgacacgccctttgcggataagaagacttgctttctaaagggatggaacatccaaggagttaggagcgccccgggattatctcctttccaagttgggttagaaaaattaaggcatttgaaaaacaggggattaattgagtttctttgtggtttaaacccgcagggaactatgacttttgagacgaaaggaagattgacttacttctactgacattggctccgaagggggtgggagaacgaagaaagattttacctggaagtagaaagggacccagaaggttattggggattgcttgataagaa

SEQ ID NO: 491668 - DNA, 694 bp, Homo sapiens
  misc_feature (292)..(292): n is a, c, g, or t
tttgtgttttttttttcaaaaataaccttttcgtgtgtggaccaagaaaacaaggttgcattaaggttctcgtggtttgaccctgagaagctccaaagactgagagtgcctgcctctttgtaatagctctgtatgaaccttgtgcatcccctcagtgttgccttgttccaagctcttttgttgacaagcaatttggtccttaagtatttcctctgggtgaagtttcaaaatacttgccattcggtctatatactatatatactaactatataactatatatactactgtacntgtttcccattttaaaccaagacacacagaactgaatgtagttcttcacatatggtctggcagagtaaaatgttgtagatatatcacagttatgaatcttgtatggttattaatgcaatctaagcttgcttgtttatttgctggcatttttagcaactgcatctcatcttgggctaatattgacgctaaggttttgcttagttaattaatccaggatttcttatcacatgaattgttttatccaaaggcaaaactttgtacgaagtccttttaaaattcatcttgttggccgggcgcggtggctcacgcctgtaatcccagcactttgggaggccaaggcgggcagataacgaggtcagcagattgagaccattctggctaacgcggtgaaaccccgtctcg

SEQ ID NO: 491669 - DNA, 182 bp, Homo sapiens
ggggcccccgtttttttttttaaaggaatttgggtggggggcttcaccgggccccccttttttttaaaaaaacttttgggggttgtcctccccccccccccggtcccccccccctgtccccccccttttccttttccccccctggggtcttttttttataaaaaaaaattttttgtggttta

SEQ ID NO: 491670 - DNA, 933 bp, Homo sapiens
catggtggctcacacctgtaatcccagcactgtgggaggccaaggcaggtggatcccttgaggtcaggagtttgagaccagactggccaacatggtgaaaccccgtctctactaacaatacaaaaattagctgggtgtggttgcgcctgcatgtaaatcccagctactggggacgcagaggtgagagaatcacttgaactcgggagatgaaggttgcagtcagcagcgatcgcgtcactgcactccagccttggggaacgagtgagaccccgtactctgaatgacatgacatgaatgaatgaatgaatgaatgaatgaatgacagaaacttgccttaagtcaactaagggacaaaacaaatatataactaaatccatgtactcttatctctacaacatcaccccacaagcactctagacactgcttcttaattatcttggctggattccttagtcacatggatataacaaccatatacgattgttaacataattccctagaatacgtagaaattgtataacattcataagctatcagcagaacgaaaaggaccgtgagactactgtagcgcacagacacatgggacacgacaaacgggacaatacacaagagagcgaaaacaaacacacaagagaaaaccaaagaaaagaaagaagaaaaagacaaacaagcaagcaacgaaaaaaaaaaagaaaaagaaagaacacagacgaacaaacaacaagcgcaacgagagaaaaaaaaaggtaaggaacacacgaaagacgagagaacaagcagcaagcagacgaaacacaaaggagcagaaaaaaaagacgaacaagaacggaaaaaaagaaagaaaaaaccacaaaagaggaaaagaggagagaagaaaaaaagagagaaaacaaaaaaaaaaacaaggaaaaacgagaagaacagaacaggaaa

SEQ ID NO: 491671 - DNA, 1358 bp, Homo sapiens
acgtttgttgtgaggttcgtcttgttctcttttgcgtctgttgttcttgtgttgtgttttttcacgctgttgttgtcgtgtctcttcttgtgatcggctcttctttttgcttggtgttttcctcttttctcgtgtatcgtggggtgtctgtggtgcgtctttcggtgatttttctatcgttgtgcctgtggtgccctttggtggttctttttcgtgatactgtccccgctggtttttcttgtcaaatattgggttttgttggttgctccgtgttttattttttccttgtttctggtcttgtctggatggtgattgtgttgttgtttttttggtttgttctcctggtgtctttgggtgcttcctgttgttcaccccgtgggagttccctttgtccgttttttgttggcccgtttattgtctcgtctgttgttccatttcctcttttctctgttcatgcccttttgtgcctccttctataccggtctgttacttccttgtctttttgtctttgcattgttttttcttgtcttgcatgtggttcttgtgttcccgtgtcctaggttctatgttgtggttactctcctggttccccccttgtgtgtatgatgtggcatatcgtttgtatgatgttactatcatcctatggtctttgtatctccttttgttcatgcttggtactatgtgtcttgcttattacagtctctagtactcttcgtgccgttattccgtctctacatgggtggtcttttaggttagtatccctttggtccaggtatgggctgtatgtcctagtcttattcattgtcttctgttcattatctgacctgtggtattggtagctcgattagttactaccttctagtatacataggccttatgtatgaagtcctatctctagtagatatgtaatggtataggtagtaggtatagtaagtaggtagtatactagatagatacctacctctaggagtaggaagaagtaatagcatggataactcaggtagtgactattcccttctactccttttcctacccatatggtgtgtgtaagtactggagcctatagctgcctgctactgggctttacatggtgaacagacaccccccgtgggatagggaagatagcaggaaagaaaaagtaaactccatagaagtgtcaataccaactgggttttgataattggacattaagactgccagtctcccatttgtgaccataatgccaagccatcatataatggaggatacacaacaaaaccccccaatattctatgatcatcacaaacatcacatgaaaaccccatcatcatcaactaatacatttgcatgttgaaattcccttgctgagatgttaaagt

SEQ ID NO: 491672 - DNA, 215 bp, Homo sapiens
  misc_feature (26)..(26): n is a, c, g, or t
  misc_feature (31)..(31): n is a, c, g, or t
  misc_feature (35)..(35): n is a, c, g, or t
  misc_feature (50)..(50): n is a, c, g, or t
  misc_feature (55)..(56): n is a, c, g, or t
  misc_feature (75)..(75): n is a, c, g, or t
  misc_feature (77)..(77): n is a, c, g, or t
  misc_feature (114)..(114): n is a, c, g, or t
  misc_feature (137)..(137): n is a, c, g, or t
  misc_feature (186)..(186): n is a, c, g, or t
gcaatcggacagactgagagagttangtcanatantagcaatctctctgntctcnntcagcggaactcctttccngntgggatagctgctgccaagagtgacagtgccttcctnatgagggttcctttgttcaggtntttacctcgttatagtacagcctatttctgataccactcaggtcaaaanactgtcgtgttgggtactacgctttggca

SEQ ID NO: 491673 - DNA, 347 bp, Homo sapiens
gcgccaggcagcagcggcaacagcttgctgtcgtagtggcgcaattgtccctgagcctgggcgtggcctgtgccggtgcattgctcggcggctttaccgccgaagccggcaatgacggggtcaataccgtgcggggcgccttccaactgaccttcctcaccgtgggcctcatggcgatgctggcggcggcgatcttcctgcaactgtcgcccaaggacggcaaacgggtggtcagccgcgagcacgatatcgagcattgaagcagctgcaagcttcaagttgtaagcctcaagcttgcggcttgcagctgataacttgccgcgcccccctactcgcgtccgtagcgg

SEQ ID NO: 491674 - DNA, 102 bp, Homo sapiens
tgcggtcgctctagaggatctcctatcagcaccacacatgtatacactcaagaccacagtgacattctctacacagaactatattcgatatagcttggactg

SEQ ID NO: 491675 - DNA, 250 bp, Homo sapiens
ttatcccctaaactggtttttttcaaaaaagctaaggaaaccctatttggtgaaacttggattttttcctataaaagtggggcccaacaatgatgattttttgtgggggttaaggaaactttctaaagctcccctaacagtttcataaggaggcagccctcataaccctttaatagcatgccagggtaaaaatgagttttttactgctttgtaaaaaaatggaaaagggccataaaaatatattttttta

SEQ ID NO: 491676 - DNA, 1089 bp, Homo sapiens
  misc_feature (164)..(164): n is a, c, g, or t
  misc_feature (237)..(237): n is a, c, g, or t
  misc_feature (452)..(452): n is a, c, g, or t
  misc_feature (555)..(555): n is a, c, g, or t
  misc_feature (612)..(612): n is a, c, g, or t
  misc_feature (797)..(797): n is a, c, g, or t
gcaaagacgtacgtccgcgcgttcggtccatcagccatcaattggctctcttgccatgtgcgcatcggctcgcgccgtacctactctagctggccgtagcgaactcaggaggcataccggagtcagacagcgtggaccccctaggcatgctgcagcgctgcagngcttgaagtacccggcatggcaactgagtgctcttcctgtcggtgtcacgccaatctcaaggtgacaactggnagccagaacagggctgctggcaggcagcttgcctgccgcgtgacagtggccgtgaaaaggaacggtgttggcgaggcagacagtgcgagccatgattgggatcgaaggaagcccacctaggggaccctgggacctggcctaggtagacgtggaagacattgtggcggagccacgggatcgctgtcatacttacaagaggtcatacgatgccagcnaggaacaaatagaggacccaagaggccagaagtgaccgaatggacaaaggtgtagtagcgtgacgtagcggacagcacgagagtacggggatggcagcacttnaccgggcagaggaacctctgagggcagcggggacatagccaaggctcgtccgcaggnattagtagctgacggggggaaaagattagtccgatcccaccgatcaaatcggaaggagggtagacgcaacgcagggaactgcatgtcagtgagaggggcaagacagaggcgcatggagagttccaaatcactccaggccaatcagtcgcacgagggttccactgggacttggagaccaacgcagnttgacgcgggtcgctcgagggaaggggcataaggggcccgcgggttggccccccctctcgggacggttgaccacaaaaccagggggcacgcgtgttcaaacggtcccaaacacagttgtgcgcggccacagaatggcacgaaccccgcgcagcgacgcaacgtggaacgccaacgggcaggacccgtcatcgccgaagaccacaccccccaaaagaccccgaaaacccgaattgagagaaatttgtggggcacaccaacaaggggggggaagggcaacaaaaagagagaaga

SEQ ID NO: 491677 - DNA, 310 bp, Homo sapiens
gatctaggctcactgtcaatctctgcctcctgggttcacgtgattctccttcctcactcagcctcccaagtagctggggttacaggtgtacgccaccacgcctggccaatttttgtatttttggtagagatgggatttcactatgttggccaggctggtctcaaactcctgaccttgggtgttccacctgcgtccccctcccaaagtgttgggattacaggcatgagccactgtgcccggctttactctttattttgaacagataactattgtaggcttttttgacttcttaggatggaccgggggatct

SEQ ID NO: 491678 - DNA, 238 bp, Homo sapiens
aggcctgcctaccgtaggtctctcagagcctttactctagtcactctttagaggggggcactagaagcaatatctccgaaacttcttcgactgtcgagactttttactcataattcgcttcaagccaactacggaggcgcatttacaaaactgaaatacgagcgacaccccaggaacgcacggagacatgacgcccttaatcctctgtccctactccctctcctaggacaccgcatta

SEQ ID NO: 491679 - DNA, 506 bp, Homo sapiens
  misc_feature (9)..(9): n is a, c, g, or t
  misc_feature (30)..(31): n is a, c, g, or t
  misc_feature (96)..(96): n is a, c, g, or t
  misc_feature (202)..(202): n is a, c, g, or t
  misc_feature (206)..(206): n is a, c, g, or t
  misc_feature (369)..(370): n is a, c, g, or t
  misc_feature (393)..(393): n is a, c, g, or t
  misc_feature (450)..(450): n is a, c, g, or t
  misc_feature (461)..(461): n is a, c, g, or t
  misc_feature (467)..(467): n is a, c, g, or t
gcattaatntgagcgcgcacaaaggctttnngttgaaacagttctcgtgactgggctcctaggtgggccttgtattggagcctggccctgttcttngccaccgcgtaagggactcctttagagtgtaatcctaatcagtaatgtaagcctcatagtacccgtctgctccgtccttagtaatagcctcataagcgttcttagncttnggacctcctcctgctcagcagcagtcataacagtctgtactaatatcgttccaggtcgcattgctaatatagtcattcatgggcgtctgtcggaatttcaaagacaccagtacctcagtaatccggctagccttggtattgttagagttttcctcatgtattnntaagaaccagcactcatgccttntttcacttatgttattcaaatctgtacaaatgccactgagtaccccttgcctacttngaagcttaatncgactnttggtaacttccatcttgtgtttgtaaagagcatcttgt

SEQ ID NO: 491680 - DNA, 814 bp, Homo sapiens
  misc_feature (208)..(208): n is a, c, g, or t
  misc_feature (232)..(232): n is a, c, g, or t
  misc_feature (264)..(264): n is a, c, g, or t
  misc_feature (298)..(298): n is a, c, g, or t
  misc_feature (326)..(326): n is a, c, g, or t
  misc_feature (375)..(375): n is a, c, g, or t
  misc_feature (396)..(396): n is a, c, g, or t
  misc_feature (406)..(406): n is a, c, g, or t
  misc_feature (428)..(428): n is a, c, g, or t
  misc_feature (432)..(432): n is a, c, g, or t
  misc_feature (547)..(547): n is a, c, g, or t
  misc_feature (591)..(591): n is a, c, g, or t
gaacggcagggaatcctggcctgcaccttagtgatctgaggcgtggtgtttctgctggatccggtttcatcgtgttgcgccgcccatcctgaatagttgtgatgttgttgcctggctgtgctgcaggttagcccacactaagcggtcccgggctgttgtgtgggcttgggcgtgtgaaaaaagggagcagatttacggtgcggttganaagtacggcgaccaaacggtaaanagggaggaacttgaagtctaaacaagcctgcntctcctggttttctcaagtggcgtttcatctaantagcggtctggcccagaccctgcttatnttcacgagatcagaggagaccggacgccttcggggtggtatggccttanacgccggtagtgcagcctgtntgccccaaangcgcggctcagccacgcccgtncgantccatgcgccacctctaatccagtgccatggggatcttatcgggacccgggagccgctcgccggaggtctggctgggttgctctccgtgtctacgcccaagcaccgttgcccgcngccttgcgccttctgttggcctcttagagccttccgtgattgcntgcgcctaggccactcgctggacctccgcggcgccaccctgtttcctcgcgggagtgccagaagccttttcccctgcccaagctctgggatctccgggcagcctccattccgccgactctccaggccttccccggctccggagctccagagcttccatgactttgggccgctccggacttggtgtgctctgaggtgtcaacgcccagggcccacagtcctggg

SEQ ID NO: 491681 - DNA, 187 bp, Homo sapiens
gagcttgcttcttggctgaatggactgctggggtctggcatagaaccgcagatggcgtacattcggtactgttcctattgcacgagtgctgggttacctagagccctgtggcgcttgcgcctaagagaacgggacactgggctatggagcctgacattgctgaccattcttactcattcctagctct

SEQ ID NO: 491682 - DNA, 170 bp, Homo sapiens
tcagtgacttgaccgtcaagagtttgtgacatgcgagactgtgtgcatgtacgagtgtggttattctggcgtgtgcagcaacaagttcgtccaccctgatctgcaagaacttcgtccactgcgatctgccgaatatccagactgagcagtatggtggctcggcgtgtgca

SEQ ID NO: 491683 - DNA, 126 bp, Homo sapiens
gtaggaagacatgatgtcaaagacttaaccaagatattgagaaacttaagactgcaaatcaaacactttgaatcgttggaagcagagcttaagaaaatgaagtccaaaaataacgaccgttcagga

SEQ ID NO: 491684 - DNA, 812 bp, Homo sapiens
ctgtcctatgtgcagatcttaatatattcgaaggccctgggaattgtgctgaattcgccagtggtactgataacgtagcattcgactatggaagaggctcaccaagaacccaaggctgttaccgaagatcagccctcggggacctcgaccggggagaactcccttgggctcgagccagttcgaacttcggggatctcaccatcttcgctcaggatggggagctcactccgtaggaatcaggagaaatcaacatggcagtagacaaaagaatggtatagtcattgccagtttcggcacgtcctcagtgccctcacactctgctactagtgagtcatcagagccactagctagcttgaatgcttaatgaggtacgaatggttctcgaaggaagaaaaaaccgtgctttctgactgcattattgccttgaaggatcaccaagaacctattgtttgtgcatcatttaccaagtcatgccacgagcaagcattgtattgttaggtacattgttagttttgttcataagaagttgctaattgccaataggctttgtagttaagaagataattagacataagtaaaactagggagaaatcaacaagaagaacagatataaacgagaaagagggggggtcacggttgtatgagagtgacacccctcagatggggtgccccaagaaatttaacgctgataccgcaagatgatcggcgacaccacagtggtacccctaaatgagtgaggtacggcaatagaaagaccacggggcctgtgggcgccggacgttataccgaccagcgcgggcaactgggaaaaa

SEQ ID NO: 491685 - DNA, 156 bp, Homo sapiens
gtgggttcaccgtggctagtagggttcaccgtggcttgtagggtagaccgtcgcgctagtagggttcaccgtaggatagtagggttcaccgtgcgctagtgggttgaccgtggtctagtcataagtcttctaccacccaagtagaggtagtctcca

SEQ ID NO: 491686 - DNA, 229 bp, Homo sapiens
tctagaggatcccgtgatgttatccccaacaccgtgggtaagcaaggtttgacgctccctcctttgtgggctggttacttggctagggatagatagattactaggtctgtggaccccttggacacaggcatgcgtgagctaggctgcctgaggcaggggcagggcccaccctatgtcaccggtccagtgcctatttgggaactagtcctatccctacaaagaggccctt

SEQ ID NO: 491687 - DNA, 166 bp, Homo sapiens
gattggagagacgtgggactgtaggaagaaaatggccagatgatgagctgcacatgtcttgggaacggcacaggagacttcaagtgtgaccctcatgaggcaacgtgtcatgatgatgggaagacataccacgtaggagaacagtggacgaaggactatctcggtg

SEQ ID NO: 491688 - DNA, 166 bp, Homo sapiens
gtagtacctagtactgtcgcagagaagagggtgttacaagacaacccacagcctccagtctatcgaatgggtcagccaggctactggtacatgctaagctggagaacacatggacaggacgaccttgcctgcttcatggtgtagagtgtatgtcaaccagggtgga

SEQ ID NO: 491689 - DNA, 197 bp, Homo sapiens
tgggttgtctgtagattatagaccctattgctgcttgaggaactcatcttaggattggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaa

SEQ ID NO: 491690 - DNA, 172 bp, Homo sapiens
ggtgtatctgaggatccccgaacatgtcgaggctaggtacgtggttgtcgatgtcacccttgacatggtgactcctgcccaaacagcacttgtatggagaggaggatggacagatgtggccgaggacccatggcccagtccccctgcaaaaagggacactctagactattgc

SEQ ID NO: 491691 - DNA, 102 bp, Homo sapiens
gtgggttcaccgtggcttgtgggttgaccgtggcttgtgggttgaccggcttccgccgcttccgcaggcaccagtagaaggccgtcaccaagcaacagatcc

SEQ ID NO: 491692 - DNA, 154 bp, Homo sapiens
aggatcctgctgcacattattggttatcttttcagcagcaccccacttactggtacccatttaccatattagtcctttttcatgctgctgataaagacatacccatgactgggccaatttacaaacaccaagaaggtttaactgggactttata

SEQ ID NO: 491693 - DNA, 361 bp, Homo sapiens
tggaagtcgaggctgcgctgagctgtgattataccactgtactccagcctgggtgacagagcgagaccctgtctcaaaaaaaaaaaaaaaaaaatttaggatttggttacaatggcacttccctgtggtctcagttactttacagggccaagggggagttttggcttgagaccaagagttggagatcagcctgggcagcatagtgaggctatctcaaaaaaaaacaaaaaaatgggaatactactttaaagtaccctgtagattttttctttcatttaaaatgtttgatgtgcctaagtatggatttttctcagtatgttagaaatctagaggcagaatagtggagtagttaagagagggt

SEQ ID NO: 491694 - DNA, 1457 bp, Homo sapiens
  misc_feature (607)..(607): n is a, c, g, or t
cccgcgtcgtcaaaatcgcggcaagcgtccctaacacattaccctccaatatggttaatactacctatacgaagacccccgccggcccccctcgcgccgaaactaccgcgacggaaatcctccttccccttctgattatgattataattctctttacgattatcattatcattatagttctgttaaggctcggacttctattaaccactactattagacgcagtaatacctatcctcaaaagcgaagtcgacttaggcgggggagacaaacgacctactactatgagcctaccaccccctctagtaattaaaaagatccgtactaatctggaacaataagcgcgcttcccggtttaacaccatcggcgaaggaccataaccttaggacgaaatgcggagagtgcccccctaactactctacaactgtctatccccctattatacaacactacttcaaaggcgacctcaaatacggtagaatcacaactattaatatccccgcaacttaagaattggaaacacacgcgcactacccccgagcgaaaccccctccacaggcctcaagatataacatccacagtatacaccagacaaaccagtaaacacncaccaagaaaaaaacggaatacataaacccgaataacccgtaactgtgcaaagtaataacaaaggaacacaagcccggaaaaagccgccgagactgcacacaccctacgcaacacgcaataccaaacacccagcgcttaaaagaacaagatccccgaaagtacatcacgacggaccaaccatgagaaaggattgaaaaaacaaaaatccataagactaggaatccctgcacgcatccataaaatttgatatccctactcccgtaaacagattgcctcatttcctaaccacaacactgaagtcaaagaacaaaacacgtgatactctcgccgcagataagagggtctaaacccaccgtggtcgcttagcgccggtcctctcgccattctactgccactgttccagccccgccatgtacttaatatggttagagaaccctctcgacctactaataagtgggagacccctttccgactcatccccgcacgcattggacgccctagaaagccgaccttgccctcttttgctggttacgcttgatcgacccccatttgttactactgacctactaacaaatgcaagacctcctgctgactcactgagacctagccttgctcccgaccccgcgcccatcgctcattactagactcatccgccactgaacctcgacgtgctgactcatccccgtacgcattagaaaccatagaaatccgaccttgccctatttcactgctcccgcccggtcgacccctacctcttactactgacctactggcaaatgcaagtattcctgctgactccctgcacccagccctgcttccgggcggggccttcgcacatccctagactca

SEQ ID NO: 491695 - DNA, 946 bp, Homo sapiens
  misc_feature (946)..(946): n is a, c, g, or t
gcgaaggcgccgccaggaagagcccaagaggagatcggcgcggttgtcagctaaaccgtcctgcaagaagttggaagcgcaagccggagaaagaggcagcagcgacaaggaatgaaatcgttcgagcacaataagaagttgcacaaaccaacacaggggcacaacaggggggagcaccaaatgcggaatacaccaggcccgcaaagggtggcttaaccaaaggaaaactacaagaaggacttaacccgtgccggccaacaaccggggggaaccaccgcaaacgcacctctgcagggcagcagaggctccccaggcccttctgtgccatggcacacggcaacggggaggcaggcacaaagaacacgccccacaggtccgtcggacttcctaaaactcacaccccgaattaattacccaaacgggctacttctactcccaaggctgggcgtcccccgttggctccagtcacccctttttcatgtgattaccccaactctcccaacgcaagcgcgaccaccccactcccccccaacttacccaaacccctaaacttcccccgcggacacaccacctgggccaccacgcttcccaccacaccacacgccctaccggccccctcacccataacggaaacaccaccccagctcccccccccaccacacgcaaaaccacggggccacgccgccgccacaactccgccccccaacaccctgtccaactcccccgcacactcgatcacaccccacaacaccgctcggtctccacaccactcggccacctcccaagcaacgcgccctactcaccaccgccacagccggcttgggcaccaccacagtcccaaccttcgcctgaggccctgggggccttcgcgcgccccacacaacatcaccgcccgagcgggcgcgctccaccaacaccccccacgccagcccaccacttcccgcgn

SEQ ID NO: 491696 - DNA, 763 bp, Homo sapiens
gcgcgtggtggccatggcggcagcggggctgtggaaccagtgcccccggtgggctggtgtcgcccctgtcgtccgcgcggcccagcgctggcctgatcatctgttccggcccatcagcgccgaggacgaggagcaggagcccaccgagatcgagtcgctatgcatgaactgttactgcatatggcatgacgcgcctccgtggtcagcaagattcccttcttcagagaaatagtagtgagctccttttcctgcgagcactgtggctggaacgagacacggagcatccagtcggtcaatgcaggactccaggaccagggagtagcagctacactttagtctgtcagggtctcgtggacgacctctgaacatgagaaggtggtgcaagatctgacctctgctgtcacaaaggatttcctgcagcatatcatactcgaagattcctgtcgtttagccagacacatggagctctgagcgactgtcgacaggattgatcacccgtgctatctctgggctggacccagggacacagactgcacgaacgggcaaagcaaagatgctacagtctgaccatgaactagcatgacgtccattggtcaagacgtggagggcaggctaaaggcaaggttcgcctcaccctttttcactctgacagtcattgggtgattccctcagggaaccaggtatagtgaaaacccacatgctccttcagacacgctgatgccctggtgatcacacattacaaccggacccgaaggcaggaaga

SEQ ID NO: 491697 - DNA, 124 bp, Homo sapiens
tagcagacatccactgactccccagctgattacatccaacttgaactgaatccgatcttctcttgtgaactatcacggggtccgccagaatcacctcatgcaagtattggggtcagtatagata

SEQ ID NO: 491698 - DNA, 318 bp, Homo sapiens
  misc_feature (178)..(178): n is a, c, g, or t
tgtctactcccccgagatctccaggccgttcggccattcccgcatttctcgagaggtgcgctatctcaccgatgccgcggtgcgaacccttgtcagggcggagacctcggcggagttctttgcttccccgcagcgctacgtgctgggtgcctctgccgatcagatggaggcgatgcangacaggtggcgtgctgtcactggccgtgtcctcgccttgtctcccaacgacgagggcgagaatccggtggttggtcagttcacgcagatgtcgatggagccgcatctgagcatgtatcggcagctggcccagaatttttg

SEQ ID NO: 491699 - DNA, 128 bp, Homo sapiens
caaagaatagcaacttggcgcatgtattggagaaggcactttggagatgtacatcaaggcatttcatatgcagtcccagcagcaatcccagcttatggcggtatcgcattagacacatgtacaaaact

SEQ ID NO: 491700 - DNA, 228 bp, Homo sapiens
tatccaaggcagctactccaagatatactgttacttgactagaaagaccacagaacaggctgggcgccctgactcattccttttatcccagcactttgggaggccaaggttggtggatcacttgaggtcaggagttcgagagcagcctgactaacatggtgaaaccccatctctgctaaaaatacagaattcgctgggcgtggtggcacatgcctgtaatcccagcta

SEQ ID NO: 491701 - DNA, 110 bp, Homo sapiens
gcatcatgcacgaaatagcacaaaactataaggtgacaaatactgaaggggaacttcgctcagtgatggtacccacattagcgagcatcattttcccttcagattatcct

SEQ ID NO: 491702 - DNA, 799 bp, Homo sapiens
cccagacaacatctgggcgcgataaacgggtccctgtgcctcttggggacaagagccgtccaggtgcaatccctaggtgtacaccagaaatcctgggatcttcaccaatccaacccagtgggtttaagaagtcccgcctttcgattccaaaaaaaagctacccgcccggaggagtcaaaaagcaatttaaacacctggttttattgattgcaagcaaaaagcggtgggggaaggttccaaaaggaagccgccactcagaattttagctgctttaacgtaaaatgcgtgaacggcgattaaagcagtgcaagccgctataggccaccccaacctatacacattgggcccccgtttagaaccatgagtgccgttccaaacaaacatggattgcacacaagccacagctagtgaagtggtcatgccgagctgaaactttagccacacagaagggattcacaggtggagctcaacccagattgcgaacgctttaatctaagggtcccagcgcctcctgtaatagtgcaccgcgatctctgatgataacattatgggctacagcgtcttgatctttagctcccgtctggtgcctggtcggggttagtggtatcaacgtgtctgttcgaatacggctctggtcagatatggtaacaacgctccttttgggtgccctcagtgtatcttgcagaacacttgggccatgggatgcaaccaccttgctaaaatgctcaacgttcacaggattacgtgatggcttgcacccaatcagtacaggtgaggtctctttgaatatgtattcatc

SEQ ID NO: 491703 - DNA, 164 bp, Homo sapiens
cccccccttttttttgggggggtttttaaaaaaaaaaccgcctttggtgggttttttccgggggggggggagggatgtttctttggcccccaaagggggggtggtgcccctttgggttaaagggggtggtttggttccccggccccataaaggctttaattgta

SEQ ID NO: 491704 - DNA, 154 bp, Homo sapiens
atcgctcgttaggtctagaggatcccaaagcatgtatgtaggttataacaggttcataactataaatgacaaagaactccagcataaagcaatcacagtaacaagcatacatcacccaagaagtgagatgaaagccaatcacaggcgcatttgc

SEQ ID NO: 491705 - DNA, 167 bp, Homo sapiens
ctatgacaggactgatgagactgatgcagaggagtgtgatcctgaggagtcttattccacaggagtaaccactgtgagtagtttttcatgttttggttagacctaattctatagattgcaaatttaatagtgtgtatgtccatataaacaaacacatttccagtcca

SEQ ID NO: 491706 - DNA, 323 bp, Homo sapiens
aaaaactcccaaacaacctttttaaaaaatagacaaaggactcgctgggcgtggtggttcatgcctgtaatcccagcactttgagaggccaaggcaggtggatcacgaggtcaggagtccaagaccagcctgaccaataatggtgaaaccccgtctatactaaaaatacaaaaattagccaggcgtggtggtgtgtgcctgtattcccagctgctcgggaggctgagacacaagaattgcttgaacctggaaggcagaggttgtggtgagtcgagatctgccactgcactccagtctgggcaacagagaaagaccccatctct

SEQ ID NO: 491707 - DNA, 798 bp, Homo sapiens
cgccaggtgctcctacgaaagagcatgttaatgtagtattcattgggcacgtagatgctggcaagttcaaccagtggaggacaaataatgtattcgagtggaatggttgacaacacggacgcttgaaaagtatgaaagagaagctaaagagtaaaaacaggataaagcttggctacttgtgcttgggccttagacatcagaattcagggaagaacgagacaacggtaagacagtacaagtgggtcgttgcctatttggaaaccgaagagaagcattcacgaattctagatgtcccctggccacagagagtgtgttcccaaatatgattggtggtgcctctcaagctgatttggctgttgctggtaatctcaggccaggacaagtgatgagtgtggaaactggatttgattacaggaggaccgacaagtagaacatgtcacatgttggcaaagtacagccggtgtaaaacacctaattgtgctagttaataacgatggatgatcccaaacagtaaatcggagcaatgagagatctgaacgaatgtacggagaaactagtgccatttttgacaaaaaagttggctttcaatcccaagaaaaggacgattcactattatgcccgtgctcaggactttacgtggagcaaatctcaaagagcagtcggaatttctgtccttggtacatggattaccgttattccatatctggattatttgccgaacttcaataagatcaggttgattggaccaatcaggctgccaattgtggatagtacccgactctgggacacgtggtccgg

SEQ ID NO: 491708 - DNA, 181 bp, Homo sapiens
attcggcacagagcaagaccccatctctaaaaaattaggcatggtggtgcatgcctgtattcccagctactcaggaggttgaggtgggaggatcacttgagcccagaagttcaaggctgcaatgagtcatgattacaccacggcactacaaccttggtggcacagtgagaacctgactctt

SEQ ID NO: 491709 - DNA, 343 bp, Homo sapiens
gaataaaagattctgcatcagatagccattcaacctacgatcttccctctgacagataaaaggttagttattcaacttgaggcaccaggaaaaggcaaagcccaagtgcaaggaactccaaaaaatgatacaagaagtgaagggagaaatattcaaggaaatagatagcttaaataaaaaacagtgaaaacttcaggaaacattggacacacttatagaaatgcaaaatgctcgggaaagtctcagctatagaattgaacaagcagaagaaagaaattcaaagctctcagacaaggtttttgaattaacccaatccaacaaagacaaagacaaaagaataaga

SEQ ID NO: 491710 - DNA, 247 bp, Homo sapiens
gcctagaggatcgttatacacccagtcatgtagctatgtaggtataaaaaaataaagtagtatctaaacaagtgatttaaaaaaaaaaacactaacgaatgccacgatgataacattgaactagttccctctagaaggccattggaaatgttaccggaggttcattttccccagccactgaattcattcttcctccagtgtagacggggattgacgacaggtaaacgttcttcacttcaaggggtca

SEQ ID NO: 491711 - DNA, 111 bp, Homo sapiens
cctaacacacgctttgccgcgaaggctacatcgcctgcgtcacccgtcgcagcgcgacaaactgcagcccctggtagacagcattcagttggcgggcggtgaagcccatgg

SEQ ID NO: 491712 - DNA, 161 bp, Homo sapiens
gtatgtgcttgatcgtaaagatgcttttttcactgtacgctgcacccctcgtccccgcctctctttgctttcacttagactgaccctgacacccatcaggctcagcaaattacctgggctgtcctgccgcaaggcttcacagacagcccccattacctcag

SEQ ID NO: 491713 - DNA, 801 bp, Homo sapiens
  misc_feature (129)..(129): n is a, c, g, or t
  misc_feature (183)..(183): n is a, c, g, or t
  misc_feature (257)..(257): n is a, c, g, or t
  misc_feature (260)..(260): n is a, c, g, or t
  misc_feature (278)..(279): n is a, c, g, or t
  misc_feature (333)..(333): n is a, c, g, or t
  misc_feature (346)..(346): n is a, c, g, or t
  misc_feature (350)..(350): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (383)..(384): n is a, c, g, or t
  misc_feature (395)..(396): n is a, c, g, or t
  misc_feature (406)..(406): n is a, c, g, or t
  misc_feature (408)..(408): n is a, c, g, or t
  misc_feature (412)..(413): n is a, c, g, or t
  misc_feature (419)..(419): n is a, c, g, or t
  misc_feature (434)..(435): n is a, c, g, or t
  misc_feature (438)..(439): n is a, c, g, or t
  misc_feature (450)..(451): n is a, c, g, or t
  misc_feature (465)..(466): n is a, c, g, or t
  misc_feature (470)..(470): n is a, c, g, or t
  misc_feature (477)..(477): n is a, c, g, or t
  misc_feature (480)..(480): n is a, c, g, or t
  misc_feature (484)..(484): n is a, c, g, or t
  misc_feature (489)..(489): n is a, c, g, or t
  misc_feature (499)..(499): n is a, c, g, or t
  misc_feature (527)..(527): n is a, c, g, or t
  misc_feature (530)..(530): n is a, c, g, or t
  misc_feature (547)..(547): n is a, c, g, or t
  misc_feature (554)..(554): n is a, c, g, or t
  misc_feature (560)..(560): n is a, c, g, or t
gatgctgcttcggcgaccgggcggcggcagcggggcggggctgtggcagagtctgtgcctgtggcggtgacggcgggggagcaagcgctgcctcgcagagcagccttggggtcgccggccgctcgcagngttgtggaggggcgggccggacgctgagcggacagctgcgccacgggtggcatngtgtgtcccagagtgccggagcgagtcccagaagagaggcgaggtaagcccagagcgctgggttgcttcagcanggnaagactcccttccccctnnttcaggctgctgagcactgagcagcgctcagaatggaagccatcgccaaatatnacttcaaagctantgangacgagngcntgagcntcaaaaaggggggacannctaaaggtttnnaacgaagaantntgannagaacntggacaaggcagagnntanntgaaaagaggnntcaatcccaagaannacanagaaatnaancaantcgtngtttttttgnaaaaaccccagagcaaggagaagaaatnttngcaaacagcggcacganggggccnttcttntcgagagagtgagagcgctcctggggacttctccctctctgtcaagtttggaaacgatgtgcagcacttcaaggtgctcccgagatggaggccgggaagtacttcctcttgggttggtgacgtccatccttgatgccgcggggggttatcacagatctacctctgttccaggaaccagaggtttctgggcacccacaccggccagggcgaatagccagcccttgtttgtccaggggtgggg

SEQ ID NO: 491714 - DNA, 585 bp, Homo sapiens
  misc_feature (5)..(5): n is a, c, g, or t
  misc_feature (79)..(80): n is a, c, g, or t
  misc_feature (88)..(88): n is a, c, g, or t
  misc_feature (125)..(125): n is a, c, g, or t
  misc_feature (127)..(127): n is a, c, g, or t
  misc_feature (154)..(155): n is a, c, g, or t
  misc_feature (162)..(162): n is a, c, g, or t
  misc_feature (172)..(172): n is a, c, g, or t
  misc_feature (177)..(177): n is a, c, g, or t
  misc_feature (211)..(212): n is a, c, g, or t
  misc_feature (215)..(215): n is a, c, g, or t
  misc_feature (220)..(221): n is a, c, g, or t
  misc_feature (236)..(236): n is a, c, g, or t
  misc_feature (247)..(247): n is a, c, g, or t
  misc_feature (262)..(262): n is a, c, g, or t
  misc_feature (266)..(266): n is a, c, g, or t
  misc_feature (273)..(273): n is a, c, g, or t
  misc_feature (279)..(279): n is a, c, g, or t
  misc_feature (290)..(290): n is a, c, g, or t
  misc_feature (297)..(297): n is a, c, g, or t
  misc_feature (299)..(299): n is a, c, g, or t
  misc_feature (301)..(301): n is a, c, g, or t
  misc_feature (345)..(346): n is a, c, g, or t
  misc_feature (348)..(348): n is a, c, g, or t
  misc_feature (350)..(350): n is a, c, g, or t
  misc_feature (361)..(363): n is a, c, g, or t
  misc_feature (368)..(368): n is a, c, g, or t
  misc_feature (370)..(370): n is a, c, g, or t
  misc_feature (378)..(378): n is a, c, g, or t
  misc_feature (382)..(383): n is a, c, g, or t
  misc_feature (387)..(387): n is a, c, g, or t
  misc_feature (396)..(396): n is a, c, g, or t
  misc_feature (407)..(407): n is a, c, g, or t
  misc_feature (420)..(420): n is a, c, g, or t
  misc_feature (447)..(447): n is a, c, g, or t
  misc_feature (451)..(451): n is a, c, g, or t
  misc_feature (456)..(456): n is a, c, g, or t
  misc_feature (582)..(582): n is a, c, g, or t
ggggnggagtgagggggaggaggtaggggggggggggaggtgaagaaagaaaagaattgaagagggatggaggcttttnnatacgacnttcaacgttttcctgtttcagtgggagagtaaagtangnaagaatgagcagccacggattgttganntgttacnagcaccatgnttttnaggaatgtttcagcggagttggaaacattttttnnagnaaaannattataacgaagtcnctccccaaacnacctttaaccatctnaagntaacacncaattncttgcaaacantggtatnananacagtttaaacaattagaaaaatgaaaactgataccacttatgnntntntagtgtgtttnnnctctntntttgttgnttgnntttnctgtgggtnttttggctttntattgttatttcnttttgctattggtggtcttgggagatntggntcggngacgacacggttttgctgaaaaagcctctatgttgtcgtgttagtgtgttagagaacctaaaagctgggaccagtaaaatccacagaaattcactcttgcctttaagaacttttgaaaactgtttngga

SEQ ID NO: 491715 - DNA, 262 bp, Homo sapiens
gtctgtagaggaggctgggcagttgggaccacacgtgttcggcacgtgcacctgcaggtctccatgcacagctgtgcgtttggtgggcgcagagtgccctgtcttcacttagggcagggagggacacggccagtattacggctagagcacgaggcggaaggaggggcaaggaaacagcttctagactccaggagatgtagaggccgcactgtccctgtctgagaagcacagattctatgcaggtggacagcaagggttgaac

SEQ ID NO: 491716 - DNA, 294 bp, Homo sapiens
acctgcttactgggcgtatgaggtttaaaaaaaaaaaataaagatttcccttttttaggtttttggtttttggagacacagtctcactctgtcacctaggctgaagtgcagtggcgcaatcatggctcactgcagccttgacctcccaggcacaagcaatcctcccgccttagactcctgagtaaccaggactacaggtgcacaccaccatgcccagctaattttggtattttgggtaaagacggggttggccatgttgcccaggctggtcttgaactcctgtgctcaatgagc

SEQ ID NO: 491717 - DNA, 168 bp, Homo sapiens
cttgccacgggctgaggtggccagcgggggcccagagccaaaacacttgggaggggtggagaggaagcagcgagcacactggagaggaagtgattcaaaagccacgctatgcctgcgatgtgtccggacatacggaagacatctgcccaatctgcctttctccgtggc

SEQ ID NO: 491718 - DNA, 1426 bp, Homo sapiens
agcggggtggttaacggccatgaaacaaaagaaacactgagaggggagccgctgccacctccaccagcacatccccctttcgacaagcaaaaaaagcacaacataaacagaaacagacgccacaatcacgcagaacagcacaaagcacaagaaaaaaggaacagataaaaacaaacaaatatcaagagcaaaaaaaaaacgaaaaaaaaaaaagacaaacagaaaaccacaaaaacaaagcaaaaaaaaaaataacaaaaaaaaagcacaggacccacaaaagagagaaaagaacaaattacaacgagacaccacaacaacaaaaacaacaaaggccagacaaaaagaaacaacacacacaacacacacaaagacaaacggagagaaaaaccaacgtgccaccaatgaacacacgaagagtcagccagaacgagaacacataaaccacacaaacaacacacatagccacgcacagaactccaatgcacaaacgagccaccaacacaagaagagaacacaaaaaatacacatacaaaacacaaaaaactataaacaatacaaataacaacaacaaaaataacaacaacaaccacaacaaaaacaacacaacacacaacacataatacacacaccaagaacaaaacaaaataaaaaacaacaaccacgaccaaacaagcacaacaaacaatcaaaacacaacaagccaacaacaaaaacacaacacatcaataaaacaaaaacaatatataacaaaacactaaacacatcatataaaataaactcagccacacataataactacacaaactctataatcacaacatataacaacacaaaataacaaatcataatacctacaatacaaacaaacgaacaacaataaaatctacacaaacatatataagacgacacatacaaacgaaagcagcaaataaaacaaacagtgcacaacacagaacacacgacatgaaaaaaaagcaacaatagcaacacaacaacaaggacgtaacaagacataatcgagaaaacagaaagcagaggcaagacaggagaaaaggagagcaaaaagagcagacagacagagacgagaagcagtacaagagccgtacaacaagacacaaaaggagcacgaagctagaagaccagacgcagcaacatggcaaagcgactagaaagaaactgaaataaagagagaaagagcacccgacgctcacaatcaaatgaacagatacaagtgcactccacacacaactgacaaatcaagaagaacatgcataaaaagagaagaaagcgatatcaaagcaagcataagcaagcgaatacatagcgcagtgacgacaatggcacaaagataagaagcaaagatcgaagcaacgaacagcgatagctgcatttgcagtaatgatgagtgatatgatcaaccaca

SEQ ID NO: 491719 - DNA, 118 bp, Homo sapiens
tgagtagattcatgcccttaggcctgatagaaaaggtgactcagaaaagctgatagcgacagagtacagcaggagagggtgcattgtgaaatcagagagaagtagtgtcacctatttg

SEQ ID NO: 491720 - DNA, 124 bp, Homo sapiens
cggcgattacgctctcatgaagactcgggacttttggtatggtggttcggcgatgtgcatgcacacgctgagcgtccatactgctcacgccgaggcatccagagcaaaatcgccgatcttcacg

SEQ ID NO: 491721 - DNA, 349 bp, Homo sapiens
  misc_feature (56)..(56): n is a, c, g, or t
ccatttgatgatgatggacctgaaaagttcctgtaatcttgtgattttaaaatgtnatagagcagtgcgttaccttttctatgttaggtatgttggattttttgtttgtttgtttgttgttttttttgaggagtctcactctgttgcccaggctggagtgcagtggcgtgatcttggctcactgcaacctctgcctcccaggttcaaacgattctcctgcttcagcctcccgagaagctgggattacacatacgtgccaccacacctgactaaattttgtatctttagtagagacggggttttaccgtgttggccgggctggtcttgaactcctgatctcaggtgatcc

SEQ ID NO: 491722 - DNA, 767 bp, Homo sapiens
cttttgatatagaggctcatttccacctcagcatacaagatcgtagtctttgggcatgtgtgccatttagaatactaaagcaagtccaagcacatttttctcttctcacgtactaataagtgtaagggacttggcctctttatacttaccatgtccccaaaagtgtcagtgtagacatgtcacaaatggctctgtagagagccatgggaagagagaggagggtgatgtggaacatttaaagggttcagaaattccagaagaggagtgggttttggatagaagcatttgaggacagttgctcaaaagccttatgtgtatgatgaacacttaaccacggggaagagactcttcagtagccgtgtatctgtctggtgattttcaattttaagtgaaccttttgatctatcttaaactctctttatggtgagtctaaatcccaattctgcagaaagatcagtaaatcacagtatttttcctgtggaaaatctattcaataacggaaatcaagacaggctcaataacattttaaccaacaaaaacacttttgaattcccttgcataaggtctaccagttgtttccagcgcatacctcagtatgacttttgctagcggggaccaaaattagaaccttcgattctctaagccaaatgactttgtgctaatcacaaattttatagtacttattacagttactgacgcagaaatgcagagaagagatctaataattgcaagaaatacttaaatccacgatctataccctttgaatg

SEQ ID NO: 491723 - DNA, 186 bp, Homo sapiens
gacaaccttagccaaacgatttacccaaataagtataggcgatagagattgaaacctggcgcattagatatagtaccgcaggcaaaagatgaaaattgataaccaggcatatatagcagggactacccctataccttctgcataatgagttaactagaatactttggcaggggagccaaagctaag

SEQ ID NO: 491724 - DNA, 238 bp, Homo sapiens
  misc_feature (102)..(102): n is a, c, g, or t
  misc_feature (136)..(136): n is a, c, g, or t
  misc_feature (143)..(143): n is a, c, g, or t
  misc_feature (146)..(146): n is a, c, g, or t
gccatcccagcacatgtcccaaaataatggatctgacttcctgtctcgttccagttctctccagcatagggccactgaccagtgtccactctcaatcctgcnacccccccccccttgaattcccctgaccccggcngccttgnggngacccgaccgagagccctgccctgctggccccaactgcactccggcttccgaagcccggcctgtcctcccctattcactggtcccctgctgc

SEQ ID NO: 491725 - DNA, 1108 bp, Homo sapiens
gatcccgccgccactccgcgatcagaccgctctgtgcctgcgagcctgctgtgagcactcggattcgaggcctgtgcgccaacgagtcctgtggggcatctgcccgcaggtggcaagctcatggcctggctgagctgggactgccgcctccgcctcagccaccgcctgcgcctgccgcctcctcctcctcagcctggcggtggcccgggcccagacaaccatgtgtctgaagactactgggacgggcgcctgctggccgaaccaggagggacgacaggaggtcgccgcggcctcaatccctgggccgccgcaccagggcgcccgaagatgctgggccccgggagttctggagggttggcctcgttgcgtgccacccccggacggattcgacacaggggaagtcggaattgagcgaacagattcaaaacggcacagccgttggtccacaagtgacgacttcccggagtgtgtgagccagaagtgcatctagaacaaaaggaacaaagtgtgatgacccccatgcacgctaggaataagcgaccttggacttgaagcactcaggcggtcgcgatggaccatgcggaggcgaacaggatgcaacccctgtggaggataatgtagcccccgcaaaagcaactagtttgcattggctgccgatgtgcggtgagaactatcttcgcgttcccgtatgaaacgaggggagagccaacgcttcaggcgcttcgtggacacgcagcggcaatatgcgatgaccagatgcgacaccatagtgaaagaattgggggagactacgaaatggacgcgaagaagggtgagccgcgaggggcgcgaccaacgcaagaacgggatcctcaccgacacatgacagcgctgccaagagccccccaaggggtatagagagcacagtaccaagcagcgagggacgcacataatcaacaacaaccaaggagggcaaaacccgaggaacggacacgagagggaaaatacaaggggagcaaaaggtgtggaacccaacgcaagaaaagcaccaagcagcaggggaagagaggccgcctaagaaggagggcgacacccccaggaagaggacagagacgaacaccagaacaac

SEQ ID NO: 491726 - DNA, 899 bp, Homo sapiens
atgtgaaaccagagatgcccgccaacctggaatagagaggaagagagcaagcagattgaaccctactgcttccaagctggcccatcatgatgaaaacttaggacacaaaacaaaaaaaaacaaggaaacaaacaaacacacaccaacactgtgtgcgtgcgcccgcccccggcccccccccgaaaaaaagcccttcccaaaagaccccacccccgcgttctgggcgccgccgcggacccccccacagacgggcacagacgcccacacaccgggcccacaaacgcgcgtggccccaccaacaaagacacaaacacccgcgggctcccaatgaacccacaacggcgcgctgtgagatcactctcttcaccccaacaagtataaaaaaaaccccgccaccggggggcgcaacaccacaccgaaccccctttcttctgcgtgcaaaccaccatctcccccacatgatgcgccccaacccacggacgcgcgcaccaccacactaacagcgggggaccacctccaacttcacacaccaaacgcggactagcagcctccccaacaggcggacgcgaacccccactcacagaataactcacaacaattaagccgccccccgccgacaacgcaggaggcaccacacacacacaaaaacgaaaccacacccacaaccacccactcccaccaccaacaagacacacacagcacacaacacacacacaacacaaacgacaacacaacaccaacgaaaacaaacacacaacacacgtaaccccacgccatcctccatgcacacacccacacctaccaccaacccacaacacacaccacaccacacattcacgtcgtacactcacccccccaccacacgcacacacaccacacccccacccaccacccacaac

SEQ ID NO: 491727 - DNA, 235 bp, Homo sapiens
tgttattgtcgattatgattttgtaaagtacataatcaatataagtttatggaaaacgtaagaaggaaacacgttagacagagagaaatagacatgccacacctagagagacattctatttttttttttttttttggaaagggatttccattttggtggcccaggcgggagtgcaagggcgctttctcggcacaccacaacctcagccttcggggtcaagcgatactccggcctg

SEQ ID NO: 491728 - DNA, 308 bp, Homo sapiens
ggactaaagtacccacctgcagtggtgacttccatcctcaactcctggctcaatactgatggaagataatctgcttaacaatctccagaaggactgtgcacgtcaatgagtcgcttgtgagttctcatctgggaaacgatcccagcgtcttagcaaccttcactacaatggagtttttcttgtagtgattctcaaagtcttgttcggcattcgaactggtcctttcactacaagattcttttctttagcgcctcttatcaagtcagcacacaccttttccaaggattttacgttgcggctgcaggtgg

SEQ ID NO: 491729 - DNA, 124 bp, Homo sapiens
  misc_feature (51)..(51): n is a, c, g, or t
  misc_feature (88)..(88): n is a, c, g, or t
atggtgagcctggcccatggcccagtctttcacatggagcagcagggcgtntctctccagtgggaaggtagctcatgtcagttccggnccattttgcagaccttggcttcttcttggagaaagg

SEQ ID NO: 491730 - DNA, 169 bp, Homo sapiens
atagcgacgctaacatagcaaagtaatgctggatcaagctagcttgcaagcctacactacagctcacagcaacactggatccttaacccaatgagcaaggcaagattgaaccagcaactaatggataccagtcagcttcattaacaactgagccacgacaggcaactcc

SEQ ID NO: 491731 - DNA, 683 bp, Homo sapiens
  misc_feature (469)..(469): n is a, c, g, or t
gcaggaattcggcacgaggggttcggacgctcatggccacggtgtgctgggtgcacgcgccctgcgtgcaagggatgctcccggccgcccccggttccgaggatccatctgggatgcggcgaggagggcagccgagctgtacgcaaacaacgggcctttaggtttcagagggcgaaactgactgcgctggatagagcgcgtgcaagccaagccgcactgctgattggatttttaaatatctccttctgagtgagtagcattcgagatggaaccattctcacaacagctccagctggcagcatgacttaccgccaatttatccaacttgtgtcaaggctctgaaatgccaacaacgtagaggcctgcacttgatgtaagggtggcacctcacctgcgaaggaggatgccaaacaatagatgagctcagcggactactccaaacttgcggtgaaagagatgaagcataggncatactgcactacccttgtgtagcctcaaatggaccaaggccagtggggcacccactaggtactcgggatcttcaatatgttgtagtacaaccacgcctcctactaaccgccatcatcaatgctgaccccgccaataccttttgtgtagcatgcaccttgcaaacataatagccgatctagggatagtttgccttccaggcccggggagcgggg

SEQ ID NO: 491732 - DNA, 384 bp, Homo sapiens
atccccttcaacaaaggagtcatcctcgtatggcaaataaccaagatgtgtctctgatcaactgtgcaaaggaaaatgactcattatacccaagttatctaaacttctgggtgaaaaaaaacccagcattaggacttaggtgtcacttaggaacaaaatcaattgggctcgaaaatcctaccccctaagagatgctcttactgggtggctcaatagttgacatagccttccttttccagaaattcaccatttgacagaagtgggtcctcccaatggttggccaagatgtactttgctggtgtccaaattcaatccccacaacgtttttggttaaaggtaaccacaagccaattgcttcattgtcatacttgtatggtggtatag

SEQ ID NO: 491733 - DNA, 709 bp, Homo sapiens
  misc_feature (14)..(14): n is a, c, g, or t
  misc_feature (33)..(33): n is a, c, g, or t
  misc_feature (228)..(228): n is a, c, g, or t
  misc_feature (236)..(236): n is a, c, g, or t
gtgaccatcttatncactggaggggcagaatgnattcaaggaattcagagaacacagcagcgtcttaacttccccttcctttgttgaaagtcggctcaagcagttctgagaacagaagccctgggggtttgggcctggaacagacgagacacccgcggtcccttctccatgccaccccaaacaggacccaggaccaacactccgcggcggcagcaggagtaatcgcgngcgcgcgnggcggtggcgatatttaaaggggacgcagcctatctgtcaggagtggagcgtgagtcggctcagccaatgcgcatgcgtgaggcgccagcggtttctcccgtcacagtggttcccacggttgtcttagaaaccagtccccgaggcttggcagagcaggagccctccgtggcagtgcttgggtatcgaggctctgaggctccggcctcacctttccacggggtcgaagggaacctctcctgatgacagcaatcgcaacgggccgaccatgatgatgaaaccccaggcggagacgggggaagcagcacgggatcccagcctcaggcctgcaaggacggtgttggttggggtgagtctcaccaaaagtcgtgccgccgtctgtgatctcgaggacgggtcggcctgcgtgcccctgggctgctctctcacccgagggtcgttctcctccagagcagaaccccggatcctcaggggt

SEQ ID NO: 491734 - DNA, 311 bp, Homo sapiens
gtcctagcctcgccagtgtcctagcctcgccagtggtactagcccgacagaactgtggcttgtaagaggaagagagccgggtgtggtggcacatgcctgtcacccagcactttgggaggccgaggcgggggaattgccccgacagaactgtggccttgtaagaggaagagagccgggtgtggtggcacatgcctgtcaccccagcactttgggaggccgaggcgggggaattgccccgacagaactgtggccttgtaagaggaagagagccgggtgtggttggcacatgcctgtcacccagcactggcgag

SEQ ID NO: 491735 - DNA, 378 bp, Homo sapiens
tgggaggacttcacagatagtgtttcggaaaggcccaatcatctcagtgcctgactaagccgggaaggtcccgttgtccaaattgcccaactaaagcacacatgtccactacggcagcccctaggagtcagtagtcaaagaggactgaggctccagcgccgttctttagatcggttagagagtgacccacagggtgcccttctaggtaccggtactccagaaagtttcctacacccttgcctagcagttagcagaggtccgggtagctgagactggctagggtgactaagacctctactacgtgttggtcttttactcctcctggtctcagttggcccgttaggtcattcccagaaccctgtgtcctcccaccacaaa

SEQ ID NO: 491736 - DNA, 362 bp, Homo sapiens
agggtaaaatgcccttttcatcatatcacatcaagggtatgtattattaataagatctatccctgttggccttgtgcagtggctcacacctgtaatttcagccctttgggaggccaaggtggggggatcatttgaggtcaaaagttcgagaccatcctggccaacatggtgaaaccctgcctttattaaaaatacaaaaattagctgggtgtggtggcaggcccctctagttgcaactactcgggaggctgaggcaggaaaatccctttaacccggggtggagggggtggaaatggaggttgtagttaacttagaccatgcccctgccctccagtttgggagataaaatgagactatttcca

SEQ ID NO: 491737 - DNA, 255 bp, Homo sapiens
aatgagggctaacttcgggggtaagcatattattaatgtagtgttctgcagttcgtgagtactcggcaggggtgtaatccgaatttttgtctacgttaagggcctgcagatttggtttggtgaaagcggcgatgtgctggcccccatatgatgcagttacgagactttagaacctcgtttggtgtaaagtacggtagagatcttaattaagggatttagaagctctatccggataaatggatgcttgaagcgaga

SEQ ID NO: 491738 - DNA, 165 bp, Homo sapiens
  misc_feature (24)..(24): n is a, c, g, or t
  misc_feature (33)..(33): n is a, c, g, or t
  misc_feature (69)..(69): n is a, c, g, or t
  misc_feature (157)..(157): n is a, c, g, or t
  misc_feature (160)..(160): n is a, c, g, or t
tcccaaatgaaaaaaggtttgttnatgttctgncctgtaaactgttggtcaacgtaaaaataacaaacnatgagcttgtgtataacattcacctggctgtcaacttcttggtgtcattgctcaagaaaaactggcagaatgtccggaccttataatnatncaaga

SEQ ID NO: 491739 - DNA, 285 bp, Homo sapiens
  misc_feature (15)..(15): n is a, c, g, or t
ccggattggagcctnatgatgttgaagcatttgttattgatgctgtaggaactaaaatggtctactgcaaaattgatcagacccaaagaaaagtagttgtcagtcacagcacacatcggacatttggaaaacagcagtggcaacaactgtatgacactcttaatgcctggaaacagaacttgaacaaagtgaaaaatagccttttgagtctttcagatgcctgaatttttatgaaaatgattttgttcgttgagaaaaaaagttctaagtaaaacattatcaact

SEQ ID NO: 491740 - DNA, 144 bp, Homo sapiens
ctgaggttgatctagaggatccctaactcagtggcgagctgcgctgggcgctcaaaagcgagttcctggtgcgcgagaacctgcaagtactacatgtgatctcaaggagtaaccagcgcggccgcttcctgcgcatcctgccag

SEQ ID NO: 491741 - DNA, 234 bp, Homo sapiens
ggccaacatgggccgcgttcgcaccagaatcgtgaagaaggcggcccggtgtcatcatagaaaagtactacatcgcgcctgggcaagcgacgttccacagcgacacaagcgtcgtgtgctaggagatcgtccagttagtcccccagcagaaagtctccgggacaagaatatcaggttatgtcacgtcatctgattgaacgcgaattcagagagggcccaggtaacgacggtact

SEQ ID NO: 491742 - DNA, 962 bp, Homo sapiens
  misc_feature (11)..(11): n is a, c, g, or t
  misc_feature (185)..(185): n is a, c, g, or t
  misc_feature (216)..(216): n is a, c, g, or t
  misc_feature (287)..(287): n is a, c, g, or t
  misc_feature (312)..(312): n is a, c, g, or t
  misc_feature (323)..(323): n is a, c, g, or t
  misc_feature (331)..(331): n is a, c, g, or t
  misc_feature (337)..(337): n is a, c, g, or t
  misc_feature (365)..(365): n is a, c, g, or t
  misc_feature (399)..(399): n is a, c, g, or t
  misc_feature (418)..(418): n is a, c, g, or t
  misc_feature (439)..(439): n is a, c, g, or t
  misc_feature (442)..(442): n is a, c, g, or t
  misc_feature (464)..(464): n is a, c, g, or t
  misc_feature (468)..(468): n is a, c, g, or t
  misc_feature (494)..(494): n is a, c, g, or t
  misc_feature (524)..(524): n is a, c, g, or t
  misc_feature (529)..(529): n is a, c, g, or t
  misc_feature (559)..(559): n is a, c, g, or t
  misc_feature (567)..(567): n is a, c, g, or t
  misc_feature (569)..(569): n is a, c, g, or t
  misc_feature (576)..(576): n is a, c, g, or t
  misc_feature (585)..(585): n is a, c, g, or t
  misc_feature (592)..(592): n is a, c, g, or t
  misc_feature (621)..(621): n is a, c, g, or t
  misc_feature (636)..(636): n is a, c, g, or t
  misc_feature (655)..(655): n is a, c, g, or t
  misc_feature (699)..(699): n is a, c, g, or t
  misc_feature (710)..(710): n is a, c, g, or t
  misc_feature (731)..(731): n is a, c, g, or t
  misc_feature (739)..(739): n is a, c, g, or t
  misc_feature (789)..(789): n is a, c, g, or t
  misc_feature (799)..(799): n is a, c, g, or t
  misc_feature (803)..(803): n is a, c, g, or t
  misc_feature (812)..(812): n is a, c, g, or t
  misc_feature (814)..(814): n is a, c, g, or t
  misc_feature (825)..(825): n is a, c, g, or t
  misc_feature (837)..(837): n is a, c, g, or t
  misc_feature (842)..(842): n is a, c, g, or t
  misc_feature (850)..(850): n is a, c, g, or t
  misc_feature (858)..(858): n is a, c, g, or t
  misc_feature (863)..(863): n is a, c, g, or t
  misc_feature (878)..(878): n is a, c, g, or t
  misc_feature (927)..(927): n is a, c, g, or t
  misc_feature (932)..(932): n is a, c, g, or t
  misc_feature (939)..(939): n is a, c, g, or t
  misc_feature (948)..(948): n is a, c, g, or t
tttaatttttncccatatgacaaaagctgagtatttcagagaattatacaacttgaaaaaccctgtgtcattaaattgtaactttattgcaagatggtagaattaattacaaatttaaactataacctgttaatctttagtcaggcagcaagtttttataaaggcaaactgcttattcagaagtnatcacggaacaactcaaaggcagagcaaganggatgagaaacatctgactggccgatagagatttcgttctctcactatatgaaacaaacttttcatttttnggaagggtaaactataacttcagtngacaccaacanagaaagantttgtnaaatagactagtttccatttagtcagtnaactgtttctagctgtttcaattgggatagatanatttacataactggctgtnctttagctttctttgccagcngcnttaggtccgcaatgcacttggnaatngtttccttttcctgctgtttggagangctttgcaccacgtcttttccacccaattnatcangtctccttgtccctttcgacgcatcaggtnctgcacananatatganagtccaggngattctntacttccttatatactctatacagttgtncccggtaagtcactnccaaagccatagcaatgtnattcctttgcacatcaaaaaggtaatggcgcttctgaaccagtncctgttgtganttctccgtatcaattgcattntggatgtnttggatggaagcctgcctcgcctcttctagttgggcaagtttttgctcantgagtttatnagcnaagtttgcnanaaagggaccanattttttaattncatanaccattanacctagtnctganagggcagtgaaggtntctgcgctaatcacatatatttctttggataaagcgtacaagacaagcncagtnccgagtncatagggtnctgttacacagttt

SEQ ID NO: 491743 - DNA, 522 bp, Homo sapiens
  misc_feature (11)..(11): n is a, c, g, or t
  misc_feature (185)..(185): n is a, c, g, or t
  misc_feature (216)..(216): n is a, c, g, or t
  misc_feature (287)..(287): n is a, c, g, or t
  misc_feature (312)..(312): n is a, c, g, or t
  misc_feature (323)..(323): n is a, c, g, or t
  misc_feature (331)..(331): n is a, c, g, or t
  misc_feature (337)..(337): n is a, c, g, or t
  misc_feature (365)..(365): n is a, c, g, or t
tttaatttttncccatatgacaaaagctgagtatttcagagaattatacaacttgaaaaaccctgtgtcattaaattgtaactttattgcaagatggtagaattaattacaaatttaaactataacctgttaatctttagtcaggcagcaagtttttataaaggcaaactgcttattcagaagtnatcacggaacaactcaaaggcagagcaaganggatgagaaacatctgactggccgatagagatttcgttctctcactatatgaaacaaacttttcatttttnggaagggtaaactataacttcagtngacaccaacanagaaagantttgtnaaatagactagtttccatttagtcagtnaactgtttgaatgctgtctgaactctgggaaagatatacagaaaaaagcagactatgctctgagcgtctctgtgcgcaacgcagctgttaggtgcgcaagtgcagctggcgaatcgtctccttatcgctgaattatgtggggaggtctgaagagtcg

SEQ ID NO: 491744 - DNA, 740 bp, Homo sapiens
tcgagttttttttttatatttattttttatttatttaatatttgggcaaggtttttttcccataatattaaagtttttcgaggttataaatatttttcttcggggaagcacaagtttcttttcacattggctccctggattcaattttataacacagttggagaaccaccggtggggcacttggtgaaacgtggcgttctcgtggggcacgccctcttatatagcttgggtggtgtgttggatagtcacacgttacaggctctcactcacacctatacaaaacaggagagtgtgacctctctgtggagaaacctctcagaacacatatatgtgacaagaacagttctcgtagatattaaatctcacaatctctctcacacacacaacaacatgtgcgcacgtgtgatatttaaccccaacacacaaagaaagtatagggggtgacatgtgcgacgcatgatgagcacaataacaagaagagaggacacaaacacccgcccgcgcatcacacacccacaacaccacactttgagcgatatgtagtggcgctctgtgatgagaagagagagagggcgacaccagaaagttagccacaaaccagttgttgtgcgacacgacccagttatcccaaagagagcgtctccaggtgacgacactgttgttgtttccacttgtggacaacacagagacgagagaggccctgtggtgttgagccactaatgttgcttcacactgtgtgg

SEQ ID NO: 491745 - DNA, 123 bp, Homo sapiens
  misc_feature (40)..(40): n is a, c, g, or t
  misc_feature (77)..(78): n is a, c, g, or t
  misc_feature (104)..(104): n is a, c, g, or t
tatggggagggctaacccctatgcctttgcataggggagnaactagaaataactttggcaaggaggaaccagaagcnnaagaccccgggaacccaggacgaggntcctaaagaacagggttaa

SEQ ID NO: 491746 - DNA, 332 bp, Homo sapiens
gcacagctacacacagggcgctctacaatatgagccgttctgaagtcatcaaagccttagaccagataaagactccagccatgacctcatgctgctccgcctgctcagagcactgccaagatcacagatgtcgtgaaggtcctgggcctgcccaaccaggagccagcactggggaccacctgctacgccatcaggctggggcagcatcaaaccagaggagtgagtcttcagtgtgtgagcctccatctcctgtccaatgacatgctgtgcaaaagctatactctgagaaggtgacagagttcatgttgtgtgcagcgctctggacaaggtgg

SEQ ID NO: 491747 - DNA, 481 bp, Homo sapiens
  misc_feature (469)..(470): n is a, c, g, or t
ctcgataccccgtgaaagcacacccgcattcgatgaacagccccgccgatagacgaccgcaacggatcatcttcgccaccgcgtccgcgatttcagaaaccggaccgccgagtgagcccgccagcccggccgcggtcagcaggccttgtcgcagaatcgccaactcaatgcggtattccagctcgtcaccgtcgaacaacaatgctgcgtcctggcccaccagctcggccacgttggcgaacgcccccacgctatactcaacggcgccgaagtcactctctggttcacccgcaatttccagagcagcccccccgatttgtttggtgctgttcgaaaccgccacagcctcggtaccgactcggccaacggtctcgcagtagcggacgatcgcaagaatctgctcattcagctcaattgcccacttcgcccgggtcagtgccacgtacagcaagtgcagctcctgacgcanngtcagggtatc

SEQ ID NO: 491748 - DNA, 179 bp, Homo sapiens
aacatcattcttgtaatacctgttgttacatatcttaacttcccgtcctggtcgaaactcaaactccaggaactcgtggccgaacttgccttgtgcccacgtagtaccgcagataaaagtcactctccatggctcccaaaagacaacctgagcctgaacttccaagagcaagccgcact

SEQ ID NO: 491749 - DNA, 226 bp, Homo sapiens
tcaagcttaaaattttctgctgttctttttttccagtagggacaggtcttgccatgttcgcccaggctgctcttgggctcttggactcagcaatcctcccacctcagcctctcaaagtgctaggattacaggcctgagcccccatgcccagtctcctggtgtccttggggggtttccctctgtaggtacttgtgcatttgtgtccagagagacttgggagactata

SEQ ID NO: 491750 - DNA, 637 bp, Homo sapiens
  misc_feature (1)..(1): n is a, c, g, or t
naggttcacccacaagaggcttaatgactgtgcttcccctccggtgtcaagaacttaaagccctcagagtccacacaagctcttaggctcatagtgcttctgcgctcacccggcccgtttgcacagatacagtgaggcgcttgttccttctcctctggcacacctagaaagccggaagagtctcccatttgcacactgacccgaatgcatttggaagtgtagtttagacccgtggccttgagtgtaaagccttctccacgattcacagagtaagccattgtgagctccacaaaaaaggtctgaaaggctcgaagagagccagtgatagagataccaagtccagcttcttcacacagacagaaggcccctgccttccactcggtgatggtgtcagggtctgttactcctacctcagccacacctgttgagtttaccaccaccaaatcccagatccatgtctcaggaaagtactttcgtacggtctccgtgtgaggctcttcacacatgcaccaggcgtgcatggcctcttcccattacatctgactcataaaaacctacacgtagaccttcaggtccatgcatttcatactgttaaagctgtgcacacattttgggtttacgaatctttgagttggtg

SEQ ID NO: 491751 - DNA, 934 bp, Homo sapiens
  misc_feature (11)..(11): n is a, c, g, or t
  misc_feature (94)..(94): n is a, c, g, or t
  misc_feature (99)..(99): n is a, c, g, or t
  misc_feature (111)..(111): n is a, c, g, or t
  misc_feature (115)..(117): n is a, c, g, or t
  misc_feature (124)..(124): n is a, c, g, or t
  misc_feature (130)..(130): n is a, c, g, or t
  misc_feature (138)..(138): n is a, c, g, or t
  misc_feature (152)..(152): n is a, c, g, or t
  misc_feature (155)..(155): n is a, c, g, or t
  misc_feature (158)..(158): n is a, c, g, or t
  misc_feature (174)..(174): n is a, c, g, or t
  misc_feature (176)..(177): n is a, c, g, or t
  misc_feature (279)..(279): n is a, c, g, or t
  misc_feature (282)..(282): n is a, c, g, or t
  misc_feature (297)..(297): n is a, c, g, or t
  misc_feature (305)..(305): n is a, c, g, or t
  misc_feature (309)..(309): n is a, c, g, or t
  misc_feature (311)..(311): n is a, c, g, or t
  misc_feature (317)..(318): n is a, c, g, or t
  misc_feature (322)..(324): n is a, c, g, or t
  misc_feature (328)..(328): n is a, c, g, or t
  misc_feature (343)..(343): n is a, c, g, or t
  misc_feature (347)..(347): n is a, c, g, or t
  misc_feature (351)..(351): n is a, c, g, or t
  misc_feature (356)..(356): n is a, c, g, or t
  misc_feature (358)..(358): n is a, c, g, or t
  misc_feature (379)..(379): n is a, c, g, or t
  misc_feature (394)..(394): n is a, c, g, or t
  misc_feature (402)..(402): n is a, c, g, or t
  misc_feature (407)..(407): n is a, c, g, or t
  misc_feature (414)..(415): n is a, c, g, or t
  misc_feature (426)..(426): n is a, c, g, or t
  misc_feature (428)..(428): n is a, c, g, or t
  misc_feature (433)..(433): n is a, c, g, or t
  misc_feature (438)..(439): n is a, c, g, or t
  misc_feature (441)..(441): n is a, c, g, or t
  misc_feature (443)..(443): n is a, c, g, or t
  misc_feature (447)..(447): n is a, c, g, or t
  misc_feature (452)..(452): n is a, c, g, or t
  misc_feature (467)..(467): n is a, c, g, or t
  misc_feature (469)..(469): n is a, c, g, or t
  misc_feature (475)..(476): n is a, c, g, or t
  misc_feature (489)..(491): n is a, c, g, or t
  misc_feature (493)..(493): n is a, c, g, or t
  misc_feature (518)..(518): n is a, c, g, or t
  misc_feature (522)..(522): n is a, c, g, or t
  misc_feature (537)..(537): n is a, c, g, or t
  misc_feature (553)..(553): n is a, c, g, or t
  misc_feature (565)..(565): n is a, c, g, or t
  misc_feature (637)..(637): n is a, c, g, or t
  misc_feature (645)..(645): n is a, c, g, or t
  misc_feature (653)..(653): n is a, c, g, or t
  misc_feature (767)..(767): n is a, c, g, or t
  misc_feature (796)..(796): n is a, c, g, or t
  misc_feature (801)..(801): n is a, c, g, or t
  misc_feature (822)..(822): n is a, c, g, or t
  misc_feature (843)..(843): n is a, c, g, or t
  misc_feature (850)..(851): n is a, c, g, or t
  misc_feature (901)..(901): n is a, c, g, or t
tattcattatngtcaccacatatatatacttgttattataacctttcccatatctttttttagcattaattggaaaaaaaaaaaaaaaaaaaanttaantaaaatataaanatannnaaaaaanccaatnaaaaaaanatattccttaaaanatntanaattttttttttttcnannttttttttcttttttttttttttttttttttttttttttttttttttttttttttttttttttttttttttttttttttttttttttttttttttttttttnttntttttcatattttantccttttnttancntttcannggcnnntttntttttaacattagtntttntttnccagntngtaatttagatttttttctgnggtgttttttatttnttcttttntgctnttttttnnttttttttttntntctcntcttnnancntttnttttnctctttgttcctttntntttttnnttgtttttttgannntntggttagctttttctctgtttcctntttngtggttttttttctnacccatccttcttttntctcagtgcccncaccagccgctattgttgaaccaccgtaacgtagcatgaacctccccagctctttaaagtctttatatagcncaagagcnattggtcnttgtgtctgtagctctaccaatgcattctggcctttagtcaaaaacttaggctttttctttgtgacttcacccgtgcttttgtttaagacactaatcaatcgtttaataacggngggttcactgacagtttggtagtgtacancacangaaatcctttagtgataggantttcaatattaaagatgaggnttcgggnnctgaaacgagtgcaagctttaatgggtactttggggccacaaaatatgcngccaacattgattttgatgatatccatcccacc

SEQ ID NO: 491752 - DNA, 327 bp, Homo sapiens
gcgcgcggaaggcggaggctttgggtgccgttcaagattcaagcttaacctgtaaccaaccgccatggccgagggaaggcattgctgctggaggtgtaatgacgttaatactgcttacaagaggtcttgaggactgcctcatcacgatggcctagcacgtggattcgcgagtgccaaagcttagcaaagcgcaagctatcttgtgtgctgatcaactgtatgagctatgtatgtcaagttggtgaggccttgtctgacacaatcacctattaggtgatgcacagaactagagatggtagcttgtaaatgcagagggactgtaagtgt

SEQ ID NO: 491753 - DNA, 106 bp, Homo sapiens
tcttgattgatgtgacttgccagaatgtttgaaaccccagtgaccaagaataatttttacttttaagaaagcatacccagcaataaaagtattatttttgagtcta

SEQ ID NO: 491754 - DNA, 396 bp, Homo sapiens
  misc_feature (1)..(1): n is a, c, g, or t
  misc_feature (108)..(109): n is a, c, g, or t
ncttagatcagggtgcaaaggaagaataatgagcagcttttcagagggaactgggcgtttaggtgttcaggggagggggtggtgcttttaaaatctcaggcttggcannaaatgcgtggcaattttacggtcaattggcgggacatctggaaccagacattctggccttgagttgatggtagggaaaccagcttacaggcaacagcaagcccataatgagtccctgtcatgtactagtggaaaccacgttgacggtctgccaaatatccatgcgcctttttctcagcgacaggattctccttagagccattatctagtatctgaaatctgtccacttacagatcttcacctgttttcgctattaaagacaatgcaaaaacaaaagctaaaaattag

SEQ ID NO: 491755 - DNA, 177 bp, Homo sapiens
gatgagatcagactgtgtgtggggagccggttgctgtagagtgagggtactccctaccccacctgtcccttggtgtttaatcattgcagggacgcctctctgattattcacccacgtttcaaaggtgtcagaccacacagggacgcctgccttggtccttcacccttagcggcaagt

SEQ ID NO: 491756 - DNA, 568 bp, Homo sapiens
  misc_feature (342)..(342): n is a, c, g, or t
agcggagtcctgccggctggttcgggtggagtggtgggctagcggtgctaggggaggggatggaccgagtaccaggagtgtcgggatgagggttccgggaggatctggccatggggtgccgaggcacaggcaggtgacgaaggatacttcgtgaaggatatcaagatctgggcttcatgaaattctgataccttatacctgtctatggttgcaggattgcacatggccagagatgacgcaaaggagcaagagagacagggacattgagggtgtctggagcctgacccatacgtgtggggacaagatagcatgggcatggcatcatatatctactgtctgggnacgagttgttgtgctgatctgtattctagccgtggtggagcgtttatgccggctgtcatgcgaaaggagtagcgcatgcatgtttatcatagagggtatggttctgcatacgtaatatacatgggcacgagcggagttgtgattcttgtagaccgtagtttggaagtaaacctctagtagtgcgttccataaactagatggttgcgctagggttacagaagaagcc

SEQ ID NO: 491757 - DNA, 160 bp, Homo sapiens
ttaaacaaatagttacacatacatctgtgtgcagcgattatgctacgattctgagactaaaataatgctgaatgtctctcatcatacaggctttccattattagtgggtatgtcgtgaaaacatcaaatttgccacaagaacttcacaagtcagtgtctg

SEQ ID NO: 491758 - DNA, 255 bp, Homo sapiens
ctttgtcccccaggccggagtgcagtggcacgatctctgctcactgcaagttctggctcccggggtcacggcattctcctgcctcagcctcccgaatagctgggaccacaggcacccgccaccatgcccggctaattttttgtatttttactagagacaggggacctacatatgattgtctccttctgaaggagcttatgcaattgtcatttgggtctcagctttcgtcagaagatacaattaaggtcagataca

SEQ ID NO: 491759 - DNA, 515 bp, Homo sapiens
gactctagaggacccctgctgacgtatatgttgggggattaaagaagacaccgaaaacatcacctaagagattattttgaacagtatggaaaaattgacagtgattagaaatcatgactgaccgagccattggcaagaaaaggggctttgcattggtagcctttgacgaccataactccgtgcataagattgtcattcagagataccatactgtgaatggccacaactgtgaagttagaaaagccctgtcaaagcaagagatggctagtgcttcatccagccaaagaggtcgaagtggttctggacacttaggtggtggtcgtgacggtggttccggtgggaatgacaacttcggtcgtgaagcaaacttcagtggtcgtggtggctttggtggcagccgaggagttggagaatatggtggcagtggggatggctatcatggatttggtaatgatggaagcaattttggaggtggtggaagctacaatgatatggggaataacaacaaatagtca

SEQ ID NO: 491760 - DNA, 410 bp, Homo sapiens
tgagatggagtctcgctctgtcgccaggctggagtgcagtggcgcaatctgggctcactgcaacctccgcctcctggggtcaagcgattctcctgcctcagcctcccgagtagctgggactacaggcgcctgccaccatgcctggctaatttttgtatttttagtagagacgaggtttcaccatgttggccagggtggtctcgatctcctgacctcatgatccacccacctctgcctcccaaagtgcacagattacaggcgtgagccactgagcccggccacaaatcaatgaggtgactttcactacaattttcctcccagaggtttgcctgggatttggttcttagaataataggaataatagttataccccagttggcttctgctgtgtaataaagctccccccagct

SEQ ID NO: 491761 - DNA, 350 bp, Homo sapiens
agctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtaaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggttaaaaa

SEQ ID NO: 491762 - DNA, 1012 bp, Homo sapiens
gcgtgaggctgtggacatttcggaatgtgggtttgttttttttaaaccgggcaatatgtgttcagttcaagctgtgaaggacaaatatatatcacgggttgtgccaataaaataccaggactacctgaaaaaaaaaaacaaaaaaggacaaaaaaacacacaagaaccaaaaaaaaattggtgtgggcgggcccggggccccagaaaagcttcacaaaacacaatggtgggggcgcgggggcccccaaggtctagacaaccagcggggacaggaggggcccccaggagaaccgggacaaaacaaagggcgagggacttaaccacaataataaaaagccggaggaaaccaccacagtatcgagagaacaaaatacagcagtgatattacagggagcacacaaagggggatactaaccaagaagggaagcaacagacgagagccacgataataaaaaattaggcccccagactgtagggataccacacaacacaacaccacacacaacgagacaaactgaagcaacatcgaacaaagaacaaagtagaaaaaagaacaaggaagcgaccaagagcaaggagaagacgcagggacagaaccgatcagcgagacacgaaaggaggactcatcagcaagcagaaacagaagagtacaagagaagaacgcgaacgagaaacaggacagcaagcagagtagagagcgagaaagaacgaggacaaagcgaacgagagaagcgcagatgaaaacaagcgagaagcgacagggagagagcctaggaaagaagtagtaagagaccgaagatatcacagcagtaagcgaagaggagacaacgagaagagacaccgagaacagaagcaggaagacgaggagagaagagcacagagagcgaacagaacacacagatgagagccagagagcaaaacagagagacaatgagagaacaggaatatagagaagaacagaagagaaacacagactagaatagacagaaacagcaaacaacgagagaaggag

SEQ ID NO: 491763 - DNA, 93 bp, Homo sapiens
gctgaggacactgccatatattattgtacgagagattgtaccttgtcctggccacagatggtaggcaactggttcgactcctggggccaagga

SEQ ID NO: 491764 - DNA, 428 bp, Homo sapiens
cacatgaagagtatatccgtgggggtatatatactcaggaagggattacttctagatctgtgaggaatcgccagcagggtcttccacaagggtggaactaatttacatgcccaccaacagagtaaaagcattccttttgctcctcacgctcgccggcatctgttgtttcttgactttttaataatcgccattctgactgggtaagatggtatctcattgtggtttggggttgcatttctctaatgatcagtgatgtggagctttttgtcagtgttgtgggctgcatgaatgtcttcttttgagaagtgtctgtgtcacgtcctttgcctatttttaatgtggttgttttcttgtaaatttgtttaggtcccttgcagactctggatatcagacctttgtcagttggatagattgcaaaaattttctcc

SEQ ID NO: 491765 - DNA, 579 bp, Homo sapiens
ggtctagctgttcagaggtcaccgactgacagctgatatccaagtcatcgattacatgcatgtgattctaacacgtagccatatttcaaagccttcaactatgactcaattaccaagccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtgaccacgcttcacggtcacgctcgtccgtcctgcagtggcgtgtttacatggtcacacgtgtgtgtatcaccagtgggtcaactgcttgtcattcctcccgtggcagttggtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatctcactcttagtgagcaaaattgtg

SEQ ID NO: 491766 - DNA, 152 bp, Homo sapiens
caggtcagacggggtggttctggtgcgtagtcgggcgaggccctgatcggcattgcgggtcggatcgaagagatcacgaccctgatgagcgaaatccgcgcctcgactcaggaacaggcggtgggtctggccgaggtcaacaccgccgtgaa

SEQ ID NO: 491767 - DNA, 234 bp, Homo sapiens
taccttactgtatctgctctgtgttcagtgtctcttcctcagcttcaattagcttggactacaggtgctcgccaccacactcggctaattttttatattttcagtagacacggtgtttcaccatgctggtcaggctggtctcgaactcccgacctcgtgatccatccgccttggcctcccaaagtgctgggattgcgggcgtgagccaccacgcccggcctgtagcctgaattt

SEQ ID NO: 491768 - DNA, 1034 bp, Homo sapiens
  misc_feature (1034)..(1034): n is a, c, g, or t
ggagtatgctatgattcagaagttgcaagttgcgtcttcaggttggatgggtgagaatagtaatgtgggctgtgagtcgatgcttgagaatcgggacggactgaacctctggtgaaggatgttgtatagtaatttcgataaggtgtttgtgatcaggtgtatcggaattgagctggaggatgatttcattcatgcagctgaggatgtaagagagcggggggagacggaaagttactgatggtcagtacggtgtaaactctagagccagggttaggtacagcttgtatatttcctatgcatgctgccggggattaggattcggtcggtttcagtctgattgagtgtatcatgggaagagtcagaacaaatgtggttgcaatgcttgtcgggatactgtatatgagatcatcattttctgggtggcaagtatacacgctaacagagtggtttcatgatgtgagtgtatagcgtatctcatgcttctgatcttcctatcaacttacagggctcccctgataatgatggagttgacattggattcataggcgattggaggggattttcgtcaggtaatacgatacagaaggtttttcctggtgttacctctatcttatggattttggttctcaccttttggtaaaacccagtgggctgtatgaagattgtggttgacacaaggttgtttggaagtacctgggcgaaagtttgacttctgaattttggcgagcgcgataccaagcatcggtgggggcactggacaccggacgagaccggggcgggatctgaggagaaacgagagaccgggcaatagggcgaacccggggaatgacgccggccggcatcccgcgcaccacagtcccaatgcgtccccaagaaggggtccagccataaaagacgcccgcgcgaagacaatcacctcacaagcccggagttaggcaaaacgtcacaaccgcaactttctaacgagagccctacaaccattgttcccagcaaagttctagaaccacactggagaccgtactcccactctcacn

SEQ ID NO: 491769 - DNA, 233 bp, Homo sapiens
gacgacagggcgactctttgcagcgatcatgctctcctcgaactgggcgtaagctgtcaatacacctgtgtgaagtcccgcacggtcatcactgtccggatgtgtctcctcgtacacgtcccgagccttctcgaactggccgctgcggatgtagtaagtcgcgcgagagaaacaccatgagcttgcccagcctggtcccgtgaagctgggtgagggccccgcggattgactgg

SEQ ID NO: 491770 - DNA, 103 bp, Homo sapiens
ccccaagcatgtaatacatgactcagactcccaatgtagctgggactacagattgcccaccaccatgcctggctaagtattatatgtagttttatgtagagat

SEQ ID NO: 491771 - DNA, 114 bp, Homo sapiens
ggataccttgtgtattatagtgaggagtacgtagtattgagtatgctaggcagaatagtaatgaggatgtaagtccgtgggctgatatatgaagaatgtaattgctgccggtgt

SEQ ID NO: 491772 - DNA, 187 bp, Homo sapiens
  misc_feature (173)..(173): n is a, c, g, or t
aattaaaatgaaattttttgcaaacccggcaaatagagccaaggaaggccagggagagtttcatgcattaaatccatgaagcaagaactatcaataaagattcggcaaaattcccaatcttcacagaggccattgcaaccttaaacacacacaaaaacttgtggaggacattnttcagcaactgcct

SEQ ID NO: 491773 - DNA, 327 bp, Homo sapiens
cgagatcatgctactgcactccagcctgggtggcagagcaagactctgtctcagacaaataaacaaacatgaaaacacaaccctagcccttgataggctaatcttatttagagttccgaaaatatgattggtcactataatcataggggctcaaaattttttcattaattattatgccctaagtaccaatgccagatacccaactacactttatcatggaaactctatacaaataaaaaaaaaagtctgtactaagtgttgctaggaaatttttaactttataaagcttataaataaactttactaacttctggttacagaaaaaaa

SEQ ID NO: 491774 - DNA, 452 bp, Homo sapiens
  misc_feature (20)..(20): n is a, c, g, or t
  misc_feature (110)..(110): n is a, c, g, or t
  misc_feature (178)..(178): n is a, c, g, or t
  misc_feature (244)..(244): n is a, c, g, or t
  misc_feature (251)..(251): n is a, c, g, or t
  misc_feature (266)..(266): n is a, c, g, or t
  misc_feature (324)..(324): n is a, c, g, or t
  misc_feature (332)..(332): n is a, c, g, or t
  misc_feature (343)..(343): n is a, c, g, or t
  misc_feature (414)..(414): n is a, c, g, or t
tggaaaaacaggccaggganaagtgcgtgcccaacttaggcagatgttcccccagtggcccaaaagccctggggtatagttttttcccccccaaggaaaaaccccttttntgggacatggggtggagggcaggacctaaaggcccccagggaaggcccccttccggggctgttccccnaggaggaaaggaaggggctttgtgtgccccccaggaggaaaaggcccttagttctgggatcaaacnccccttnacgtgtatccccccncaaaagcaagctccccaaggtcccctttcagtccccttccctacaccctggccggccnctgccgcncacccccccanagcacgcccccccccatgggagtgtgctcaggagttgcgggcagggtggacatttgtcccaaagggggcanaatttcccataaagggctgagcccttaaaaaaaaaaaa

SEQ ID NO: 491775 - DNA, 718 bp, Homo sapiens
  misc_feature (718)..(718): n is a, c, g, or t
gtcccgtgtggggcgtggtgaagagtgtggcctaggaaccccagccccgctgtactgcctggtggctgcagcctgtggagtgactcggtgctgctagctgaacccagctctgggggacctggcgtggtggctgggcagcacagatacagctgtatgatgcgccttctgtccctgcctgatggagcccccctatgcatgcctgtgccctgctggcattggagtgcctacatgatgtgaggagctgccaatgtggtgcctgcgtgcttgctgcatactgccactggtgaatgccatgtgactgcagtgtagaccttggcactggtgctgtagggtgactaccgtggcctgtggttgctggccacccaatggcctacacccatgggtgcttgattcaccagcttgagcctgtcgccgcagccctgagtccgtttccgcctgcttgccacgtgacaggtgcagctgatgtggccttccacctcttgcccggccccttccttgtatcggttggctgtacccagcgcatgtgtcctgcctctacccacctagcttgcggcctgttgaagctacaccaggaaagctgcatgcccaactgcgaactgggtagtccagactggcgggtgcaaccctgccggttacaacgtagttctggtgtgagctacgatagcaagcctggtgtggttgacctggatcttcaccaaggcataatggatgctgctcn

SEQ ID NO: 491776 - DNA, 326 bp, Homo sapiens
tccagaggcccagtgggtcatctcccaaggtgggtgtggaccctagcctcaggggccttgctggtgctgtcacctcccacctgttccattccgaggtgggtggatcatgaagtccggagatcaagaccatcctggctaacatggtgaaaccccgtctctactaaaaatacaaaaaaaattagccgggcatggtggcgggcccctgtagtcccagctacaggctgtggcaggagaatggcgtgaacctgggaggcggagcttgcagtgagccgagatcgcaccactgcactccagcccgggcgactgagcaagattctgtctcaaaa

SEQ ID NO: 491777 - DNA, 160 bp, Homo sapiens
gaccagctttaaattagcgacggatgataggttgttttctttatattcagtattatattacacatacatttcctgcagttactagtttttataataacttgtgtagctgcacaacatataacttaacagcttactaaacactgcattttaacacttattt

SEQ ID NO: 491778 - DNA, 666 bp, Homo sapiens
tcgacccacgcgtccgtttttttgtttatttttacgcaaacagggaaaaaattatttttattgatccaactatttgaatacaattttcaccccatggctattctcggtctggaagaggtttggggaaatattccttgtttggtgaatggatggtccagcagctcaaagagtgaaattattcctcgcgagggccaaaaagtctctgaggaacctaattcacggatatcacgggcgaggccgtcttatcacctttacgtcgcaacagatacaagacgcgagcagaaaaagatcataacatagcgcgaaaagccacccgaggagaggcagtggacacatatagcggtgctccacagaggggataacgtgggaaggagaactccgagacaaaaatagcggaccgtgggagaacaggacattctgtagagtacatcgtgacacactcttaccacacgcgagagtgcctcaactcgtgtcacaggggagagccacaaaaacgaaagagagggggggagccccagagagccacagcacaacatgtgacgggacccagaggggcgggaggggcacacaaagcggctgcgttatccaagagaggagatagagggtatcaacatctgtgggtatcaacacacgcggctccactacaccgacgcgatgtgacacaca

SEQ ID NO: 491779 - DNA, 118 bp, Homo sapiens
  misc_feature (41)..(41): n is a, c, g, or t
tagagttcactcgtacgagcgcctcgtacagtactccgtancgagcgccgtgagcttttaatgtttaagtcatattaaactcttaggtcaaattaagcagacccggcgtcgttacgga

SEQ ID NO: 491780 - DNA, 194 bp, Homo sapiens
  misc_feature (76)..(76): n is a, c, g, or t
gaaagagtctttctccgaaaatcatggtaaagaatactgagacattgaaaaaaattcaacaaaatatgcttctgangacctgtacctttatggtttgcttcacatcagtagttctgctgaacgggctgtcataatgagggattccaagattttttcctgattaggactggtgaccagttattcaattatggttt

SEQ ID NO: 491781 - DNA, 136 bp, Homo sapiens
tatttggccgtcacttcttctgttggtaccgtcatttatttcttcccaactgaaagcactttacattccgaaaaacttcatcgtgcacacagaattgctggatcagactctcggtccattgtccaatattccccac

SEQ ID NO: 491782 - DNA, 145 bp, Homo sapiens
cccgttaaaaaaaagggccgggttggcggggttgggttcttgggtggggcccttcccttcccgttcctcccccccccggggacgcgcacggcttcccaggcaccgcccggcggcggcggcggcggcggcgaggcgcggcggccgc

SEQ ID NO: 491783 - DNA, 225 bp, Homo sapiens
  misc_feature (213)..(213): n is a, c, g, or t
cccagcagccccgcactccgatcctgctgatccgcgacaaaccgcaaccgcgcggccgaacgcggacggccggctcatctggagtcaccgctggccccccagcccaccgcccgtcactggttccaagctggctactcgacatctaggagcccgaagcatggcctcgcgcgcggagaaccagacagcgccgggagaagttcctgcgctcagtanacctgcggtcgc

SEQ ID NO: 491784 - DNA, 153 bp, Homo sapiens
aagatcccccagtttcagccctgcttattagtgagaaagactggcaaggtttcctagagctttacttacagaacagccctgaggcctgtgactatgggttttgaagggggcaggagtcagcaataaagctatgtttgattttttccttcccta

SEQ ID NO: 491785 - DNA, 307 bp, Homo sapiens
ccctctacatatttaccactaccacaatggggctcattcacccaccgacacttacaacatataaccctcattcacaccagaaatcaccctcttgtcttacatttatgtatgacatgaggcaaattcacatgacctctttgtgtctttggccctagcagaaacaatattccttaacaatgcttagttggtgttgtgtagacgaattaaaataattggaaggctggcacttggcatatgcaatgaagtgtgtcatgtaattccctaataacaacaacagaattggtatgtgacctactgttgagttaca

SEQ ID NO: 491786 - DNA, 169 bp, Homo sapiens
tatcagctcggtcctctcttctcccagattctccccaaagggccaggagttggcacacccctgtaatcccagcactttaggaggccaaggtgggcagatctctgaggttgggagttcgagaccagcctggccaacatagtgaaaccctgtctctactaaaaatacaaaa

SEQ ID NO: 491787 - DNA, 516 bp, Homo sapiens
actaactgacttgggggaaggaaaatatccagctccagttggctctagccttccatgtggggaagggaaatacaccactgtagtcccctttagcaattctgtccatcataagagggagaaacaactgaaaaaaaactgctgaagtttaccgtgcagggttataggcttaccaaaagactgagacctaatcataggactacagaatgcttccactccctgacaccttaccaccacattacttaaggcttatttactgtagttccttttactcaacacatcatagtcacctttcaacaaaaaaattacaagacatatttgtaaaggcaaaaaaaaaagtgattttcagtttgaagagaataagcatcataaccagagtcaaatatggtaagaatattgtgattattaaaccaggaattaaaaacaaacagaactatttttatatgataaaggctttacggaaaagtagacaacatgcaggaacaaatggataatgtaagcagagagatggaaatttta

SEQ ID NO: 491788 - DNA, 430 bp, Homo sapiens
ccgggcttccaggaaatttgccacgagtgccgagcaaggtcgtgtagaaaggggagttaggtggtacggccatttcttccgccttccgtgtctgcggccctcgcagaactttccagcagcgacatgttgggccagagtatccggaggttcacgacctccgtggtccgtcgcagccactatgaggagggtccggggaagaatttgccattttcagtggaaaacaagtggcggttgctggctatgatgaccgtgtactttggatctgggtttgccgcacctttctttatagtaagacaccagctacttaaaaaataaggatatttaattcatccctttaacagaatgaagaaagtttaagagatgatctgaaaattggattaaactcttgaactcttatactagaaaaaattgtaaataaactaatgacata

SEQ ID NO: 491789 - DNA, 86 bp, Homo sapiens
agcgggcgttctacgtaacggacggcggaggctacgtgaagagaggcgcggcgtgactgagctacggttctggctgcgtcctagag

SEQ ID NO: 491790 - DNA, 395 bp, Homo sapiens
  misc_feature (336)..(336): n is a, c, g, or t
gaccgggccgtgcccctggcagtgatgacgcgcaaccgcaaggcggagctgcggctgtgcaacaagttggtggcactgctgcccacgctggaggagccccaggagcgctttgagtttgcccacatggccttagcactcagcatcaccctgcccgaccggttgaacgagcgcgtggcataccaccggatggccgccatgcaacaccgactgggccatggcgagctggcagagcacctttacctcaaggccatgtagatctgcaactcgccgctggagttagacgaggagaccctctccgacgtgaaggtgtacctggtgctcggtgacagcatcttntacgacctgaaggacccgattgatgcacccagaaaaaaacaaaataacgttggcgcccg

SEQ ID NO: 491791 - DNA, 1335 bp, Homo sapiens
gcaccaatatggcggatgacgccggtgcagcgggggggcccgggggccctggtggccctgggatggggaaccgggggtgtcttccgcgggaggttatcggcagctgtgacttcctggtggccgtgtggtctgcgtggctgtggactggggtccggggccgaggccgtcggagctctgcggaggcatgggctcgaggataaggagtggatgcccgtcaggcaagttagggccgcttggtcaaggacatgtagacgatcaagtccctggaggagatctatctcttctccctgcctattacggaatcaggagatcatggatttcttcctggtgggccatctctcaaggatgacggttttgagagattcatgctcagtgcatgagaggcatgacccgtgtccggtgctagggctacccgaggttcaacggcagttttgtatgcctactcggtgggcacgtaacacagtggcgctacgatcggatctggggtgcttaagtgcatcctagaaggtagcggtgagccgaccgggccattccaggtgggggccatctatccttggtctcaagacttctctcatctgttcccccagatggcggcaagagaggcattaactggcggggaaccaagaatcggggcaaggcccccaccactggttcccttttgtctcagggttgaccagtgcccgctggcatgactcctaggtgccttgtgtacgcccatcaattcggcttgtggccccaagggggccaccttgggcaatacggtctaccacgggaccttggtgcctaaagacaagcgtgcatccatggagttgggagtggggtaattccgagtagagcgtggggtataagcctttaatgccccgcgggggagcttgatgagcttggtgtgctaccccctgtgtgggggggacaactatatcgcacaggagtgccaacacctttttggatgttgcccacgaattctataaagagagacaccttacagagggtattccctgtgatatcactcgcgaagcctcggagtgaggagagcagagaagcggagggaggtggttttcaccaacaagcagttaccgcccccaactacacagagagggcggcgaccatgtgagagccacgcacaacgtcggtttgtaagaaaagccagccaacacaacgagaaggactacttgctgcgacgcaggagagagcaagagcaggcccccacagcacgcgggggagagacccaacacaggagcggacggggtatcaagacagaaaaacaaaaggggaagcaacagcgccgggaggacagcagcgacaagaaagcaaagccggcgcggccgaccatcttgg

SEQ ID NO: 491792 - DNA, 444 bp, Homo sapiens
atgatgtcctggcctcatgccccccaatcctagaaccagagaggacaatgatcttgcattcccaggttcccaggaaggtcttggcctggttctacagccccagcccaaaatcctattgcaagagcatctcgtgtgaccaagatcactaaaccagatgggatagtggcggcgcgccggactgtggtgaacagtgagcgccggaacaagagactacagtaacccgataggaagcagatagcagtcctaggggtgatccagacatcacaagacctccagccctggatgatgccttttccatcctggacttatacctggaacgtaggttccggacccgatagcctatgataaccctcagaggccttcaagtcctttccacctctcacccattgcccaccattaataagcttagcttctcttgccagctcaggggctaggatatgtgga

SEQ ID NO: 491793 - DNA, 356 bp, Homo sapiens
  misc_feature (241)..(241): n is a, c, g, or t
gattttcctggcccaacacaattgggcaagaaaacaagatgaaagataacccggttggaaaataagaattaaaactctttatttgcaaatgatatgatcttctggatagaaaattctaaagaactcacttaaaaactattagagctaataaatgatttcaacaaggttgcaggatacaagatcagtatacaaaatcaattgtattttagtataccagcaatgggcaatctaaaattaaaanaggccaggtgtggtggcctatacatgcctgtacttcccaaaatttaggaggctgagacaggtgggttgcctgagcccaggaattcaagaccagcctgggcaacatggctagatcc

SEQ ID NO: 491794 - DNA, 208 bp, Homo sapiens
aaagcagagagagtgcgagacgcagcagagtcagacgagacgtcgctgacagtcctctgtgtccaggtggtctctcagaatccattgaccatgcagctggacaaatagactggggtggaacttgctgtgtttatatttaatctcttaccgtatatgcgtagtatttgagttgcgaataaatgttccatttttgtttctaaaaaaaaaa

SEQ ID NO: 491795 - DNA, 132 bp, Homo sapiens
tccagagctaagttagtactgtttaagttactattgagtggattttcttcattttctgtttagtccagtgttgccaaggtaagctggggaatggagtataccaacttctttcagagcattttaggacattat

SEQ ID NO: 491796 - DNA, 200 bp, Homo sapiens
caccgctgcgtactaaaaaatgagtataaaggtatatgttcacatgtatttatttatttattggagggttgtgctttgtccactaggctggagtgcagtggcatgatcatggctcactgcaacctctacctcctgggcccaagcaatcctcccacctcagcctcctgagtagttgaagtccttgccacgactatgtcctg

SEQ ID NO: 491797 - DNA, 227 bp, Homo sapiens
ttgggggccggcccgcaacctaaggcaggaagatagtggccgcaaagaaaacgaaaagagtcgcgtggatatcaatcaactctaggctccaactcgttcatgaaaagtgggaagtacgtccgtgggttacaagcagactctgaagatgatcagacaaggcaaagcgaaattggtcattctcgctaacaactgcccagctttgcaggaattctgaaatagagtactat

SEQ ID NO: 491798 - DNA, 1086 bp, Homo sapiens
  misc_feature (950)..(952): n is a, c, g, or t
gtaagacgaatggctaactagaataaccaatgcagagaagtccttaaaggacctgatggagtgtgaaaaccaagggcatgagaactacgtgaccaatgcacaagcctcagtagccggatttgatcacctggaaggacagggtctcatgtgatggaagactcacatgacactgaacactgcacgtgacgaccgacgaccgtttacgacgaccacaacacgacatacaaccaagaaacccaaacaaaggcctccaatgacatgtactgggacctacttgtgacaacaggacccagaatctacgtgcttctggactgtgggtgtacccttgaaacaggtgactggggggaagacctgggacactcaacgttgtggaacgcccactcttgcagggtattcatccaggagaacttccccaaatttagcaaggcaggcaacattcaactttcacggaacctacagacaaatgctacaaagatactcctcaagaagttgcacttccaagacacataatgtgtcagattcaccaaagttgcaattgacggcaccacattgtttaagggccagccagagcaggacaggtcgggttaccccaccaagggagcccatcaggataacagacgatctccttggagaaaactcttccaagcagaagaagagttggggccaatattcacacttttaagacaagcatttctaccagaattctatccgcgcaacataggttctacacgtaagggcgacaacactccttgtcaggaagccacggtgtgcagcattgggtccaccacggggcccaaaaaaagccttcgggacacactctgggggagaccagctccctcgctagcactagctttattacatctgcggaggattatagactcgcgactccttgggagaaacctattctggtagacggcagcaccattttatcaacagatagcagtagtagnnncccctgtcactcctctcttctatctactgctccacaatcacccagcacatagacagcccggcacctcacgcactatacataacacagaccagccgaccgcgagctacagagtcagcgtagagcacacacccgtt

SEQ ID NO: 491799 - DNA, 194 bp, Homo sapiens
gcttgagtgtccccagtgtgcctaagatcaagaagtactagtcgcatactgacatccctgcctatcctggtgagccgcggattcctgagcctttggtacccatgtgcagcgggatgagaagcttcagccgtaggacaggagcaggcactattggggctgcagagctgctcactctgagtgaatatcttgaggaa

SEQ ID NO: 491800 - DNA, 181 bp, Homo sapiens
gtgaacattcgtgtacatgggcgttggatcagcagtttgatttctctattataaatatagaccacatactccaagcaccaggaatttacattgggagaactacctatggcaggtctcggcgtcgggattactatgacagaggatatgatccggggtatgatgatcgggacacgaatgttca

SEQ ID NO: 491801 - DNA, 166 bp, Homo sapiens
  misc_feature (9)..(9): n is a, c, g, or t
  misc_feature (58)..(58): n is a, c, g, or t
  misc_feature (120)..(120): n is a, c, g, or t
  misc_feature (162)..(162): n is a, c, g, or t
atcagcttnatgaccatcacctgggacaatctgaaaggcaagaagtcctgccatacgnatctggcagaaccgctggctggaacatccccatggcctgctctacaataagatcaaccactncagatttgatgaatttttcagtgaaggttgtgccccttggtntaag

SEQ ID NO: 491802 - DNA, 628 bp, Homo sapiens
acctgtaggaatccaagatcacaccattgggctccactctgtatgtgagatcgtgaccctgtctctcaaaatcctaatagactcgtctactggtggaatcctatcttcatgcgctccaacaaacataggttcatggctcaaagagatgacgttgactgtgagctccgtgtttcaagagtgtgttaggagaccaccatgcgcgagctctattcctgtgtgaaagcctttagtagatgatcataattcactttgtagtaccttttatcgtggagtgtgcaggagaaggccatatttcaccaggtggacctagtggatccatttctgcggtacgcgcttgaagcctaaggagaattgtcaagtgacatgaatactaagcacggcagttttactcacatactaggcagatcatttcagtatctccatgcaaagcaaacattgtgtatgtagagctatatttaatgggttttgggagaaaattaggacagctatgtattttattacattttagaattctatacaaagtgaactgcataaatgctttgatgatgcttcagaaaccaaagtactttgcatgctcaaatagtgtcttatgtaagttgaaataaaatcgttactcaggtatagcttc

SEQ ID NO: 491803 - DNA, 91 bp, Homo sapiens
tggcaggtctaggcggaagggagtggagaatggggcctggttcctgcctgcagtgaggggaacagatgggacaataaagactggagaactc

SEQ ID NO: 491804 - DNA, 223 bp, Homo sapiens
atggcagtggtggggcacgagggcaggtggtggggttccctcaaagcactccattgacattcctgactgccttcatgtggcttctcatgtgggaatgagaagatgaagtgaactacacttgttcatacatggcgttcactgcgagacttgtgcgcgtatctccatcatggtcgtgagttgcatgcattttcccgtctaggtttaggaattagagggagaatat

SEQ ID NO: 491805 - DNA, 316 bp, Homo sapiens
tgctgtagggcaagggttcgcgatgtaccgtatcatttcagatcggaactcacgtcgttctaagggcatgctacgtggaatctgtgaaaatcagctgtgccactggcatgggcgactggcagcggttgggggaggcccaacattggacaggtccacggcgaaaaacggtggagcaggcaactgaagggcggggcagggcccagggggcccgcccaatccggagaggccgggacttggcctggaaaagaaagcgagaacaacaggcgcaagtgggcaacgaaagacggcgaaaggggggccacagaaaagggaaacc

SEQ ID NO: 491806 - DNA, 364 bp, Homo sapiens
  misc_feature (6)..(6): n is a, c, g, or t
  misc_feature (68)..(68): n is a, c, g, or t
  misc_feature (95)..(95): n is a, c, g, or t
  misc_feature (104)..(104): n is a, c, g, or t
  misc_feature (140)..(140): n is a, c, g, or t
  misc_feature (177)..(177): n is a, c, g, or t
  misc_feature (181)..(181): n is a, c, g, or t
  misc_feature (187)..(187): n is a, c, g, or t
  misc_feature (191)..(191): n is a, c, g, or t
  misc_feature (193)..(193): n is a, c, g, or t
  misc_feature (205)..(205): n is a, c, g, or t
  misc_feature (215)..(215): n is a, c, g, or t
  misc_feature (262)..(262): n is a, c, g, or t
  misc_feature (278)..(278): n is a, c, g, or t
  misc_feature (281)..(281): n is a, c, g, or t
  misc_feature (313)..(313): n is a, c, g, or t
gctgtngagaatgagttttctgtccaggggcttgatggtgaaggggtccagcacgcggatgttgtatnttttctttcttcagcagttcggcagcngccaaggcntcgtgcagggtcaccccagccccgataagggtcacntggtcatcgttgctcttcaggattattttggtttgtncganttggangtcntnattgttgttatngttgatggtnttttctgggggggtggtcgggatgaagcagataccctttgtattggnggctagttccactgcnttntttgtagcaacgccatcacttgggtaaaaganagttgatgtggggattgatcgaaacatagccagattttctagggccatccc

SEQ ID NO: 491807 - DNA, 173 bp, Homo sapiens
ctggaccggcacgaggctgcggcgggacaagaaccagcagcggtgcatgactccctctgcagcgatcaccccctccaaaaccttccctatctgtgggtgtgactttggacaaaatcaggcacatggcagatggcagttggatggggtttatatcctttgtctgtttttttgag

SEQ ID NO: 491808 - DNA, 1484 bp, Homo sapiens
  misc_feature (730)..(730): n is a, c, g, or t
  misc_feature (830)..(830): n is a, c, g, or t
  misc_feature (871)..(871): n is a, c, g, or t
  misc_feature (905)..(905): n is a, c, g, or t
  misc_feature (912)..(912): n is a, c, g, or t
cggtgcctgacagtgtacattcgtgctacgtagtgtagtagtagtagtagtagtagtagtagtagtagtagtagtagtagtagtagtagtagtagtagtagtagtagtagtagtagtagtagtagtagtagtagtagtagtagtagtagctacagtatcacgacgagtctgactatcacgctcatactcactatatacctactcgtcgtagttcttccatctatctctactacgattgacaattgctactctatagatctcgttgagctaactatactgctgaatactatgtcctctcagcactactatgactctgccactatacttactcgttcaattgtcgcaatgactatatctacacatactctagctgattgatgagttattactctgactaatctctcatacactctgtctaacgcatgtatatacctgattactactatctcgatacgctacatacatcctgctctctctactacttttgtagtctagatctcccactgcaattacgtctactctgcatcaattctatatatctctatctacttatctcactgctatcttgtctgaaagttcatatcttgattcaattgcttatatgacttactgattgtcttctaattgtatctgactcatctatatttcacattgtacttctgtaattcacattgacatttgtctcctaactacacattcatctaccttcatgtgtatgacacacgtcctnctaatcaaccttctctactcacatatatacatcttatgtctacaatgattatcgctaccacatcacgtactcactagtcctcttatcatcttgcaattangtatcaatgtcgtacgtccattcgtctacgctctatacatntcattatgtcctcaataccatcgttaacatcttntggctancactcttcatactcgactagacatctgcccctccctcacaatatctgcgtctctcgcgatctcatctcacgttgtcatctatttctttacttccatacctatagtattaatatactaatcgtctagtctatgacatctcttcctagtctactctctctctctatatctacgtgtgacgtactcatgtccccactcgtgatctagtctctctacaacttatttctttcacacccttgtaataatcatggtgatactcacctttatgaccaatctacccccattctgtctcatcctctcttacgtgcctccttctaaaccactgctttcatcaatcctacgtcaacttcttttgatcgcgtacactctctacattcactatgatctctcctctatgatgtctcctttcatcctcgtctataatctcatcttaacctacttttcgcagttctctcctctactttctcattaatctaccatctctccttccgacctattcatctatccatatgcgttactgtatatccctctactattaatcatcatatctatccatcataacctcatgtccctct

SEQ ID NO: 491809 - DNA, 207 bp, Homo sapiens
atctttctttgagtgaccgtctgtgccggccctgtatgtccgtcacaggtgtctgagctgcactggccccggtgctgtcctcggggggcgcgtagccactcccttcagattccacaggtccatggcctcacttgtgtaacaaactcctaccaagtgtgagcaataaaaaaaaatgtggggtttttttttttattttttttatttttt

SEQ ID NO: 491810 - DNA, 163 bp, Homo sapiens
cgtaccggcaggtctgagactcctggtgtcggtgaaggctgcacatctgtgggcagaatccagatgctgaaatctacaaaatcactgccactgacttttagcctctccagtttgtcctcctccaagataagggctttcagaagagacctgcttgagctccctt

SEQ ID NO: 491811 - DNA, 199 bp, Homo sapiens
gattttttttttctccccctctccccaatgtatttgctatggcccttgctttttaccctccagaggtaagaggtagcagagtctcttgggatgagtgattcacccttttacttggcgaccaatgatgagatcaacaacaggtggacaataaacctattatttatggcagaactaataaaaaatccaaagccttgtaaaa

SEQ ID NO: 491812 - DNA, 141 bp, Homo sapiens
caagaagcacatccctttcccctattatcaacattcacttgcattagtatggtgcatttgtcacaatttttgtgccaatactgatacattattatcaagtaaagtctgtagtttacattagagttcagtcttggtgttgta

SEQ ID NO: 491813 - DNA, 160 bp, Homo sapiens
gagtcaatgaggagcagaaagctctaagtaacatctaggaacatgtatacacttcagcatttaggtcaaatacctaacaagctcttctctaaacacttctaactttagttgggtggcttctggcatagcctttatcagtggtgtcctcattacatgccag

SEQ ID NO: 491814 - DNA, 152 bp, Homo sapiens
caaacacagggaaccccatgactcggccctcacctaggcgtggagctgccttggtttgggctcgaagcagagctggaaagcgggattgttcctttggcccacatgttggtcctgttcccggtaagctctgttgtaaagaggttcacggggca

SEQ ID NO: 491815 - DNA, 273 bp, Homo sapiens
agcaacaccagccacccccaggtctccagctccacaaccctcagccttaagcaacagcagcaccagctcctccctgggtctccagattcacacccctcagattagaacagcacccctcctccctgagtctccagctccatgaccctcaaactacaacagcaacacgggctcctccctgcatctccagctcaacaactctcagacttgagaggcggcaccggcaactccccaaggctccggctccatgaccctcagatttgaataatggtagca

SEQ ID NO: 491816 - DNA, 415 bp, Homo sapiens
ctgtatgctgttcagaggatccctcgagtctgacatgtgtatgggaggaggcaatgtatgctggtgcatgttgaacacgcctcacactggagaccgtacgaaagtacttccctgagacatggatctgggatttggtggtggtcacctcagcaggtgtggctgaggtaggagtaacagtccctgacaccatcagcgagtggcaggcaggggccttctgcctgtctgcagatgctggacttggtatctcttccactgcatctctccgagccttcccgcccttctttgtggcgctcaccaatgccttactctgtgcttcgtggcgacggcttcacactcaaggccacgttccacccgtaccttccacaaatgcatccgggtcagtgtgcagctggaagcatctcccgccttcctatct

SEQ ID NO: 491817 - DNA, 284 bp, Homo sapiens
  misc_feature (18)..(18): n is a, c, g, or t
gttccacatgtgctaggnggccttagaattatgccccggagaccaaaggcacttcttacatgctggtggcaagagaaaatgaagaaacaaaagtggaaacccctgataaacccatcagatctcgtgagacttcaccatcacgagaatagcacgggaaagaccagcccccatgattcagttacctccccctgggtccctcccacaacatgtgggaattctgggagatagatacattaaaagtgtgatatggtttagctgtgcccccacccacatttcaacttgag

SEQ ID NO: 491818 - DNA, 996 bp, Homo sapiens
tcttttctgtcctgtcctctgtgttgtcgtgttttctccgcaatacttgtttttttgtttccggaccccctgtgtttcttgttctctcctctcggctctttgtctcccccctcgccccttgttttgctgactgggtgcgctagaaccttgccccctgcgttgggggccctttcctttgtgcacctttgcgcccgttgccggtgttcccaccttaggagtcagcttcttagttgcttagtcttcctattgtcgcgccctcggccctgccttgtcgtcagttttgtcatttgagtgcctgcgcttcctctcctagagaggccaggcatggtcgccgatttccccctcctcacttgcgccgtgttattccccgagttgacccgcatcgtttttgttggtctaccagcacggtacggagtctctattcgaccactcctcggcataggccggccgcccgttcttctatgtttactctccctacccttatgtggtacttcaagttctcgaccactcgcactctctctctgggatggggctatccactctcctcccccaccctgcctgttagatgaacactcctactctttccgacttccaacgcgtagtatggctcaccgatctactcggtgtacaaggataggctagagcaataggttataggctcattttgctacgaagactgctgctcctggctttatctcgtatttcgtctcgccttctgcatcctctccgcctccttccaagtcccaccccccccccccgcccctctccccccttcttttgcgatcccgcgtttctctctcggcacgcccgcgctggggtgctggttgtgcagatgtcagtttcacccttctttctggctggactccagtccgacatcctcggctcactcacaccctcgcctaaccggaaaacagccattatcagaaaataaaaattaaaaaaataaaaatagatcagaccactcgcgataatagaactagtaatagatttagatca

SEQ ID NO: 491819 - DNA, 379 bp, Homo sapiens
  misc_feature (241)..(241): n is a, c, g, or t
  misc_feature (276)..(276): n is a, c, g, or t
  misc_feature (289)..(289): n is a, c, g, or t
  misc_feature (311)..(311): n is a, c, g, or t
  misc_feature (358)..(358): n is a, c, g, or t
  misc_feature (374)..(374): n is a, c, g, or t
tgtgcagtgagctgagatcgcgccactgcactccagcctgggtgacagagcgagactccatctcaaaaaaaaaaaaaaaaagaaaccatgcctgcctaatttttgtatttttagtagagatggggtttcaccatggtggccaggctggtttcaaactcctgacctcaggtgatccgccagcctcagcctcccaaagtgtcgggattacagctgtgagccaccgtgccctgcctcttccttnactttttgaaagacactgttggccagatatttganttcttgggttgantgttttttgttttttgtttttnaggaccgttttctgggcttctgtttggcactccagccggggggttgnacaggaggcggagganttcca

SEQ ID NO: 491820 - DNA, 138 bp, Homo sapiens
catacgccaccgcacccagcctgcccagctaattttcaaaaattttttgtagataccgggtcacactttgttgacctggctgatcttgaactcctgacctcaagtgatcttcccagagtgctgagattacaggcatgc

SEQ ID NO: 491821 - DNA, 1023 bp, Homo sapiens
ggtgacggcccgtttgcagccgccggagttactgcaagggcaaaagcctggagtggactgtgtcttttgaaactggctgctctttcacttctcaggcgtcaccgagagctcagcacccaggctgaactctgtaccattttggcacgactgggagctgatgcatctgtggacatgtttgccaaagtcctggagcatcagctgcttcagcactaccaaactgggtggcaagaacatttggcattctgaaattcaaaaactgggatcagcatggcatgagcgcatgactgggcaacgccttaacagcaaaagcagactccaggcactaaggaaagctcaacagcagaaacaagaatggctttctaaaggacatggggcactccagagaaatccctagtgcacagcgactttgctcaagaagtcacaggcagagtgacaatgtggttggccatattctacagagacttccacattcaggtgtacacatactagacagacattctggcaatactggtccaagaacaactcgagaccaaattctgcacgctgaatgtggaacaaagcaccttttgcttttgtgagcagactgcattttcaaagttcatgccgaaactagcactggtaacaacgcatggggacaacacaagagtcatgtgtgggttacttaactaggacataccgatgattcaacacgaaacttacactggaggactcgcatctctgacatccttattaccggggactttactggagccacaatttcagacccacaggtattggggacaaccttcaaagcatgaacgcaccttcggggcacccattatccaacctgcggagatagcccaacaactgtggacggcgtgtccccgtagaccaacgggtaaaaactagcgacacggggccacaacaatactgagtaatcagtgccccacgttgtggggcaacatgagaccatactggcggacatcgactactaaaactgtaacgtcactaccctctcccttggtacttgtctggtgtctttgc

SEQ ID NO: 491822 - DNA, 929 bp, Homo sapiens
atgtgtgttgaaagaagcgaaaaggaagaaggagaggaggtgaaacagaagcacgcgtgagaacgagaaatgaactgctccacttttgcgcgcaagtggttctaaatcgagtggctttctttgttgttcgtttctctagcatattgctgcgccgttgagattgtcccgtgcttaagttgatcataatcacgcgttggcgcaatcttcgtggttatttcgtgtgtgtatgattggccatgcatgtcgtctagcgcatctataatgcaggtctgccacgcttgtgggctaatgtagtcataccagtggtttgatgcgtgtccccgaagctcggtgggcattcatgtcgcgtgatgtccgcgctcgattatcttgatgcatgccgaggtgcgccctgtatcccgacggacgtccggtcatatttgtgcccatagctgcaggcactcgaagtagtttcccccctcagatgaccctggccccgcgcgtactctccttagggggtccgtcccccccagctgactcctgggcggggcagggctccccggaagtttccgtctcgccccgtggctcgccgctcgtgtccacgccgtgctggcagtatcatcctgcatgcgctgtcagcgcccccgccgcctcgttttccaggacggagggactgcgcggccgggccacacaaaggcggatcggtcttacccgcccgacggcgcattgatctaccacaatcgcctcggcgtttgtggctggcacacccccccccagaggagcagcagctccctcccttcgtccccgcgcgttccatgtgtgggggagggtgggggagcgcctccattgcctcccccccccggcaggactaccgctcccgcgccccccagaaagacacaaaaaagaacagacacaacacaaaaaacaaaaaaaacaaacaaacatgacaa

SEQ ID NO: 491823 - DNA, 131 bp, Homo sapiens
atggatgtcgtcagaagatgaagaggaggaggatgtgaaactcttaagtatatctggaaaggcggtctgcccctggacggtggtagcaaggttccacagaaaaaagtaaaacttgctgctgatgaagatga

SEQ ID NO: 491824 - DNA, 876 bp, Homo sapiens
ccattcactcatttcttatatttgggaaacacttcatgtgagcgccgtgctgctgtgctgggttattgatgcttggcttgatggtgaaagattctctccttaaccaaactctaatcaggctcctctgaactctcttctcgaatgtaggtccgtgacctttgggacttccttgttttatctctgtattgtctaattttaccaatgaatcctgtcgagtcagtttaatgttaatcctcgatatctgatcgacccgtacactacgctgaccaggttccattatcctaccatacatcctcctgggtgatgtctgacacgaacctggacctgccttcaggcaagaacccagtgtaggattaacctctttcactcctattgttctcttactaaagtaatttttcacccaatgaccacgcttccgcaccaacttagggtatacattcccatcttcttactttgcgtatcttcatagttgagcccaatctctcttccctattgaatatatcccgattgcgagtggtccctacggctatcatgatggtcctgatagaagtctgccttatcatcttacacgtggtgtcatgaactccttgcgtctttacatggtgagtatgcaagttgcactaagacaactcccatgggtatgagtctgactatctggcgattgatgctatgttgagagctctgcggtcccttcctgtatggtactttcgtcacctgtagcagaaacaggggtaacactagcctgcaaattctctccaatacacgcgacagacaaacaaacgatttttggcgcgccttgaccctcgagaacttcaaaactgtggttggactcgggtcccccaggccatgtcagcgggtccaaggtggcccaaggag

SEQ ID NO: 491825 - DNA, 225 bp, Homo sapiens
  misc_feature (74)..(74): n is a, c, g, or t
ccccccccccccccccccgggggggggggggggggggggggggggacccccccctttttttaaaacccccttanaagggcccccaaaagggggggtttttttccccccccctttttttttttttcccccccaaaaaaacccccccggggggggtgtggtttccccccccccttttttggttttttttttttttttttttaaaaaaaaggggggggggggggggga

SEQ ID NO: 491826 - DNA, 327 bp, Homo sapiens
cggaagcacactgcaacaggacatacattttctcacatgcaaaaacaaatcaaggccaggcgtggcagctcacgcctgtaatcccagcactttgggaggccaaggcgggtgaatcgcttgaacctgggaggcggaggttgcagtgagctgagatggcaccattgcactccagcctgggtgacaaagcgagattgcgtctgtaaaaaaaaaaaaggaaaggaaaggaaaggaaaggaaggaaattgcctttgtggatggacaattccctggaaggcatataaaaaactgggttaactctgccctttttgaggtggcagggggcttccg

SEQ ID NO: 491827 - DNA, 341 bp, Homo sapiens
ccccccagttcccctttagaacagcatggggcacgcttatgcctgtggaattccccattccccacctgcctgcctcggggcgcagcgttaaggtccccctggaggtagcagttctttcagggccctcccttgaggacagggtaggccttttcctgtctgccttttttttgcttgggcttttcaaggcactgggctgggctgctgtttacctgtccccctgcaaggattcaaaaaaaaaagcaaagtgagggccctccctgccatcctgtggaagcccccatcatttttggcccaagcttttgtagtagctccctaaaataatcccctatcttttgctccta

SEQ ID NO: 491828 - DNA, 103 bp, Homo sapiens
  misc_feature (2)..(2): n is a, c, g, or t
tntgtacgacggacctccgacactgacacgtacgacggacggggtcttaccgtcggggctacttttgcccctgacacacgtgggtccgtgtggccctctactg

SEQ ID NO: 491829 - DNA, 834 bp, Homo sapiens
ggtagaagcgctggtaggccttggagaggcgggttaggaaagacgcagggcccctcgggctaccttcgatcgtcgcgaattcacgagcacgtccttccgaggtgaaggaacgcgaaactccacccatccgatgctgtacggctgcgggcgggtcctttggtcgggcgtgacccgtgggtgagcggaccggagccgaagactcgagagtggtacgcacgtgctgcgacggactctggaaccatgaacgatatttgatcgaaagatcaactttgatgcgctttgcaaaattttctcgatataaaccccgtcaaccgcagcagcgacctgaaggaaggtctcatgcaagttatgccctattgtatgtttgtggcggctgcaggggcctatgtccatattggtcactcatgttcattcaggctggcctgctgtctgccttggtgctccctgcatattgatgatttggcctgatggcaacagcctcatagtccatgtaacactgaacagaaaagactggacttctagctggatttgcattccttacaggagttggcctgggccctgccctggagtttgtgtatcgctgtcaaccccagcatccttcccactggtttcatgggcacgggtgatgatctttagctggctgcaccctcagtgcactctatgccaggtgccgtaagctacctcttttctgggaggtatcttgatgtcagcctgagcttgttgctttgtcttccctggggaatgtttctttggatcatttggttttcaggcagactgttgtggacctggggtaggtgtggggtccgcctttgactcatcatttgaagccgattg

SEQ ID NO: 491830 - DNA, 105 bp, Homo sapiens
  misc_feature (1)..(1): n is a, c, g, or t
ntctgagaatgagtgtgaggcggctatggtataatacgcctcacactcattctcaactcccttcccctactcatcgcactaatttacactcacaacacgcctagg

SEQ ID NO: 491831 - DNA, 548 bp, Homo sapiens
  misc_feature (77)..(77): n is a, c, g, or t
caggcagatcacgaggtcaagagatggagactatcctggccaacatggttaaaccccttctctactaaaagtacaanaattagccaggcatggtggcacacgcctgtagtcccagctacccaggaagctgaggcaggagaatcgcttgaacccaggagacagaggctgcagtgagccaagatcacgccactgcactccagcctggcaacagagcgagactccttctcaaaataaaaaaaaaataataatctttggctgggcacgatggctcacgtctgtcccagcactctgggaagccaaggaaggaggattgcttgagcccagggtgtcaaagttgcagtgatctatgaccttgccactgtactccaatctgggtgatagagcaagaccttgtcttgaaaacaagataaaacaagataaaacctttccctcatcaaccatttgcccaggaaagaagacaattacttggggttttgtttcctttgtttaccagttttcagaatgagttggtactatattaaacaccaaagaattttaaacataaaaaa

SEQ ID NO: 491832 - DNA, 1128 bp, Homo sapiens
ggcaacctttccaatggtgagtggttgtgtgatcgccatctgagggaaaagatgttcgtcgtacgtggcgcacctggacgcggtgcgaatccctcgtttcaaggatggtccatatcttgcaagcatgtgctgcactgatggatcctccggggaccgtccgaaggcaagcatcctcgcagtggcctcaccgtggctctagctcgccgacagtcctcgtcaagacttgtgctagttgcagccgcctgtgcatagtagtagcacgttggtgagcttgtggcgtccttgcgaaggtattaatgcaactgtggtggcatttgtgttgggggtcttaatgttgttggatctttacaggagcagctggcttgctggcttcctctctaggattatatgccgaaattagaccagataatgcattggtgcgagctccctggagaggtagcacaggggctctatataagcgggatgttcacgagtgccactatctgtgtaaagacggcaatgggtgctctcggttgggctctagggcttcaacgggtattggggccatccggaactctatcggcttcgagtctcagctacccaattggccatgggcgagcatacctagaacgggaaaggtcactgggtcgactatcgaatgggacaccgctgctctggcaagagggtgcatataggtattaagcgtaatcacttgcgtgtccggacggaagaggaaggatatcaatatacttcctcctagggacaggtaggaggcatttccagtcctaatgtggcctaagtcgtctttgggtccgaattgtttggaaagaacccttgtgtgcgtgcgtacgattaaaaggcccgtggtccattcccctcattggatagagccttggtggttgaggggtagctaaacggtaaatttttccacaaacaaggctacgggtcgagggctcttcttgggccaacacacagttggtgtcggagggcgccgcattggccacgttttcatcgaaggggagtctgtcctccaaagttgtaaggcaaaggcgcgcccttcattctttgcaattactacaaaccagggtgggatttgctcaccttttcctgggtcctcgaggaacaagaataagccattaacaacccatg

SEQ ID NO: 491833 - DNA, 702 bp, Homo sapiens
caagagactagctagtagagctgtttaaattggacgagggcgaggcagcgttcccgggactcgctgctcaagttgtctattgctccgcacatcatcctagcagggcccgtcgcccacaggcggacaaaagcggtccgtgaacaccatgcggcgctcggcgtgccgccaggctctgctggtgagcgccgcaccccgcgccaggtcccgcgagcccgccttgcggcacctcgccctgtcccagtctactccaggccccgtccgccccgggggcgccgcccacgggcctcgctcgggccgttgcctgtctgcacccagaccctgagccgcgccgccggccatggaggtggcgcctgtgagcagccgcgctggatgggcgcacccggccgtgctgaatgcgcaagcaccccgatcaaccacccggggctggcgcacaaactaatggaacccggcagttgttggctccagacggagggtggaccgtcttcttcaatcacctcgacttcgcagggaaacccccatattatggccaaccccggtcacggcgcgggcgcgcagtatcctacaggccccgggcaagcccggcttgaccggaggaccatatgttccggccacattttgttgcacagccgggttttgcctgttgggcggggaaaaggagcctttttgcggtggggccacacaatccgggagcggagcctttca

SEQ ID NO: 491834 - DNA, 1093 bp, Homo sapiens
ggatttacgggatcggaagtgctgggaggccgcctgggagcccgttcggttgcgggtgtctctggccctgcggtcagaccctgggaactgtccctggagagctagattcctagagtgcccgattccgctagccctggaacagacaaatgccagcgctcccgcactttccccgacttaggatcctgatgccggcagagtcctggggcccccgtagcggggctggaccatgagacctgctggacggactcgacttcctcgacacgctgggctccgatgcagtccagcaatggacaggatgaaaaagcatccacgaaggaagagccagaatgagaagtaccggcttgaagtacatgcgtgctgatgcaaaagtggtacaggtggccatcggatggtatggaaaaagtgcgtgctataggtgtgactgagaattgatcgaacgttgaagggaagggtttgcttgagaggcacgaagcaagacaggaagggtagcttgacgtaaaggaaagctcggatagcagacatatccagaggagaccaaacagcatgaacagggaagaaaggaacaccaaggggcgctgaacggcgaccctgtttcgccagcaacgagtgcacagcgacgggaccccaccgtgaacaacataagtgcgtgggtggcccacagcacttcctagctgaggaaagcacaatagaaaaagagggcacgcatggggtgccgaacaaaccagacagacacacagagcaaacatgagggaagaactgacagaagcaacaccgccacacacgcgggcagacgaacaccgaccaccaacaccgcgcgaacagaacaccgcggcaacaccgacgggcacacacaacagacaggcgcgaaacacaaaacaggggcagcagttacatccaaagcgaagacagccaaatcacgacgaccagaaacggagagcaggatggaaacgaagaaaggcaaggggaccgggacaaaaaccgcagaaagagagcagcaaggcgcgccgggaggacacccaccaaagcaggcgacggcaccgagagaagaccacacacgagagaagaaggcgaagacaaaaaccgaccaagaaga

SEQ ID NO: 491835 - DNA, 218 bp, Homo sapiens
ggcgggggcggtgggagctgacaaagctgtccagtcccataggaagctgctcctccagtgaggagcaagctgcacgcatgggtcactgctcctccttcgaggactcctgcgagatgccctgctcttgctccttctacagtgtttgtgggtctggcccttggtttccttcctggagttgtggtggttttccgggtcttggcagcacccttgtttttgct

SEQ ID NO: 491836 - DNA, 538 bp, Homo sapiens
  misc_feature (5)..(5): n is a, c, g, or t
  misc_feature (61)..(61): n is a, c, g, or t
  misc_feature (70)..(70): n is a, c, g, or t
  misc_feature (100)..(100): n is a, c, g, or t
  misc_feature (115)..(115): n is a, c, g, or t
  misc_feature (118)..(118): n is a, c, g, or t
  misc_feature (123)..(123): n is a, c, g, or t
  misc_feature (133)..(133): n is a, c, g, or t
  misc_feature (136)..(136): n is a, c, g, or t
  misc_feature (158)..(158): n is a, c, g, or t
  misc_feature (218)..(218): n is a, c, g, or t
  misc_feature (225)..(225): n is a, c, g, or t
  misc_feature (516)..(516): n is a, c, g, or t
aggtntgtggggaagtgcacgataaaccgttgtgtttgctttttggttaaagaagagaaantttgtgatngatatgccggctgcgataagtgaaagtggnaaagaagaggagctngantggcnttgatctggngtnttggcatctgctctgccatttnatatgcgcagtttatttgggttatgctaccgtgaccagcagaacacctgttagtaaaaanaaatgtnagggaggaaaaagtatgaacaacagggagctccagaggcggctgcatgcgggcgctgggctcagtagaagcagagggtgtgcagagaggtgcggccactgtgctgctcgaactcctgcggcggcgcgtggatctggttctccatgttttccgtgtgcgggatacactggcagagctcacagatgagagaggcccccggggtggcctcctcgtggttgtgctggatgtgcacattgaccacgtgcacgggctggcaggtcttctgtgctctgggatgcagatcttccaccanctggtcatacactctctcttcg

SEQ ID NO: 491837 - DNA, 621 bp, Homo sapiens
agcggagcagcctgcaagctgggagcttgcatgggtgaatgccgcagaaactgaggactagacattttcataatggtggctccatcttcccttctctgccagccacgctgtatcctaaggagcagaccagatggggctgataactgaaaagcccatttgcataagattagggtaaggtgaccacgccttgccccatgtgccatgtaaatgtcatacctaattgaaccaatctgtgagccctacataaatcagacaccacctcctcatgccagactaaaacaatcggtgcattccctgccagctggtgtttgtttcttctccatcctttccgcatggtcttttctgcttggagaacccttcctctatggaggaagctgttcctctttctcttctcttctacctattaaacctcatgctcctaaattccagcctgtgtctgtgtcctaaattttcttggcatgcgacaacgaacccctggcattattcaaaggcttctggactgaatcccagcctccgacagtgcagtccaggtgtaggtgaaaggatctccaggcgtatcctgtcacaaaactttcctttcttttctatccatggtcagttatgtctccgtatgcgtctccg

SEQ ID NO: 491838 - DNA, 277 bp, Homo sapiens
cgcactagaggatcccctctggcacacaggcttggagaccatgtctgttggtactgtctacatctctcaatggggaatccattctgtgttcacaggctcatagctcgctgtcagtgaccaagtcagtcgcttcctcgtccttacttgaatgctgagaactgtgatgaaaatggcattgtggtagtgcggtggacaagaaaagaagtgtgccgtagtgtctatgtgaagatatttgcgatcctccaagagcgactgagagggggtatggagctcgaat

SEQ ID NO: 491839 - DNA, 103 bp, Homo sapiens
  misc_feature (92)..(92): n is a, c, g, or t
  misc_feature (94)..(94): n is a, c, g, or t
ctgctgtcccccgagctgctctacgcgctggcgcggatggggcacggggacgagatcgttcttgcggacttgaacgttcccggtgccttccnantccatcgta

SEQ ID NO: 491840 - DNA, 120 bp, Homo sapiens
gcggggttatcacaaggaatagtgttgtctaagccacagggggaagctgcctgtgagtatttccaaaaaaattctgtaattcaaacccaaaatgtctgcggaatcgaccagttcgatact

SEQ ID NO: 491841 - DNA, 150 bp, Homo sapiens
aatgcctgccatcgctgcctctgccggcttagctttgaccagagaggcgaggtttctgttacccgacagaatatggcgctgctcgttgccctctcgcctgctctcctctgatagccggtcgtcgaaggttctgctgcgtacctgctcggc

SEQ ID NO: 491842 - DNA, 372 bp, Homo sapiens
cagagcgtcatggacgttgggtctcagaaggggggacgaatagcatggcccttagtgatcgtcaggccgtccaaagcgggatgggaactacaccagtaggtgtgcgggggatgttccagcacacagatgcagatcctcagcttccataatggcatgaaccagtcggtcataataactctctttccataggacctaggggattctgtttctcaggagaaccccgggttacatcacacttaaggaaagtaaattgacggagttccaaggcagctaagataatatggaggtggaatagtaaagaatggaaggtcagaatgctgatccatgacaattaacccaggagcaaaatttaaattactccttgggccagag

SEQ ID NO: 491843 - DNA, 184 bp, Homo sapiens
cggtacttgatcgggacaatcctggcgatcaaaatcatatcagtatcttctcagaccacaattgaataaaacaaatccataacaagaggaacttagaaactatacaaatacatggaaattaaacaacatgcacctgagtgaccactggatcaatgaaaaaagaagagataaatttcttgaaaca

SEQ ID NO: 491844 - DNA, 794 bp, Homo sapiens
gccacacctctacatgtctaaaacaaaaaacaacaacaacagataccccactcgccactatgcccaaaccctctggatgctgaaaaaaaaaaaagtgtatgcaaggctattatttaaaaatggtgtaaaaatggctattcctttttccctggtaaaatattggcagtttataggttatttacaaaatgtaagcttgggtacaaggctggacctttctatagcggtgctggcattgggtaaatggaaaaaaaatgggggcaaacgttgggagtcctttccttgtaattggccagcatcagcttaaaaactccggtatgttacattatcggtaccatttaaatctcttcaactttcttggtaccttctgggctggtatggcttcctctttaaaccttttaatattggtcatttcatatttaacatttctggggtatataatggtaaaaccacaatttttggaattaaaattttaggttcctggcaggcttggatttacaatagagggacttttactgggcaccttggcattctcttccaagatgctttgtacctcagaggggaccggtcagacacaaagttaaattaccttaagaaacaagagcaggccaagtggccctaattacattattaccatttggagtgtcctactccattacactatgggtaccagtaccattttggggggttccacgacaagtttaaaagtccaccgtggtttcctcaagattgtgttaacattaaaacccaacagtgccagttcctggacatggtacaacaacaccgacacacatcaa

SEQ ID NO: 491845 - DNA, 328 bp, Homo sapiens
  misc_feature (313)..(313): n is a, c, g, or t
ggactaattaactaaagaggttttgtacagcaaaagaaactgtcaacagagtaaacagacctacagaatgggagaaaatattcacaaactatgcacccaacaaagctctaatatccagaatctataagaaacttaaaccattgaacaaccaaaaaacaaacaaccccattaaaagtggacaaaagtcatgaactgacacttctcaaaaaaaagacatacaagcagccaacaagcatataaaaaatgcttgatatcattaattatcagatgaatgcaaatcaaaaccacccaagtctttttcttctgtctaggntaatttattttaggg

SEQ ID NO: 491846 - DNA, 107 bp, Homo sapiens
  misc_feature (77)..(77): n is a, c, g, or t
gctaaagtggctctcccaaacctgcctttgttctaactcagttgtctgtgaatctcaatataggtaccgttaggccnttgtggatattggaggcccgttcgcggacg

SEQ ID NO: 491847 - DNA, 673 bp, Homo sapiens
  misc_feature (409)..(410): n is a, c, g, or t
  misc_feature (421)..(421): n is a, c, g, or t
  misc_feature (426)..(426): n is a, c, g, or t
ggctgcctgaccccgcatacacgtgggctgaaaagaggttaaccgctgcatcgcgacgcgcccgtggccagatctcctggtggtgatccagtgtccagatcttcttgttccgcttcttcatggttttgcggtggctcagggcaatgatgttgagctcgggcttgtgtcgccattcctgtgtcccgcaggcactccagccggctctgcatcatgaacctcgcggccttccgctgctcacgggcccggatcaggtgctcttccgctcctccttgctccagtagcggcccatcttcattctgctcaccgcgtcgtcgtcggtcgtcattcacctgcgctctcccggatcttcagggcacgggctttcagcagccgatctcgcacggccgcttggccacgtagcgggttccgnnctgcgcaccgnacgtnccactccatgccggtgcttcagtgccgcggccagccacccacgcccacccgagggccaaccaggccaagctcaggggccgtggcccagctcctccaggcatcgcgtcgggccactgcacgcagctgtggtagtgctcagccctcactggccctgccgcggtggcgccgcgagaggtaagggctgctttacagggcccacacgctccaggtcaaccccgtcttgggtttcgcgccgcgctcctccgcg

SEQ ID NO: 491848 - DNA, 163 bp, Homo sapiens
  misc_feature (1)..(1): n is a, c, g, or t
  misc_feature (5)..(5): n is a, c, g, or t
  misc_feature (107)..(107): n is a, c, g, or t
  misc_feature (135)..(135): n is a, c, g, or t
  misc_feature (158)..(158): n is a, c, g, or t
ngganataataccaaccagaaattggcatttataaacctattaagagactttaagcatgcttcaagaggcagttgacccactcgaattcctataaggctggtacccntcccagagttacagaatcttaggtgccnctctctagtctgtgagggagganctcca

SEQ ID NO: 491849 - DNA, 977 bp, Homo sapiens
  misc_feature (973)..(973): n is a, c, g, or t
tggcaaacggatgatttaatgaggggtgaaaagcactccgcaggtgcgggcagcggcgggctgcggtcggggcccagcaccggtgggagcggggccttctctggcctcgcgcgcgggggacgcggccctttcccctccggggggacgcgcaggaggcaccgcggccccggtttggaacaaacgcgtttactgcaggcaagggcggcgggcgccggggccggtctcaccagggcgaaaaaggggtcttgaccgtcctccttggaaaagtctcgcacaggcagttgaagcagcagcaggcgattcgcccaggaatcttgggggggcaccagcgttgcgcatgaaccagctttggcgccaggcgcgcggcccgcggtctgtctgttgccaggggggttggccgccgccaggttcgggcccgcgtgttcttcagagaattcgcgaaggtgtttgatgaaggaactcgccgtgaaagcgccgcggtgtttgtccccgttctcgcgcgcgttgtgtatgcccccagggtttcttcccagggcctcgcgcgcctcaggggctcaaggttagcgcgccttggcgtcttcagccttcgcgcgccagattttccttcttcgttccagcggagagaccccggtgccagagagaacgtgtgcggtggaagagactctgtggcctcgaaactctattctctgcgggagaattgtttgtggggcccaccgcgtgtgaaaaagcctggtttaaaaagccccccgcgggtattccaacacgcccccctgggtggaacaccccaccgtggttagggcggccccacggagaatatgtcggggagggggccccccacacgcttgtggagaaaacgcggaaggacactttcgagaccccaaaaccccacacggcgcgggccgcgagttccccattttcattccggagggcgcgcccccgggcaacaaaaagacttctttgggggcaatccccnaatg

SEQ ID NO: 491850 - DNA, 731 bp, Homo sapiens
gcattggacctttcgcccggcgcgcgtgtgcctggcgctttttccaagcagctgggacacagacgcccaacgccatactaagatcatcgtgggacgtggttagagaccgggttcaaccgcgttaggtcaaccttatctggacctgcggacctcaggtgatgagccggacttggcctccaaaagttctgtgattacaggtggtagccaacgtgcctggcctcattaagattgttaatcatcgaatggaaccttaatagttttcagcagtgatgtctatatcaaggcctggtagactgacaggaagccttcattccccacagggatcttaccaagtgtggaaaaatgggatatgggaagcaatcaagataacagtggatttcaaagtgtggttcctggacccagcattattagttataccctggcacttgctagaaaggcgaatcatggtccagcacgtgactcacacctataatacctgcacttttaggaggcacaggtgggaggactttttgtgcacagggttccaagaccagtttgggcaacactagaaaaaccccaatctttggaacatatctaaccttagctggcattgttggaccaatgcctgtcggtcccagcttattctcggaggttgtacgcgaggacaattggccgatatccagcgcacctgagggctcgactggcgacaatgatagcatcccaccttacttcgcctcgggccatcatatgcg

SEQ ID NO: 491851 - DNA, 973 bp, Homo sapiens
ggcaagagccggcgccggaggagacgcgcgcagactgagttggtcttctccgcacgattgttacagaggtctccagaaggcttctctctcctgtgcacaaattgggcaacctcttaaggaaacaacctcatttgcccgcagatgccggaagaagaggcaaaagtgtgcaatacaataagatcactgtagcgggtgtaggacccagtaggtatggcgtgtgctatcagcattctgtggaacagtctctggaactgagtgaagcttggtcttgatggagtgtattggaagtataacgcttaatatggacgaaagtgactggagtctgacagacatggtgaggcttatatatcttcagacaccgtaaaagttgtggacagagtaatgacttattgctgtgatgcgccaagttctaatgatagtggttggctaaactgcgagtgaggtgccgttcagcaagaaggggaaagttgcggatcacatctgagttgacagagagtaacattgtatacatggtctttcaagattggattatgcctcagatcgtgaggtacagtcgtgattggatcataattgtggtgaccaactcagtggacattcttaacgtatgttacctgggaaagtaagtggattagccaagcagcgcgtgattggaagtggatgtaatctggatctgctagatttcggtacttatggtgaaaagatggattcatcgcagtagatgcatggatggatcaggggggaacatgggagtcaagtgtgggatgaggtggagcgggtgaattgtggcaagtgttactgtacagcgcattggattcagagattgggaaactgagatgctagtggagagtgggaaggaagtgttaagaatgaggtagaaagtggtatgaagtattaggctcacaggatacaatgggtatggaaaatggggggagataaggagagagatgaaaaaacacagattacgcagggtcaa

SEQ ID NO: 491852 - DNA, 277 bp, Homo sapiens
tagccttatctcccaaaatgctgggattacaggagtgagccaccatgcccggctggcagttgcatggaagagaacacctctttatggcttaccctctagaatttctaatttctgtgttctgttgaaatattggttcgtgttagcctttatgtgaaacaaaccataaagtcgagtatagaaacatatcttccggtattctgttgtcgaatgcaggatgatgtggcagcagtgtgctatatatcattcagataatcgttctattttgtaatcaacattc

SEQ ID NO: 491853 - DNA, 591 bp, Homo sapiens
ggggtttcatcaactcctccacttcttttcttttaacgttcagacagctttattttatcaccagagtttacataatacacagtttccatcagaccagcccccgagtccccaagaagtcacccacataaaataataataaataacagacttatataaatacagctgtctgagcaggaatcgggtgtctcaggaaccttgagcgcattccacagggcaggacaactgaggtgcgtcccccgcgcaggtgcacagtggaaggaccaggactgctcatatgcagtggcagtctttggctaacaagtcatcataggtctggaggacacccgggtggtctttgaatgagcacatggatttagctgcggcacgagaggcgtgcacgtgtcggcttcagcgtcaggtgtttgattgggtgatgttgcgccgaactgctggcagcccgatgcacatgtcacttgcactccgtgcgcacacccaatcgcccagcccaggtcttccaggacgcgcggaccgtgtgcagacggcagcaacgcccgggcccgagcggacagtggtccccgttgcggcatctctgcggcccccctgctgcggacc

SEQ ID NO: 491854 - DNA, 246 bp, Homo sapiens
  misc_feature (20)..(20): n is a, c, g, or t
  misc_feature (68)..(68): n is a, c, g, or t
ggcccccgtgtcgggcttcnggcggtgccggctcgtcttgctctgcgcgtgcctgtttgccgcccggncctggctcgggcccgcgccgctgcccctggtcccttgcccctcccgtggcgacagcacccaatcgcccagcccaggtcttccaggacgcgcggaccgtgtgcagacggcagcaacgcccgggcccgagcggacagtggtccccgttgcggcatctctgcggcccccctgctgcggacc

SEQ ID NO: 491855 - DNA, 226 bp, Homo sapiens
aggaagtaatgactccacgagcagtatcaataccaaaagaacagaggagtgacatccaagagcagcaaagtcttgaacattctcagacttgtctccagacaagatggctgcctggacagctgcaccacaacgtcctggtggtgctgcttcagaacaggtaataaccaaaatgataaacaccagaaataggaagccaaacatgtaataccaccaggacagcagcacc

SEQ ID NO: 491856 - DNA, 904 bp, Homo sapiens
  misc_feature (63)..(63): n is a, c, g, or t
  misc_feature (73)..(73): n is a, c, g, or t
  misc_feature (79)..(79): n is a, c, g, or t
  misc_feature (82)..(82): n is a, c, g, or t
  misc_feature (107)..(107): n is a, c, g, or t
  misc_feature (109)..(109): n is a, c, g, or t
  misc_feature (121)..(121): n is a, c, g, or t
  misc_feature (138)..(138): n is a, c, g, or t
  misc_feature (145)..(145): n is a, c, g, or t
  misc_feature (148)..(148): n is a, c, g, or t
  misc_feature (159)..(160): n is a, c, g, or t
  misc_feature (170)..(170): n is a, c, g, or t
  misc_feature (173)..(173): n is a, c, g, or t
  misc_feature (193)..(193): n is a, c, g, or t
  misc_feature (195)..(195): n is a, c, g, or t
  misc_feature (231)..(231): n is a, c, g, or t
  misc_feature (233)..(233): n is a, c, g, or t
  misc_feature (238)..(238): n is a, c, g, or t
  misc_feature (241)..(241): n is a, c, g, or t
  misc_feature (248)..(248): n is a, c, g, or t
  misc_feature (272)..(272): n is a, c, g, or t
  misc_feature (279)..(279): n is a, c, g, or t
  misc_feature (301)..(301): n is a, c, g, or t
  misc_feature (311)..(311): n is a, c, g, or t
  misc_feature (314)..(314): n is a, c, g, or t
  misc_feature (322)..(322): n is a, c, g, or t
  misc_feature (325)..(325): n is a, c, g, or t
  misc_feature (338)..(338): n is a, c, g, or t
  misc_feature (343)..(343): n is a, c, g, or t
  misc_feature (345)..(345): n is a, c, g, or t
  misc_feature (348)..(348): n is a, c, g, or t
  misc_feature (354)..(356): n is a, c, g, or t
  misc_feature (358)..(359): n is a, c, g, or t
  misc_feature (361)..(361): n is a, c, g, or t
  misc_feature (364)..(364): n is a, c, g, or t
  misc_feature (366)..(366): n is a, c, g, or t
  misc_feature (372)..(373): n is a, c, g, or t
  misc_feature (377)..(377): n is a, c, g, or t
  misc_feature (382)..(382): n is a, c, g, or t
  misc_feature (391)..(391): n is a, c, g, or t
  misc_feature (398)..(398): n is a, c, g, or t
  misc_feature (417)..(417): n is a, c, g, or t
  misc_feature (432)..(432): n is a, c, g, or t
  misc_feature (443)..(443): n is a, c, g, or t
  misc_feature (813)..(813): n is a, c, g, or t
  misc_feature (844)..(844): n is a, c, g, or t
  misc_feature (895)..(895): n is a, c, g, or t
cggcttcggcgcggaggggcggcggccggggaggcggcggcggcggcaggattcccaggagcnatgttgtcanaaatcntantggtgtctgctccggggaaaaacancnttcaaggagaanataccgtggtaaatggnaaagtancantggctgtatcnntgaacttganaanattcctccggcttcaacccnanagcaatgggaaaatgagacctcagcttacccaaaantngtatnaanacgggcntgaggatgtggccaggcttcagtnactgganaaaagctttctggagcaaggtnatgtcacaanaancacctcanagnaagtggaaaaaanaaaanangtngcaggnnngnntnaanantgtacnntcancgaangcctggctntgctggnctttctttacttatacctntccatctgccggaanaaaggtagacnaaggagaatttggagctaattaacaagtgggccttccaaggggagagaatgattcacgggaaccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagcccagccccggagcagtacctcgtgctggaagagctcattgacatgaaccancaccatctgaatgccctcggcgtgggccacnctctctggaccagctctgccaggtgaccagggccgcggacttcacagcaanctgactggc

SEQ ID NO: 491857 - DNA, 260 bp, Homo sapiens
gggggtttggttttttcccccgttttgtgggggcccctttgaggtttgccgggggcccttaaaccggattttttttttccccttgggcccgcccccggttttttttaaatttgcccccccctttttttttttttgggtggtccgggggttccccctttgggggggggggggcttttttttccccgtgtttggggggtgtttctcccccgttagggttggccccccccctggttttaggccccccttttttttccccccca

SEQ ID NO: 491858 - DNA, 375 bp, Homo sapiens
gtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctcaaaaaaaaaaaaagaaaaagaaaaagaaaagaagtagaagctcagtggccagggattgggggctcacaccgtgttaattcccagcacttggggaggccgaggcagggtggatcactttgagccgagttccagaccagcctaggcaacattggtgaaacctcgtctctat

SEQ ID NO: 491859 - DNA, 537 bp, Homo sapiens
ggtgtcggtgcgtaaagtaactgacgagatatgtgtcgcgactgactgactaggaagatgtcttcaggaaatgctacagcattgggcacccgtgcccccaagcttcgacacagccgacagctgttcatgaccaaatggtcatgtttaagagatatcagtcgctagtcttgactacgaacggagcactatgtttgtgttcatcttttaccctcttgatttcaccttctgtgttgccccattggagatcatttgcttgcatggagatagtgggcagaacgacattctacaagaaactcaaccatgtccgaacgttgatttggatgcttctagtggattctcacttcttgtcatctacgcatgggtcaatactacctaccgaacgaacgtgccggactgggacccatgaacattcctttggtatcagacccgaagcgcaccattgctcaggataatgggcgtcttacacggcttgatgcccgtgcatctcgctcagtgcgcctttctatcatctgcatgataagcggtattcttacggcc

SEQ ID NO: 491860 - DNA, 286 bp, Homo sapiens
cactttccagagtagaaatatatgaaattgaaacagagcatatttgttcattattttaagcaaaacattacggatatcttaactcttggttactgctctcaggagagcacaaagctgttgaagcctatatacacagaacgtatttttcagtagtgactttaaccattgtatatcatgtcaatgagtgaacctgacaaccccatatttagtatctgcagaaagctgtaatacactctggcttaaacaatcaaccaacaaacatgtatttagtgcctactctggaaag

SEQ ID NO: 491861 - DNA, 942 bp, Homo sapiens
gggacgatggtcctgctgcgtgccgccttcttgctggctgtccgcctgtgttgtgccacctagttgagccgcctgccgcccctgtcctcacgagcatgaggagctgctagtgtggtgaagcggtctctgcccccgcggtggccctcccggtttcctggttgaagctaggcccctgtatccacgcgaagcaatggttttgataatggcccctgggaacaatatggcggggcttgaacagcgtagcatcctcatcctcgcatcctcgatggagaaccatggagctcatccttcgtgggtgccctctctatgggactcaggtacgggacttcaggttccgcggaggcgggttctcatgtgttgcagcatgacccttcgcgcaacgcagtaagcatgcggcagcgatcaactgttcgttgttggaaatgcatccctgcagggagcatagctctcagtctgacagacctagttgttggaactctggagggcctgtcgtgccttggcgagagagtggggactgtgttcttcagactgtgtccattcgacccggatgattcgcgcccagggtgttccggttgagacgcctacagtctgggatcttgcgctgggaaagtggagccatgaagaaggggtattttctcccgcgatctgaggggtcattccaactctcttcttgctcatggcaggtttgggggaggctcaattggagcatagacacctctgcagactattgtggaaaggaacctgcatggtttaccgtgaatgggattgcagggttttgcttgacttagttggcactcacacgtatacacgcgagggagacaatataaccgggggacaacctgtggcagagaaacacagaaaggagagaggtgtccaccacataaggtttacacactatttgactcttacgtgctctccattaaaaaaaacggaacaaacaga

SEQ ID NO: 491862 - DNA, 585 bp, Homo sapiens
actggcggggtgcaccgcgtcatgttcccagcatgcggtggggccagaacatgtccaggggagccaagtgtaattagggcgtggccgccccaaaaataatgggggccattcaaaggcagttgattttcccggcaccaaactggcggcaacagatggggtccgtgcagaaaagaatacgggccccccaataggagacaggggattctgtccgcccacattgttgggggtgcgccgcactgctttccacaaaatggttcaataatgggcccaaccgacacccatttttcgagacaaaaaaccacaaagtttccttgctgttcacaacaagaaacgcggatcactcattgtgtcaacatttcacaaaccagtcgttttgctctcgcagaccacattacagtgaccacccattttcgcggtgattaaatatatagtgcccttctcccaccgccttccattattaagctttttgaaagcaaggccaatgcatacatcttctttttaatgaactcctctctgtaaaacccatgtcgcaatacagggaatttaacgcaagtttgaaaaacaatcccccccaaccccaaaaaa

SEQ ID NO: 491863 - DNA, 367 bp, Homo sapiens
tggtgtgttaagaacttttaaggtctaccctcttcacaaatgtcaattacagtatatgacactattaactacagtcacactgttgtacattagatctccgaacttatttatgttgcataactgaatctttgtacttgaagtttcaacatctctccatttactcctttccctagcccctggtaaccaccattctactctgtaagtttgatattttcagattccatgcagtatttgtctttctatggctgcgttacttcacttagcataatgtcctccacgttcatccatgttgccgcaaatggcaggattttcttcttttttaatgctgaataatatgtcatggtgcaagtgcgtatgtatcacattt

SEQ ID NO: 491864 - DNA, 1315 bp, Homo sapiens
  misc_feature (336)..(336): n is a, c, g, or t
tatcatatctcatcggagttaaatctatgatattcttcccacaacgacttactactgtctatccggaatgccccgacgtcaactcggactaccccgatgctatacaccacatgacaacggtcctattcatctcgtagggcttcatttcattcttctgcttagcagcggtaatcattgattgaattgtgaccatagagtttgatgaatgccttacggcttacgaatgcgaaaacagtccgtaatatgtacgatagagggcctcttcccatgtaagccggggaattggactaatatcgggattgacccctcctaagcctttatcgagcacatatgcgnaaaaaatatcgcgtatataaatcgtgaaaatgctaaaaattcgaacaagatggcaagcgtaatacggtaaagctcatcaaaagactcggctctaacgctagacacaatccacctagtgggacccttcccatcggaactcattttttcctaacataaattcccagacagccatatcagcacgagacaaggaaacaccaattttgtgcttgcggcctcctacatgatagaccaccacttacaagttgctgtgtaaaacgcaacacaaggcatcggacaccagtgataggcaggaaaacagaggttccttgtgtgcctgcccaaagcgccgttaaacgagtacggctttccaaaggacagaacaggcacgcaaccacaatttgaaatccatttctcggggacatctggtggaccatgaaccccgttcagtcagttaacaatgcggtctgggcccccagcattatcaaggacacaacttgtccgccgcagcgaggcgacggccctataccctagcaactctgctccttttggaacagtacaaactttctgtctgccaagacaagaggggtcttcacagcacagctcggcgagcaccttggcccctggtgagcaaactatccaacgtatatacacattatcctttggctgtgagccaccaaatacgcagcataccgatctggacaattgcacccattttatatgatgacagccgcaaaacggacacagttgtgcaccgcacacaacgttcaacaggaacatcagtcattatacgcatgagacagagcaacacccattagagttgacaccatacagtttatattcctcagcctacggacttatccgttgtggacaacttgagcgttgcacaacaacaacccaaccagaactatccgtggaaagaagaccacacaccgataaaccacatattggtcaagatacactacttacaccaaaacaaatatatcaacccaccagcacacag

SEQ ID NO: 491865 - DNA, 211 bp, Homo sapiens
  misc_feature (183)..(183): n is a, c, g, or t
gaagcgaatgatggcacgaaataatcaccaccatcagattcccagagcctgtttctttagggcaggaacatttacccacacactgagttccccacctgtgagggacaggaggagtagagaaatctgggaaggtcggccatactgagaccaggcacaatgaactggaaggaacaccagactganaatcacaacatcatggtagaaccgacta

SEQ ID NO: 491866 - DNA, 118 bp, Homo sapiens
ctgcgcctccaccattgccctccttttccttctccacctgaatacgccatccgcacgtcagcactctgaaacaggctaccggaggaactcgggtggttggggtttggatttggcatcg

SEQ ID NO: 491867 - DNA, 747 bp, Homo sapiens
tacaagagaaacttcttaggtattataaaccatcaatgtaaaggatccacagtggtattgtattccacacttgctagctctcaagatagaaactgggagataatgaaatatatctgtgcagatattaagattgacatacacaaagaaacccatataaagtgtcaaagggcaaataattttgctctagatcacaaaactagttagcacaaggctaggattataaccagggtctaggaaaaaatcctgaaggtgatttaactgagtgttaggccctgtcaagccacctgttaaggctcatggtctttcagcactagcttcaagcattccaaattcaggcaatagcgtacaacggaaagcataattggacggggaatcctgagatcagagtccgtagttcggctttgtctcttgtagcaggattttttaaatcaggggcagctctcttctcccagtcccatgcgcatgaactctttcaaccttagtggtcaccaagcttgtattccattccttatatcaagccttgtcctgtcaattctcccttaaatgttagttgcgttccatttctaaatatttccatggccatcaccctagtaaaaagactattacctcagaccccggacttgatcttcccccaactttaagtgactcagttccttatatcacttgccacaagaattaacaaccatgtccatctttcatttctctgctgaaaagatttccactggttcccactgaataccaaataag

SEQ ID NO: 491868 - DNA, 561 bp, Homo sapiens
ccgtctaagaggacaggagggtctagagagattcagatctgccattaattactaatatccaggtttctcatcaacttagtgaatttacagaggctggaaagcacccacatctgtggtacctgggaatggtaggtaaatgctcgggttatgtggaaaaagctaaggaatatgagtctaggaaacgggtagctctgtcatgaactggtgcaatctggaacaaactattggctggggcctcagataccttatctgtaaaatggaaagcatggaactaacaataaaactaactatggactgagcatatactaagtactaagctcttggttatacactatatgtactttatctaatttaattctctgaggtaggtgatataactttcatttaacagatgaaactgcggctcagagagtgggcaaagtatgttaggcatagtcatggatgggataactattggctaagcatcttctatatatcttatgtcaagaggtaagggtagacatttagctctcatcctcaaggacctcacaacaggagtctcactagaagatggcgcctgag

SEQ ID NO: 491869 - DNA, 247 bp, Homo sapiens
gctagaggtgcagcagcaagaccgaccggctggctgaggtggagctgcgacttcaaggactgcctgtgttgagaaggcacaggaggaggagcggctcagtcggcgcctgccttgacatccacgagaccattgccatgcctgcgggcccaggccccacctgtcatgtatgtcatcaagacagtgtaggtgacattcgtccaagaccaagcaggccctcagctgattcccatgcccggagccagcacct

SEQ ID NO: 491870 - DNA, 734 bp, Homo sapiens
ccggacacggaggcccacttcagcattgaccagccactaaggaggccaagggggaggactgccacgagcccaggacgccgccgctgaccagcgcacccgacgccaccgaccggcacttccagcccgcgcgaccacaccgacacccctccccccaccacgcaccaacagctaccactagcacaaacaccacccacaaaccacgccccatcgcgcccctcacccccccggaccgcagacaagacgcccccgggacgccacgccagaagacgccaaccccaccgctaaacagctgcctcccggacccgtccctcacccggcaacgacagcaaccgcccagccacacaaccgccgcccccaacccaagccggcacgaacacgccgcgcgcggcccccccccacccacccgcaccacctagccacacagaaccccactaagccacccagagacgcccgccaccccgccagcgccgacgacagccgcagcacccaccaccgacacccacgcgcacccacccaccggccgacacccaccccacccaccgccccaggcaccccaccccccctaccaccaccccacaccaacacaaccgcacccccccgtacccacaccccatcgcaccaccccgcgtcaccacaacccacccccacgcacccagacccacgcacacaggcccacaccacatccaactcccccgacccgtccacctactccccactccggcacaccccgcccc

SEQ ID NO: 491871 - DNA, 1159 bp, Homo sapiens
  misc_feature (294)..(294): n is a, c, g, or t
  misc_feature (465)..(465): n is a, c, g, or t
  misc_feature (532)..(532): n is a, c, g, or t
  misc_feature (578)..(578): n is a, c, g, or t
  misc_feature (601)..(601): n is a, c, g, or t
agcggggggtgggctggcggacccataggtgctgaagctactgagtccaagtggtctggcggctgtcaggtggacccataagacgtccccaactctagggtagcattcatccgcagtctctgcgacgtcggcgtgatacgagcagaatggatagttcctgttcacggcagcggtgctcctgctctctggagtgtgagtgcagttgtcagtgcctcgcgcaggtgggtcactgcggggtgccgggggatggccatcgatcctgtcgtcggtccttcgagaggcagcagtgcgtcntcctatccccctgccccgttgtctgagtgtcccagagaaatgcaggcatggccggggccggcatgctaggtgcaagtggcgttgtcgtggggtaccttcatattaagcctggctactcgccaacaagtagacttacgcacgcactctgggtggttcatttgcgagacgatngtcggcaagcgccgagacgataaatctcaagcggcgtgcaagacttcacaagtgagaccgtctaganccagcctcacgtggggagtgcaccctggtgcgctgtcgaaaacatngcagcactatccatggcatcagncaaaggatctagtgccccgcatccttggagcggggagatctacatacgttcgcgtgggttgcaccttggggccttggctactaacactacgataacactctttacttcaggagacaagccaggcgatccatgggaacttatcgttcggacaccaccacgaatcatctgtgtgtgcccgacagagcgtggtgggccaggcaggcgggaaggtggagggtgcaggctgtcatgggtagccgggaaccaattgacccaagaggcgtgcgcatcctggacgccttgaggcgtggtcgggtggccacgaatggggcttgggagtgggaagccctagggttgtgacctagggtgccaggcctggttgtgggaagtggaccgacggtggcacccttggtgtggcgatgttggttcacattggtgtcgcggaatccagtgcgcccacggaggggaaggccgtaaggaccaaacaggcgtggcgcttggccaagggcttccttcccccaaaaaccaaccttggcaattccaaagggtattcccagcattgggagtttaatgaacccg

SEQ ID NO: 491872 - DNA, 1800 bp, Homo sapiens
  misc_feature (722)..(722): n is a, c, g, or t
acttcgagcgcgggcgtgatcatattgttctccccccactcgccgtggggggccgccccgtccgtgtggtggggctgctatagctcggtctgttttgttgtcggccctcgtttgatggccgtcttttgtcagtcacagcgggtggtgtgctgcgcctgctcgctggttgctgtcctttaaggtgctggcgcaccacctgccagcgagggttttggactggtcccgcccgccgacacccgatgcttggtggtctgcccgcatgcttgtttgtttagtccgctccccccccctgtggcccgacttatttgactccccccgctaaatgtatgcctgcccgtaatacggtcgcccccccctcgtgtgttaggtttccgcgggttgctcgtgagtaagtctcgctcccgggtgtgtcctcggttgtagtggttctctcagacgtagacagcgaacgtggttcgtccgcggctagggacggttgtgggttttgccgcccgaatgatttgttggcttgctgtgtcggccgcccacaggcgtgccgtctcgtcatgacgccttggtcccttgtgggggggcaacatcttaccaacgcgtttaatgttgtacatcgttaatagtctgtgcgtacaccacactgggtggcctgcctggggcctagctaaggcactctttggtgtctgaatatatccgacgagcccgcaacgacccgcggtgttttgttgtgngtgctgtggaatgacctcccccctctcgcctccccgcgctggatgagggaggaatgatggtgtgatgtgtatgctccccccccccccacccttctttgctctttaaaatagtagtccccctccagcaccacccctccttcattgtttgttcctcggagaatttctgttctccaccggcggtgtcacaacacccccccttcgtagtaaaggttttataaaataaaaatctttcctctgtatttatctcctcttatgaaccccaacgcggcccttctttccgccgcagaacataatatatttcttctccccccaccatatgagttttgtttacaacacctctatactctatcatctctccccgcgagatgatatcaactagagaggagcaccacacctctttgggagaataaacaaatatagcgctatatgggtttttctgtagagcgcctatatggagatgtatcacacacatgtggggcctcttctctatagcgggctctttatattctccgctcgttgggagagcaacacaccccacatatataatatgtgtaccacagtataggggataatattgagaccggttatagagacacacactccgagggacacattatatgtgttctacaccgcctctccggcggtactcgccacgatatatatgcactgtctgcgcgatatattctgccacacaccgggcggtctacagagagtatatttatataggctcgaaaactccgcgccaccacaactctccaccgcgagagagccacacatcatatgtagaaatggaggtttctcggctgccaacgctggctctctgaggcccctataggagtttcacttctctttctctttttcccaccgctaaggtggccctgaactggcacttgtaattatgcacaaactcactcacctatgagcactcgtaactacaccgagcaccgtatctaacgctctgtatgctcacactttccacactaatgtctctcaatcacaatataggaagctgtatatttgccactacacatataggaggcttcattcactgatttcccctattttcaggctaccccca

SEQ ID NO: 491873 - DNA, 881 bp, Homo sapiens
  misc_feature (83)..(83): n is a, c, g, or t
ggatcgaggtctacccttcactgctctgtgtcctcagcgtgtgtggcttcgtgacctgaagatactgggaaatccatagctanagatgccaggaccccctgaaagcctagacatggtgagagtgctgggtccgacatcacgagagaggggaaggagttgctcggaaccggtgggaagtggctgtggcgggactcaggcctccccgcagtcagctccacaatctgctccctgagttctccttgcccagctcggcctcagtctccttcagccgtaagttggcggctgcgccaacagccggggccccgggcgtcctgtctcttccctgcactgtgactgtgccctgcctggagtcctctctggcagttctgcacccgcagcgccgcgtctttctcagattgtgcggggaccacgggagggtcatcaggggagaatcctgacttggggtgcgggttcatgaatgggaagagctttggtccgtggggttcccagttgctattttctcctattaaaaatttatgggcgtcactgcaaaaatattaaacgaatgtaactcaaagagtggttctagaattgtagagcacccagctactggttcgtagctttcgtggtctgtgggagaggcttgaagggatacgtcttttataccatgctgatgaagaaaccaaatttactacttggttagggtacccgttacatggttttcctctactactgtgccggtttaacggggtgcaacacgtttcctggttcactgtcactccgaggcttaccatggcacgttaaccagttgcctgcacgcccggatctgtcggtcctcctgcaactgaggtatcttcgccactccggccccttgacgctccatctctgtccaccccacccac

SEQ ID NO: 491874 - DNA, 347 bp, Homo sapiens
gtatttaaaacggagcgggtaattataaattctcttccgggaacttctgactttctcacaatgggaatctttggacaagaattatcagtaaggggaaaacttggtgtagtggtcatctttcctcccatcagtgagatagatatgatgggagttatgtgggacggatatttggaaaaaagatttaattatagctattaataaagacatttaaactacggactatgcatttttattctttggggagggtttaaggtttatagtttaaagctaacggtggtttttaaaaaagtatctaacagggccgggcgcggtggctcacacctgtaatcccagcacttgggggtacc

SEQ ID NO: 491875 - DNA, 431 bp, Homo sapiens
  misc_feature (22)..(22): n is a, c, g, or t
  misc_feature (427)..(427): n is a, c, g, or t
gaccctttcaaaacctgtctgnccgtttggggtctgctggattagccctgttgccctgtttgaatccatgaaacatttatatgaaggtgacatccttattttgtttgtccctgttcaagaaaagtatcatctgttaggatagatgatacttttaaatcatccatttaaaatcagtcatttaatatcccgtgcatctttaaaaaatattgtagagcatgtacaattaataaatatatctttttttcttatttatttatttatttagagacggtgtctcgctgtctctattaaaaatacaaaattagccgggtgtagtgacgcatgcctgtaatcccagctactcgggaggctgaggaaggagaatcgcttgaacctgggaggcagaggttgcagtgaactgagatgggccaatgcactccattccatntatg

SEQ ID NO: 491876 - DNA, 219 bp, Homo sapiens
gtttgttttttttttgaactatgaaaagccccggtttgtgaatatattttagaaagagaggaaggaggtctgcagaactttgttttgttttttgccccaaaaatgtgaatagttcagagtgaaacccttttgtgagggttgatgtttcaggaataagcgggatctccaatgttttggggaggctttgagtctcaaaaaaaattgataatcagaaaagta

SEQ ID NO: 491877 - DNA, 246 bp, Homo sapiens
tttgagcgggggcttgataggtcgcgtacctgcattcaaccgcgcggacatcccgtcatccaacagttgatcctaactgagcacgcccacggccctgtgtctggcctgggctcacggccaccgatagcgccatcccattgatggcctctgtgtccccagtgagggcgggccgggagcgtatgcccagtgggctggaagcaggtggacctgtggctccagtacgaggtacggccggacgggatgtga

SEQ ID NO: 491878 - DNA, 463 bp, Homo sapiens
acagacagacaggcaggcaggtagagcaaataaagatgatcaattaccctgactgccagaattctgaatagagttgaaataactgacaaatcaagcacacagggaaagccaaagagatgaaaaaacaaaaatcctactaagtcttaccagctgctgaacagctacaaagaacatagcagtgagtaagcagatatatattgtgaactcaccttgtgtactattcaaggaaccggcgttgccatggtaaacaagagtcctaccctcaaggagcctggatgtacaaccagaagaaaagaaccatataaagagaaccatgagaaagagagaagggtagacagagcactggaaggagactcttcttcaaatgagcatgtatgtccaatagatcatatatatatagggatcaaacagaaactacaaaacagaactatcattgcctgtcagaacatacaagggaatcgaa

SEQ ID NO: 491879 - DNA, 262 bp, Homo sapiens
catgtaggatattatgagcagcattgtcgatgttcatttggattataggaagaccgcctggtaaaatttatgaagactgacgaagccattatatactcatatggattagtcaccatagccagtgctattcctgcttactctagaagaggggacattgttttcgtagatagagttgcctgttttgttattcagaaaggattacaggcttcccgtagtgacattcagttattttagcataatgacatggttaacccgagcgcta

SEQ ID NO: 491880 - DNA, 1102 bp, Homo sapiens
acgtatagccactactaagtacccaccatatgggtatagcgctttctgtagaaccgataggggcttgtgatagagactatctacatcactattgacgctgtacagtgactgacagtcgcaccgcgtcgatcgcgtgacaaattcctgtgaccttgacgtgtgttgacttgtgaatacgccgttcctcgtgactaatggacagcgatgactcactcgctcgacaagggtgacacaactagtcaccactatcacgatgtaagcgacgaatgctggtggggtgcaactcactcgtactgagtacaagaatgtcgtcacatctaaacctttattcagcactgtggccgagggttgcatcctcggtgtctagatcgtcttctccgccatagtgcatgtctgcctcttggtttccccatacaacgcctctcaaatacgactgtttctgagcgattcatctacgtcgcggtgcacgtgtgcagaactcgcagaggtcagcgaacgcgcagccaatggacccactagtcccctgtcagcctccacacggacgcgtaatgcgacgtagtggacctgtacccagggacgtcgatctcaacggtgtctgaccgacgacgagatcgctcggatccgactattggaccggcccgaccgagtatcttgccgaggacgaggagtagcaaacaaggtgttcgcacacccgacctactaccaaacctgggttctgctatcgcctgcacactggatttccggatcaccagtctgcgggtatgtaccctctcagaggttcgtgcccctacgtgtctaataggggcacgtggacaatggccgcagttactggtacacggcggcaagacgttgttcaattggaatcctcgtaacacaccattgtatcggaccaagtcccactaaaagggcacccaggtatccacataaaccgttgaattaggcgcggctggatctctagaacctgggcctcttctccatccaaggagcatgtcatgggaacaccagtgcacgcacgcacaggcgggcaatccctgacacagtgcatggtatcgggacttagcgctccggcgcccggtaacctcactcagcgaccgcgatgtcc

SEQ ID NO: 491881 - DNA, 368 bp, Homo sapiens
tgaactgacttgactgtggatatgaaaagcccaaaaccaccgcccaggaagaaccgcgtttgcctgcggcccgggaagaaacatccacggctgcgttagaaagagggtcgcacgctaccaccgaggtcgcggggtccgcgagtcctggggcatcgcgccccacagaccgagtcccttccccgcgggggtggtggctatgggtaggacgcgcgcttggcgcggccagccctgcggcaggaggtgagcggcccagggacacgggcagctgggaggggcgcgtggtgatttactcacttccctcgtagccagagaagtgcggcaataccgaacagttctaatagtagcgtccatgataacttcatgtttta

SEQ ID NO: 491882 - DNA, 139 bp, Homo sapiens
caaattatcgacctcctgagtagcaggattactgacatcgctatcactgcctggttaagttttttgtatttttagtagagacggggtttcactgtgttagccaggatgatcttgatctcctgacctcgtgatctgccca

SEQ ID NO: 491883 - DNA, 116 bp, Homo sapiens
ttattagtatgagacaggtctactttgttgccacgctggtcttgagttcctgggctcaaaggattcccccacctcagcctcctgaagtgctgggattataggcatgagtcctcgaa

SEQ ID NO: 491884 - DNA, 144 bp, Homo sapiens
gatataaactcatgggctatagtgatctgcccaactcggactcccgaagtgctggtgattacagtgcgttagccactgcgcccagcccctgcacagttatttcaaatggcagcagcaatggtagcctagtgaagaccagtgcat

SEQ ID NO: 491885 - DNA, 224 bp, Homo sapiens
acactttttgcagacagcaacaacaggatttcaggaaccagtgttctgatgaagctcggactgaggagctaagctagcaagcagcagttcgtggctgaatataggaaacgagtccaggagccatgctgcgatttgagtgaagagaagctcggaagtaaggaatggagcgctaactgatttgagtgatgaagactaggaattccggattccagtgaaggagcgag

SEQ ID NO: 491886 - DNA, 222 bp, Homo sapiens
gcccctccccccttccttttttcccccaacaaaaaagaccaacgacttccgcaaaagggcaaggtttctccctttcctgcaaagtagggatttggggcccaaaacctttcctcaacaaaggacacttagcccaacggagtttttggatgggaggggtgggagcatgggaaaggaggcatccccccccccaaaaaaacttaataaaaattttttagcaaagga

SEQ ID NO: 491887 - DNA, 184 bp, Homo sapiens
gcggtcgctctgaggccccccgggtccagtacggatgtgggaccccggagtacctggcccctgagcgtgctgacgtgacacgtcgtacacgcgagctgtgtactggtggcggactggtgtgtgctgctctactagatgctgtgttggcgagtccccattcccaggggtacgcttagcgaggagg

SEQ ID NO: 491888 - DNA, 1055 bp, Homo sapiens
  misc_feature (1055)..(1055): n is a, c, g, or t
tgcctgaacaaagtggagcatgttggtgctgcctgcctgcatggggaccctgccacccacctccctgtgggcctgctgcagctgggccgtctctgctctacttgccacctatgacctgccaactgtgcacatgcctgatgtgctggtgcatgatccatgttctgtgcctcatcaactgctgtgcaacaatgtaccttgagctggcctgatgtgctgttctgagtgttcaatgtgtgaactgctgtcctgccatggcatgccattgaatgaagaaggcagtgactcgttgtgactgcttgtgatgcatgcccccctgactgattggtggctgtgtgcatgctgcggtgcctggtgtgcctttgctgccacggccactttggtgccctggcttagccttgggtctggctgtggacaagtggggacgtgggggcagactgttgagcctttgcttgattgctcgcttggatggtggttgcaccgtgtgttcgccctgaactttgcccttgtttatccctccagttctgttgtgctggcacgggacaggagctgtgtctggcattgggtcatgcttgccagtgttcccgtgattggcttgccactctgtgcgttgcttaccttttctggggttgtggcacctggaatgtggagcccggccttggttcccttggcgttttctgggtgccatgagagctgtggttgtgcccccccggcccggagggacagggttgcgactgccggttgcagctttctgcgcatttgccagccccttcaagtggtcacgacatcttagcatgctggtccccccctggtatacggctgcttacggctggcgaccttgaagctgctgccgggcctggggactgaccggaatgtattccggccttggtggggaccctgcggaacggttggccccttgtgtgtgggttcgactctgcgtctattcacgccccttcgccctttccagagggacccccagtgcgcttacagggctgtagcatggacctggctggacccccctgggttaccttgggccacagggagcgggggcgccttgn

SEQ ID NO: 491889 - DNA, 915 bp, Homo sapiens
gaaacagacaaatgggttgccaactccaaagttctgtgcttattccagtcacaagttgttaaattcgtgttgtcgatacttgtggatgcgaaatgaagagacccttgaatacatgaaaaatgaggtggatcttgcagactcgatcagagactctaacaagtatagccaccagtgctgtgttcgaggagtatggtgacaaagttatggttcggtagtatgggtaaagaaagtttcatagtgaaatgaggttcctgataagaatagatgtttacgttctatatggatttccttaattcaaagatcatgattttagctggacactaaaccaagaacatatctagcaagataacttgaagaaagtataagcattatgtataagaaatgtgaagttcttgaatgaattgcatatttgtgactatgagtttgggcagaatgagaatgatcggctcatcagtgaagcgcagtatcttagtctcgagatctcgattttgatgctttcatggaagtgctatgcggttaggtctgtttgtgcgtcaggcaagagttaatgagatatgtatgaattgtaagtcgagagatgggtcaactcagatggtagtcagttgagtctcacagtaagcgggtctatatatgtatttaagtgccaaatgtattccattttaacaccgtaagccagagttgagtcaaggcatatacaacactttctcacaaaaattcctaaacagattcgggggtctaatatggtcccaattcctcatgcaattatattccattccatttaaattattttccatctttttaacattaaattgtaaaggtttaagcacccattcatttaattatgggctccggtgtaatccagggctaacacacgggaaccggcctcttaagtctcacatgttgattaaacccata

SEQ ID NO: 491890 - DNA, 201 bp, Homo sapiens
ctaggtaacgcatcgacattgaatagtgttctgaatgcgccatcgttgtgctcggtccacccaccgcatctatttcatcaataaaaattacgcaaggacgatttttccgcgcctcctcaaacaacttacggacagattgagcaccagcacacgcataaatttgaacaaatgaagaagcagattgggctaagaaagtagcat

SEQ ID NO: 491891 - DNA, 202 bp, Homo sapiens
tgggtaatacaaaataagcatcatgcatgaggattggtgctggaagaacaagagcctggaggtggaagtgctggaggatgacgcgtcttcagttgcattcaggcagacgggatacatgagtgatatgttccctgatctcacgccatcactctggaattttatcagcaatggaaatggaccgtgagagtgtggagatttatct

SEQ ID NO: 491892 - DNA, 434 bp, Homo sapiens
ttacgggtgctgatgtgcaaaccaggacatattgggagagagggaccgggctggctgtgtggtcagcagggttgaagccaggactcggggctccaccaagagctgacaggctggccctgccttccttgagcctcactttcatcttgtccagtgtaagatgggacagtgactctcatggaggggctgggtgaggattagggtgatgagggtctaaggcagccggagagggtcctagcatcgactctttctctgttagttcttctgagtagatagaaaacatggctcagcctggccacacacagacacatgtagcacacacacaggtccacatgtgtccagcacacgcatgagtgcacatgcacgggtatccccaaccccatcacacacacacacacgcacacaccagggcaccgagcctcgaattccgcatcacg

SEQ ID NO: 491893 - DNA, 271 bp, Homo sapiens
  misc_feature (50)..(51): n is a, c, g, or t
caccggcccgctccggagcagagtccggagcggattcggcccacagtttnnagggcggtgttgaagaattgattggcgaacatctgtcacttactagagatgttctcacgagagcttgcgctaccaggatcggcgggccagcagcgctcccgagtggagggacctgataagtactgccctcttacacagagtctcattcacagccagtcttcgtctgactgcacttcagaggatgcagcttacttagcgtatcattctccatgcgctgggc

SEQ ID NO: 491894 - DNA, 620 bp, Homo sapiens
gcgggctttcttcctcgccttcccggcgggctggggaccccagccgcgtccggaccccaccggacgcccggaaggcggggggtctcttgttcgggcgggggcacggggaccacctcccaacggtgtcaccgaccacccggccttcctccgctcctggagttcacgggaccagtggggggtgccttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggtcggccgacgcgctgcccgacgccgcacccagagccgggccgctgccgggcgccgagatgaaggtgctgggacaccggctggagctgctcacaggcctcctgctccacgagtgaccatgggcgggctgcaggagctgggattccctgaggagaagccgctgctccggggccaggacgcccaccgagctggagagctccgatgccttcctcttgggtgtgacacagactggaaggacatgacatcggagataccctaaggcttctggatga

SEQ ID NO: 491895 - DNA, 663 bp, Homo sapiens
gaaaagattcatcttaaaatcactttcactctgtagtatacaagtatgcatacttcttctctcaagtactgaatgtagtagcgttcagttcattagcaggtttactttgctatgcgtttcaaagtctgatttcaactgctgatttggcatatttataaaatgcctactaagtgttaggctctactctagtacatgtgaccatacacagtatgagtcagactagtagcgctagcactatatgtgtgagccaatagagatgatcacatggtgacagctgctatgcttagtattacaatgaataatgtcatcaacagtggctgggcatttagattgttcggtcatagatggcctctatgaaatgatggcatttagtctaggatatgactagcaaggaggagccagcgcatacgcagagtggtagaagtacactccagtgtcccagtggggacgctaatgcatgtaagcattaatgctgacttcatgtgttgcagatacataagtcttgtggagttgtagcatagtagggtagcggatagccagtacaaagtggtcttagagaggcatcatcaactccatcatgaacagctgggagtggtggttctcccttacaatctgagcacagtgggaagccgaggtggccgtatagctttagtgtgggagctc

SEQ ID NO: 491896 - DNA, 152 bp, Homo sapiens
cagtgtctgggagggacattacagctcatggcaacaccggatccttaacccactgagtgaggctagggataaaacccacatcttcatggatcctattcaggttccttaacccttgtgccatgaaagggaacttcccgaaattagttcgcatt

SEQ ID NO: 491897 - DNA, 1007 bp, Homo sapiens
tctagaacgcgttatcccatggatagtgcccctcagggtcatacagagtaatctaaataagccccctattcttctaaatgtaagcaataccttcatgtcgaaatggtcgtaagtctgccaatcacataggaagcaaagagggagtgtcaactctctttgcttatagactataagactgcattgaacaacgaatccaggcccagtccagcttgtaccatccataaagtctcacgttcactgtgatcccttagagatggttggacataccatattacccaacacagtgaatattgccaatcgtcacaagattatgattcacgacacccgttaacagatttctaagaaccctaagtcgaggctacctatataaccttaagacaacaaacgaggtcctgggcgttttacctcaaacacagcgaggattgctcaggcattgatcatatcggcacaatcctgtagaatattacacgtctaacaaaatttggatcgctactgagaggattcagagtccctaaggtggcttgtcctgcatagaagacactcctagtattctaactcaggccctagtagccaaggacacactgctggtcgtaccgcggacaccttgcggaaggtctgccctcctcgcgcaagtccacagctgggcatacggggtaacaaaagatactctcaagtagcaaagaatataccatagcccccggaagggacccccggggaagcggtactctagacctaacgaacctcattggacaagatggcaactgctgcccacacaaaaagtcccggcaagtaacagacaaagggactaccggcaagcacatttacagcgcccacaacacgtacggtccaggaaacgccacacagccgtcacagggaactggcgcgaccgccacgaggcagaacaggagcacgtgcgcccgccaacacaacagcgacgcgcaaacaacaaggcgagcagccagcgcccacagcgaagcacaccggttcggcgcaccacagacgcgcgc

SEQ ID NO: 491898 - DNA, 188 bp, Homo sapiens
aggatctctgagcacgaatgtaatatatgacaacacagcacaagatctgtaggtggaaatggtattatcataagggtttattactatacattcagtgatacaatgtggcttggagatagacctttttttacattacatatgtatactataaaaccctacgattgagaactaacaatagttaaatctaa

SEQ ID NO: 491899 - DNA, 138 bp, Homo sapiens
cctgaagatgcgagaacaacagaaagaaaaaaggcaggaacaagaaaaagaagaatgaagaaaacaacacgaacataaaaagagagagaaaaaggaaaaaaatttagaagaaaaaaagaaaaaaatgggaagaggaaa

SEQ ID NO: 491900 - DNA, 101 bp, Homo sapiens
gccaagaatctgaatctttgagtttgcttcccccacacgcaatccacctgctgaagcctagtgaccagctgaacagaacggagaggttgaagattcaggag

SEQ ID NO: 491901 - DNA, 635 bp, Homo sapiens
ggcgatgcacgagcgcgaggtgctgcacgaggcgctggaggagaactaacaacttcagtgcgccaggcggcaggagaagctcaactacaagatggatgctcagcaatggagatccgctaggcacacctggcctgcactgcgcgatgcggctgcgcgagaaggagctgcacgctggctgaggtgcgcaggaacaaggagcagcgagaagagatgtcgtggctaagtggccctgggactgggctggcgcccatcctgcgacggaacacgttcgggtttgggtttggtttcgttcacctctgtctagatgcaacttttgttcctcctcctcccaacccgagtcccgcagcttcatgcttctcttccgcgactcagcgcgccctgccctgtcctcgtggtgagtcgctgaccacggcttcccctgcaggagccgccgggcgtgagacacggtccctcggtgcagacagcaggccgggcgcggctgggtccccccgggggccctgtgagagaggtggcggtgaccgtggtaaatccaggtcggtggccgtgggatcgctgggtccttacgctggtgctgtctggtcagccacgtgccgcgtcagggcgccggtcctctgcacccgcgcagccctggccag

SEQ ID NO: 491902 - DNA, 1406 bp, Homo sapiens
agcggagcggggggtcgccatggctgagctgcacgcatgctccgggtgcagtgaggcggtggaggtccatggtgaaagagtctggaaagagagaacatccggaagatgcaggtgagctggacctgaggcccatgcagaggcgctgccaaatgtgaagagaccatgaaaggcgaggactttccggccatcccctggtttgggcaggtcatgccgtgcttctcttgcggcccaagctcgcattcaacacagacgcgggttatcttacaacgtgatactatctctgaggccccgctaattgccttcttgtgttgttcaacgggtaccttgcattcatcttcaacggaagataatgcggtagtacgccagattaggtgaccccctttgatggtcacttgtgatatacgttggagacggacatgaacatcttgagatgggaatattggtactttgctaagggtatgcgatgagcacatttcttggagaagccccatgttggaaaaggcaggggcgttccattgagattcgtcagcacgtaacagttgacgtggagcatatcgcgatcgtagagaaccaacctcgcgttagacacagatacaatcgcctaacattctggtgtgactgaaaagacacgcatcttggattttctgtgcagcaataggctcaattacggtgttgcacaacaccaatgtgattggccaggaattgaaagagcatagagcgaaggagagaattgggaacgacccgtagtaggaagtaatgatgttagtaaagttaaggaagagtttagggagtgatgaaattaaacttttttagtccgacgcaaaggatagggatagtgtgtaagatggtaatgggggttacacattgggtatgtattagtaaagtttacatacaaggaggagaaaatgtgtgtggagaatatgagagggataaatatgggtgttgtagaagaaacggtatgcaaggggagttatgatgaatatggtataattagaagtggattgccagcacaggaggcacgaaggcaatgtgaggaggcaaagaagacgatcaaacatggacaccaaggccgacacacaacgcgaaaatggaaaagggcaagctggggatttcacaacgacagagcagtgagacagtatagggagagaagaggcatgaggcacaaagttgctgttgaccaatgcgagggtgccaagacgaagaggaagcaggggggcacgactagagggaggcatcaacaccacaatgatggaagtacagaggagagagaaaacgataggccgaagcagaagccgggaaccagtgaggagacgcgggggaggtaacaccgcgagtgaagagtaacggggcaagacgtgaacggaagaagagcaacaagacgagacatgcggatgcaacgagcaaag

SEQ ID NO: 491903 - DNA, 312 bp, Homo sapiens
  misc_feature (41)..(41): n is a, c, g, or t
  misc_feature (75)..(75): n is a, c, g, or t
  misc_feature (142)..(142): n is a, c, g, or t
  misc_feature (152)..(152): n is a, c, g, or t
  misc_feature (154)..(154): n is a, c, g, or t
  misc_feature (209)..(209): n is a, c, g, or t
  misc_feature (224)..(225): n is a, c, g, or t
  misc_feature (238)..(238): n is a, c, g, or t
  misc_feature (299)..(299): n is a, c, g, or t
aatggctacatttgatagaccaacactttagagaaagggtnaaacactttcggtttctcccctttggcccctaanacaacatcttacagtctgggtctgggtctacctatacggtcctacattggcttctgaaatatttgtnggggggggancnataaaatgacactggccagtacagtctttgggtatttggggggggggtggggggnaagtcagttctcggnncaaatttgtcggnttcggtctcgtcggcggggtctttgggttctttgttcttccgcgcttcttcaatgtgcttntccttctctcgca

SEQ ID NO: 491904 - DNA, 679 bp, Homo sapiens
  misc_feature (491)..(491): n is a, c, g, or t
  misc_feature (562)..(562): n is a, c, g, or t
  misc_feature (564)..(564): n is a, c, g, or t
  misc_feature (664)..(664): n is a, c, g, or t
tggaattatacggtttgactgtgtccccactgaaatgtcaacttgaattgtatctcccagaatacccacgtgttgtgggagggactcagggggaggtaactgcaatcataggggcgggtctttcccgtgctattctcatgatagtgaataagtctcacgagatccgatgggttttcaggggtttctgctgttgcttcctcctcattctctcttgctgccgtcatgtaagaagtaccttttgccctctgccatgattatgggacttacccagccatgtggaactgtaagtcaaattaaacctcctggccaggcatggtggcttacacctgtaatctcaacactttgggagggtgaggtgggtggatcacctgaggtcaggagttccagaccagcctggccaacatggtgaagccccgtctctactaacagtacattagccaggagttggggcacgcacctgtaatcccagctactcaggaggtcgaggcggncgggtcacttgagttcaggagtttgacaccagcctgtccaacatggtgaaaccccgtctctacaagtacananattaaccagggcgtgtggcgtgtgcctgtatcccagctatacagaggcagaagcggagaatactcgaacttggagcggagttgcatgagctaagacgcgnactgactcacctgcc

SEQ ID NO: 491905 - DNA, 1279 bp, Homo sapiens
taataaatcaataagcttccgttcctcttgaaggaagtgcccgaacgagggccggaattgttgcctgtattagttctactgctgtatcccatgtcacatagtcaagcacttgatcaatatctagtagagagtgaatgcaatataatagattcgtaagtgaacaagatgacatgccttcattcacgacgtgtatagtgactagggataactcggtttcgatagactatccgctagccgtggcttttagcgcttgggagttgcctgcctggccattcgagacatggggcgcgcatggccacttgcagctctcgctcgtgtaggtcgactaatgcagacttatgcacacttctctagagagactcatgtgggctgtcatggcatcttacgacacactcacttgacacgtatcttgacacaaagttagcctaaatcaatggtcccagtggggaacggatagttggcctcccaatcgggcgcttgtttaagaattacgccctaagggctaggctctctggaagcgacaaagccgctctagaaacgggaccttagtgaatggggcaattccaaaactattgagcaaggggtcgccgagagcaaagccttgctttttaagaacaagcgctaggcttctcgtgtgtggggccttcacacaagtccacactacggggttattgaacaagaatcccccccccgcggtatttttggcctccaaccctgggcagatcatatctggtggaaatccagcagaatacaattgtcgaaggggcaccggcgacaggcaaattatggacattcctgggggtagggcattggccgaacaacctttcgcgtttccacatggtcaccctcccaaccgagtttcatttaacccccttgtttgatcgcgaaaattgggcggtctcttcggcatataatcggggccaaacccagaaattgcgcaatcaatatttgccggcgagccggtgttggccgagaaagccgccaccatgaggcgacacacacggttgcttcaaccgtaaacagagggctctatcggatccaaacgggtctcgggacaagggttccgccgaacggtggggaaacctttgccgggacaaaaagacgttcaaaaaccacgttgtagtagataaagtcgtttcccttccaaaggactcccatatggagggcagcacacctttggaaaccccaactcggcaaacggacattcggcaagcggtagcagccttattcccttctaggagctccactctttcctcaaggcgacaaaagcatataatcg

SEQ ID NO: 491906 - DNA, 1259 bp, Homo sapiens
  misc_feature (292)..(292): n is a, c, g, or t
  misc_feature (297)..(297): n is a, c, g, or t
  misc_feature (309)..(309): n is a, c, g, or t
  misc_feature (627)..(627): n is a, c, g, or t
agcgggcttccgtggtgggtcgcgggtggtgcgggccccggggcggcgctgagccaatgaccccggcagggtcgcggtgcgtgcgggatacctacgaccaaccgatgcctgggtcgaggtgcatatgaggagctgtgccacgcaagcgggaagagcctgtgccgagcatgatccacgcgaggagggacggacgaggagagcgagcaggactgacaggaagtgaagggtgacgcgctggcgtggacagcagtaagtctggccgcccgtgctcgagagcgaggagaccgtggcntgcgncaacagagttgncccgtctcgccgaactgcagtgtctgacgcggtgactctactctggccggagtacaggagtgcgctgccctactcatcaatggaatccgtagggacgagactcgcgcatgaactattaggctgccacgcggtctccttcgaagggacgcggcaaggctcggtgcaaaccacgtagagcactagagtggcttaccaaggccccccaggaacgcgacgtacaaaacgttcaggccgaggccgtgcccatgtgggaaccagtgctcggaaaccaatgtatcccagcgggttggcacgcgtgtccttggccttccctgtggnttgcgcccgctccacagcatccacagctcctccagcgctgacgtttggttgatggcctactaggaattggcaatttgccttttgttgatatttcctttccccatcagtgaccgaaagttccacggcgttagctcccgtttcctcccatgccaatcgttgtaccttgcagagcgcttcgcccggggaatgcattgggggcgcccaaggaggttggactctcattggggccttatccacacatgtggtgaccattacacggttgtagcaaaacgctctcgacggggaccacgaggggttcgctaatccgcaaggaaggtggtccctttctggctttttgggaatggcgttgcaagcttaccaggtggccgtcatcgagtgagtactgggggttgggatgggcttcactaggcggttcccaaggtcgttcgttaggccaaaagaggggagctcgttgtgggctgccttccttgtttgtggagcaaaccctctagctaactttctcgttggttccccttgggtcccacaggggcacgagtcttgccttcggggttgttgtttccgtggtaagcccacgcccaattgcgtgtggggggccccccccctttccaacccttttggtttcgccttccctg

SEQ ID NO: 491907 - DNA, 668 bp, Homo sapiens
gggagtcaaatttgcaacaaacgcataaaaggaattagaactctctcaaagtctctataccatttatacctccagtattgaaaatgatgtgaagatgaaatacagtagcatagtgaattgcaaaaagtaatgctatttaaaatagtgggggaaaaaatatatatatatactaagagaccagttctagttgtgtttcaaagtttaacatatgaccaagtgtataacagggagagattatgggcagattgcacagagaccgttcataagagttgacgctcacaggatacaactatcctgtgattgagatttttaggatattagacttaggggattggatctttggggatttcaatatttgggattatgggtatttgagatggtctcttttaggattatgatccaagacccagtctcagggaatgtgtcgaaatccacacgtaatccagtacccatcccggcgctgtgagaaatgtaggaaccacaaggcctctcgttacagagccacttactgacccatggcagattccccagagtaagcatgaagcagtagccggcggaaggactacaaatggacacaatgtatatctgagcatcatggcgttgctcgacaaacatcatacaacagggcacccgcacctatgcaagcataatcattacgaaggggaaaa

SEQ ID NO: 491908 - DNA, 368 bp, Homo sapiens
tgcccaggattttattaaactgcttttttttctcaatatacctgtattggaagattgaaacaaaaaggcccaaactcacattaaataaacaagggaatttaatcaattctccaaagggttgtttgtaaaacaagtggcccttggaaccaaccaaagtaagtcagggggtcccacccgggactgtaaaaaaacttgggaagctttacacatgcccacgatactgaccctgtcccggacctttttgtttgaaaaggccaaagcccaacacccctcctacaaaggcactgttgttttttttggggctgtgaccctggaatttttatggaagcacctggtctgaaggggcatggcacacactcaggttctac

SEQ ID NO: 491909 - DNA, 156 bp, Homo sapiens
gctagaacagagcacacctgtttgccgaagacaaacgagaaaaaagactttggagactcgacttatttcagagaccacatctgtgtgcaaaacagaacaggtgggcaaacaaattgtttacgatagccatacaagggaaatttcaccagaatccct

SEQ ID NO: 491910 - DNA, 934 bp, Homo sapiens
ctgtgatccatctacatgaaccttccctggattttcttctaggcttctcggccggcactgagtacatggacctgcacggaatggacctaggccagacagccctgtcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccacatgacccggggcccctaggagaaggcccgccgtatcacctacctcggctcaggaccctaaacgtagcacacgaaagcaaacatacaccctgtcaggactaagtaaccccgattccgactagaagaaggaagaaaaggagagtgaggaggacctgagaaaacttgcaaggcagagaggctgaaaacactacaggtaggggcaaaaaccgaatccgacgtgggacataatcgcatcaaacgattgtggagatggtccggatgatccgaagatgctggagctgaccttgacaaaatcgaaagtcccactgatgcgagcggaacaccctacatttggcagaggaggacccaggcagccgatgtgactggagcttctcctgagggcagacgcgaaccctgctgaccgcattgttcggagagctacaacgtcacagctcgggctaataggcaaaaagctcacgagtcccaaaccgcaatcatcgtcgcggctcctccgtagcaggacgaggaaccccgtgaaagcgcgaggagcgaaggaacgaaaaaaattctgggccctttcaacaaggtagtaagagtgaaagctgatagggaaaacaagagcgtcagtcaaagtaggagatacagggcaacccagtggaggggcaaggaataacgggaagcaaaaggcaaaaagata

SEQ ID NO: 491911 - DNA, 129 bp, Homo sapiens
  misc_feature (121)..(121): n is a, c, g, or t
ccccgaggcggcagattgttgagtcaggagtcaagactgccgggcacacattgagactctatctctacaagaaattaaaaattagccggacatggaagcatgcacctgcatgtcccagctnacctggga

SEQ ID NO: 491912 - DNA, 202 bp, Homo sapiens
gcacatttcaggcatggtcatctgccacttttcatcaatatcggcatttcttcaaattctgatctgtgagtagcggcagtcgtcgagttgaatcgtgtaagattatcatctaaccaccgtattgaaccgcatcgctcacccgtaattgttgtaaatcctctagcaaggtcgcccgcatatttggcgtggcatacggatcatt

SEQ ID NO: 491913 - DNA, 128 bp, Homo sapiens
tttctgaaggagaaaatgttatagttattgaggtggcactgcaatcgtctcttagtaaatggatcagttttaggactttcagaaaataaaagatcgttgattagaccattatttaacaagggatgaga

SEQ ID NO: 491914 - DNA, 1258 bp, Homo sapiens
  misc_feature (246)..(246): n is a, c, g, or t
  misc_feature (921)..(921): n is a, c, g, or t
ccatgcccagtcttcaagatttctaatgttttggcaggtgttaacaatgtttctgcatatatacaatgccagataacaaccagatcacaataagtatctcactcaattgatgaacattgtagtgattctttttgaagttttctcatacgagtgtcattctgtatatatgacgaccacaggaatctacatagtattagagatagcatagaagcacggtagcattcttgattcgtcaaatgtaattcnaggcaagaaactaatacagtgacttgccgaccgaggatttgtatgatatacatctatttgacaaattagtcagtatgctctaagtgaaaattctgtgtcaggctataaattgagcagtgtaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaaaggttggtttttcctttatggtccttcatagcaggccaaggtatggcctctctgcaatagacagctactggtcaatacatgctggtaatttggacattcctggggtcacagattataagggtattcaaaatctatttatgctttatagagaaaccagactttaaaacttcatgcactacttatttcgaattactggtaccttatccaaatttacacctagctataaggatcttcaacccaggtaacaggaataatnctggggttccattttcctgtaaaccaactgaaagaactaattagatcatattctagtatgtcctgaaatatctttaagactggatcttaaaaactaacttctaagatgatttcatcttctcatagtatagagtttacttgtgtacaccgtttggaaacccaactactgtagaaagatgaggaatctatgggtaatttcggcttaatttccatctggccagtggacttattgtgaaattttccactttagtcaaattatttggggataagtttggatgcagacttaaaattagcaatcattttaaaatgtgtcaaaatttccagattactgctaaaat

SEQ ID NO: 491915 - DNA, 458 bp, Homo sapiens
  misc_feature (65)..(65): n is a, c, g, or t
  misc_feature (87)..(87): n is a, c, g, or t
  misc_feature (242)..(242): n is a, c, g, or t
  misc_feature (273)..(273): n is a, c, g, or t
  misc_feature (396)..(396): n is a, c, g, or t
ctggcaggaggatataggtttaggggccagccaagccccccccccccaagaagccattgccttcngaccccagggccggtgcccatngggttacctgcccggcccaggggttggaatcccgcccctagtggtaccctccagacaagggcccccccctccgacagtgtcctcgttttccctttgacctttccggaggttccgctccctccaacccggatttagggtttcaaaaggggggggtnccctttggagtcccctcccatgattaaaggngccaaaaactgggggttttttaaaactccgggcccccccccgggttgtcaaacaaccctttggggcccccccggggtagttccaccgggggcttggggaggggctgggggttggacgggattnaggaaggtccccccaccctgtttttgttcagttgcaataaacgtgactttttgggggggtta

SEQ ID NO: 491916 - DNA, 548 bp, Homo sapiens
  misc_feature (65)..(65): n is a, c, g, or t
  misc_feature (87)..(87): n is a, c, g, or t
  misc_feature (332)..(332): n is a, c, g, or t
  misc_feature (363)..(363): n is a, c, g, or t
  misc_feature (486)..(486): n is a, c, g, or t
ctggcaggaggatataggtttaggggccagccaagccccccccccccaagaagccattgccttcngaccccagggccggtgcccatngggttacctgcccggcccaggggttggaatcccgcccctagtggtaccctccaggtaagaggacccctgggcatgggtgggcggggcgatttacctggggaaaaggggcctttcattttttttttttggcttcccccaatccagacaagggcccccccctccgacagtgtcctcgttttccctttgacctttccggaggttccgctccctccaacccggatttagggtttcaaaaggggggggtnccctttggagtcccctcccatgattaaaggngccaaaaactgggggttttttaaaactccgggcccccccccgggttgtcaaacaaccctttggggcccccccggggtagttccaccgggggcttggggaggggctgggggttggacgggattnaggaaggtccccccaccctgtttttgttcagttgcaataaacgtgactttttgggggggtta

SEQ ID NO: 491917 - DNA, 478 bp, Homo sapiens
  misc_feature (65)..(65): n is a, c, g, or t
  misc_feature (386)..(386): n is a, c, g, or t
  misc_feature (414)..(414): n is a, c, g, or t
  misc_feature (429)..(429): n is a, c, g, or t
  misc_feature (463)..(463): n is a, c, g, or t
  misc_feature (478)..(478): n is a, c, g, or t
tgagatggagtcccactcttgtcacccaggctggagtgcagtgctgcaatcttggcggctcaccnaacctatgcctcccaggtacaagcaattctcctgcttcagactccagagtagctgagattacaggcacccgccaccacgcctggctaatttttgtatttttagtagagacagggtttcaccatgttggccaggctggtctcgaactcctgacctcaggtgatccacccacttcagcctcccaaagtgctgggattacaggagtgagccaccatgcccagtcacagtatttattccaaatcataaaattaggatcgatttgcttgtttactgttcaaggaagaatgtgtttttcgttctgtgggagagtgggcaaagagggnttagtgggtttattagggtatttaatgncagtgacagaaaggnaaaccaagggcaaattaggaatttttttttcttnccttccttttccttn

SEQ ID NO: 491918 - DNA, 129 bp, Homo sapiens
cactgctggctggacaactgaacaagttgagatgatcaggagaggtcagagaagctggagaggagagaccatgctatacttcgtgtgccattttacagactgatttccttttgaggggaacagaccctt

SEQ ID NO: 491919 - DNA, 608 bp, Homo sapiens
gtgggagagcagaggctcctggaagaagatgaggataggggctgggcacggtggttcatgcctgtaatcccagcactttgggaggccgaggtgggcggatcacttgaggtcaggagtttgagaccagcctgaccaacatggtgataccctgtctctactaaaaatacaaaaattagccgggcgtgttggcacacgtctgtaatcccagctacttgggaggccgaggcaggagaatcgcttgaacctgagaggcggagcttgcagtgagccgagatcgcgccattgcactctagcctgggcaacactatgagatccgggacccataagaaagttgacaatgggctttggatggagtgtggtggagcaggggaggttggagctggtgactccacatttccctccctagggtgtgtctcaaacgtgacggcagaagagaggtcataggtttgcctggatgccagaagcaggtgggagtaaaagacggaaatggctaggaattggccaggcaaccgtgaaacagcttagaaattacaggcaatccagccaggtgcggtggctgtacgcctgtaatcgcagcacttgggagggccaaggccaaggtggatcac

SEQ ID NO: 491920 - DNA, 407 bp, Homo sapiens
tatatctcgatggcggtgagataccgggttttcgtgtatatcaaagaatatcggggtaaatgtaaagaaaattcaagcagacagacagagggtgcaggtgctttctattatttaatagttcacctggccaggcacagtggctcatgcctgtaatcccggcacttagggaggctgaggcgggcacatcacctgaggtcgggagttcgagatcagcctggcaaatgtggagaaactccgtctctactgaaaatacaaagttagccgggtgtggtggtgcatgcctgcgaccccagctgctcgggaggccgaggcgggagaatcgcttgaacccgggaggcaaaggtggtagtgagctgagatcgcgccatcgcactccagccggggcaacaagagtgaaactccatctc

SEQ ID NO: 491921 - DNA, 261 bp, Homo sapiens
  misc_feature (14)..(14): n is a, c, g, or t
ttagtcgatgccgnacatacacaacacaaaaggaaaacagtaggcctttctttttcagggaaatgcaaaataaagctattatgagatgccactacacacctattagaatgttacaatggcagtcataaaaaagaatgagatcatgccctttgcagcaacatggatggagctggaggccataatcctaagtaaattaacacagaaacagaaaaccaaataccacgttttcacttataagtgagaacgtggcatcgataaaca

SEQ ID NO: 491922 - DNA, 285 bp, Homo sapiens
  misc_feature (184)..(184): n is a, c, g, or t
gcgcccaggatgactaaccagctagactccaggtagacctaagcctgctaaattactgcaggccacctactcgtgcacctaattggaatgcggttaggtctacctccaggtagacctaacatggcacaccccggaaggtgaatctctataaagacccttgtattccaatgagagatactatggnacttacctgaacgaacttccagagagtgaagccattcacacgtggaccgatatcctacctggtggtctacctgggtagtctacctgggttaggtctacctg

SEQ ID NO: 491923 - DNA, 668 bp, Homo sapiens
tacgccggtcagcgggggggcccggtgggccctgtgtggccctgggatggggaaccgcgtgtgtgcttccgctggagtgtttcggtgtctatcggtttaaggttgggcgatatttcacccatttgggtggtggtaggaactcaccacccgtttggggttccgggattgggttagagagtttccatggagcccattttgggttgtgggggcacaatccccccattggttggggggctcttttttgtggtccttgtgtgggcaaaaatatgtccacccacattatgtcggtgcgtggtgggtatgtggcttgtgtgagatacaccaaacgccccactattggctggctgacggtcctgtcggttgctgggtgacacccagaaacccccagaaggggggtgaaaaaaaaaacaccggagcggcggtgggtgggagcacagaaggaccaccacagatgtggtatgacgacacaccacgagattgtaaagacgagcgaagagtcaaacaaaactcggtatctatacacacccccacgataagatttatttttatccccccccgggtgagtagagcacccacccaccactggtgtgtgtcacagagaatgccgacaaaaaaacaacggcgcgtagaagtggtggggcacaccacccgtaagaaaataatctaaa

SEQ ID NO: 491924 - DNA, 107 bp, Homo sapiens
gtgtagtatatagtttttcagaattggaatactaattatttttgtataaaataattagtattccaattctgaaaaactatatactacaccttttgggtagtcacaga

SEQ ID NO: 491925 - DNA, 366 bp, Homo sapiens
gggacggagtttccctcttgttgcccaggctggagtgcaacggtgcagtttcggctccctgcaacctccaactcccaggttcaagtgagtctcgtgcctcagcctcccaagtagctgggattacaggcacccgcccccgggcccggctagtttttttttgtattttttttaggacaaatggggtttccccatgttggtcaggctagtctcaaactcctgacctcaggtgctccccctgccttggcctcccaaagtgctgggattacaggcgtgagcccctgtgcccagcctaagcccttttttaaaataaaaatgctaaagggctagtaagtaaaaataaaacttcctatgggatttcccagtgga

SEQ ID NO: 491926 - DNA, 314 bp, Homo sapiens
gggctgtggtcggctggcactatctccaaggtgactgtgaagcccggctgctggtgcccctggagtgtcaagtggaccccgctgttcagcagctgaagaacaggagaaggaggagatgaaggccgtcaatgataaatggcctccctaatggggaaggtgatgccctggaacagcgcaacttagcgtgctggagacaccgctggagcttcctggaggggcaggactcagccatcttcgacctcgggcatctctatgaggaatatcagggccggctgaggaggaactgcgcaaagttgagccaggagcgggggcag

SEQ ID NO: 491927 - DNA, 160 bp, Homo sapiens
aactatctcaaacccacttaaaaattaaacagctatttttacatccttcacaaagcccataaaaataaataattataactaaccctgagaaccaaaatgaacgaaaatttgttcgcttcattcattgcccccacaatcctaggcctacccgccgcgagag

SEQ ID NO: 491928 - DNA, 159 bp, Homo sapiens
ctagaggtatccccgcgcatacctggaccttctggcatacctggaccttctggcatacctgaccttctggcatacctggaccttctggcatacctgcgacctttatgccttagtcatttctgctctgtaggtcacacagtacaagaaggtccaggtatg

SEQ ID NO: 491929 - DNA, 103 bp, Homo sapiens
ccagcgtcttcactaaatatgagattactgaaagcttctctgggtaaactcttgtcatagattttccctgctgtaaagaacacggtcctggatgcccctctaa

SEQ ID NO: 491930 - DNA, 150 bp, Homo sapiens
tgcgaccgcaccgctgaagcagccaagaagaagacagaggatgccctaaatgagaccaggtaatcagacacacaactgaaggagctctcagaagagagcaatgagaccatgatggcactctgagaagagcgtaagccctgcctgaaacag

SEQ ID NO: 491931 - DNA, 658 bp, Homo sapiens
ccatcataatcggaggcttgatgtaccttctaggtaacgaccacatctacagacgttcctcgtcacagcccatgctttggtaataatcttcttcatagtagatacccatcataatcggaggctctaggcaacatgagctagattccccgtacagtaactcggtgccccgcgatatggcgtctccgccgcatataacgacataagcttctgactcttacctcccatcgtctccgtagctcctgctcgcatctgctatagtggaggccggagcaggaacgggttgaacagctctacccttccctgtagcagggaactacagagtagaaaccccaaaaagtaccaaaggggcaataataaaaacggatatctcagatataacaacttaaaagaggatgggcgtcgtggttttggctagaggatgggctccgacttttcctggggctactccatgcagggactctggcaagtttggctttgtatgaagtgctgttaaagtctggataagccaatatgcttggagacggagaatacttatctccgggggcaccctcactatattaggaggccctcctgccagggctgaatactttggctgacattgcgctggctcctatggaaagctgctaagggttcggaattccaaaccccaggcaggtaa

SEQ ID NO: 491932 - DNA, 452 bp, Homo sapiens
  misc_feature (3)..(3): n is a, c, g, or t
tcntggatccctgtagccccgccccgcatccccccagggggcccagggggcctgcccttttttttggcaaccaaattggggggtagtgggaggttgggcatggaggcccgtgaaaacttacctttgttaaaggccctcaaggaaaaaaaacccggccccgggcccggccgggggggtttcccggttgcccccaaccttttttttttttttttttaaaaaaaaaaaacctttaaaaaaccccccctaaaaaccaaacctttttggggtttggaccaaggaattttccaaatttggttgggattttgttttgaaggttaaaaaatttttccccccaaaaagccccccgttttaagcccctccaaatttaaaggttggggaaggggggggggcaaggggtttttttttttttttaaagggggggggaaccaaaggaaaaaaaaccggggcggtga

SEQ ID NO: 491933 - DNA, 521 bp, Homo sapiens
tagtcaatgaatgctgatctaggacagtgacatggacccaccagtcgtgattgagtcacagtaaaatgaagtgtgactctttactcttccaagttgctttctagatcctttcattacaacctattctgatcggatagtcttggaaaggaaagataagtctagcctcgaggctatcctctaaaagcaaagagagagtgatggattttctgctcagtcattccatgggggacctttatgaggcacgtgttagttcccaggcagcactgctagtgcggtctgtgccagaaagtacacgtactgcccgcggggttcaaaatggtcagcgagccgtttgtacgctgtccacacctggttctcccacaagacagccgcatggccattcgtgtagttcttctcagtacacgttgacgcggtgatagatccccgtggggagcgcaccatgtctcccttctccatgatgatccggatcaaatgatcctccttgtccctcatatcgaagtacgactgccatccaggatgta

SEQ ID NO: 491934 - DNA, 218 bp, Homo sapiens
taacctagaggatcgattctttgagcacgaggctagctgaacaacgttggccttcctgaaaccagttccacgtttggtgtcttctatgccttcgtgaagctcaaggagcaggagtgtcgcaacatcgtgtggactcgctgagatgtatcgcccagtccccaccgtcgccaacaatcgacagactacatcccgtatcttctaggcgtcctgagcccaag

SEQ ID NO: 491935 - DNA, 186 bp, Homo sapiens
atatcaattagtccgcaaggatgggaaaagtacagggattgtttatattgaatttaagacagtagctgatgcagagaaaacctttgaataaaagctaggtaacagatatcgatgggcgatctatttccctgttactatactggagtagaaaggtcaaaatcaagactttgaggggaaaagaccctg

SEQ ID NO: 491936 - DNA, 727 bp, Homo sapiens
gagctgggctggcctgtctgggcccagccgaggtcgggcctgggggctggtggggtgagctgcacaccccgcaagaaatgagcctcctgcgtggcctctgcccccctggtgggcctggctgtgaaccgcctgtgggtccgcagtggcctcaggccggccctactgtctgtgcctgtggtctgcagacccccgatggaacactggaatagcagagactcctggagtgggcgtcgtgaccatgccggcgccaagcgggcgacaggtacgagtacagagacgatggatgcaacgctttggccaacgctctcagaacgatgagtattattcagacacgaagagagacatgccaaagcagacgacaggacaacagaagcttcccccagcagcccctcaagccccacctgaggacgacacatgaacagtgagcctgaagaaccatcggggcaagtaggaggacttcaacgacgacagttctgggagggtatggagacggccaagcatcaggtgtggagggcgcagcgtttccagaagccgacttcctcatgaccggatgacttctcaagaagcagactggtttccagatattatcagtggaccagaatgagagccagaagggtatatcttttcattagaaagcggacacgtgcagttgtggttgggatattcagagattcagggtgagatttgaggctatctccaaaattagaaagagcttataacagtgata

SEQ ID NO: 491937 - DNA, 188 bp, Homo sapiens
cccgcgggctatgaggaaatgatctttcatgggaacgtggacaaggacgcacccgtgctgagtgagctttcaaagccggtggtggctcgcttaatacgcatgtacccactcacttggaatggcaacttagtgcaagcgcctggaggtgctggggtgctctgaggcccatgtctacagctactacgagg

SEQ ID NO: 491938 - DNA, 208 bp, Homo sapiens
gtatctaaggatcgtaatatcagagagtactctgtgggtgggtgacagttcgacaggcgagtgtgagagcgtggggttacaggcgtgtcgagcgggatcatgtgctgtgtgagcttatcagctggatggcgcggttggtgtgggtgctcgattcgttgtgtgggattctaatatcacgatcttgaatcatcagggtccgagctcgaat

SEQ ID NO: 491939 - DNA, 991 bp, Homo sapiens
  misc_feature (1)..(1): n is a, c, g, or t
  misc_feature (554)..(554): n is a, c, g, or t
  misc_feature (565)..(565): n is a, c, g, or t
  misc_feature (575)..(575): n is a, c, g, or t
  misc_feature (600)..(600): n is a, c, g, or t
  misc_feature (621)..(621): n is a, c, g, or t
  misc_feature (633)..(633): n is a, c, g, or t
  misc_feature (702)..(702): n is a, c, g, or t
  misc_feature (944)..(944): n is a, c, g, or t
nccaaaacaaccaggggcagggagggcggagcgggggagggcggcagggggagggaggccgggcagccggcggagggccgggggagaccgggggcggggcgggggccggggcgacggggaccccgggggaggagcgggagaggggcaggcccagggcggcggccgagggagcagcggggcgggccgggggggacccgggcccgcggagcaccagggacggggggggcgcacgacccgcgacggcggggcccgggcggcggcgcgagcagagccagcggaggaagcgggcgaagaagccggggggcgccaggcgggcagaggccggcgcggggaacacggcggcgcgggcacccaggcggagcggggggagcacggccagggccacggcgcggcccaaggccagcacgggggggaccacgggcggcgggcgcagggagggcgccgacgcgggcagacgggcggggcccgggacgccggccgggaggaacacgaaggacagcgcggcgggccgccgggccccgccacgcggcggcgcacgagggcagggagggcgngcaccacgccngcgcccacgngcgagaaggagtgcagggagggggngggcgccagcgccgcgggganggccgggagggnggggcgcagcgggaaggccaccggcggcgcgccggggccaccaaacggcagcagcgccacgcgggcggngagaggggcggcggcccgccgggccagcggcaccgccgcgccaccggcgccacgaagcgccgggccggggggaagggcggcgcacccagccgcgcggagccggccagcaggaagacgagggccacgggccgcggcgggcacggggccacggacagcgcgggggggcagggaagggcggggcacacgagcggaggggccgggcagaggacggccgccagggcagcgaggaacggcgcagcgancagggcggagaacagcggcagggggcgcaccggcgggggcggggcgc

SEQ ID NO: 491940 - DNA, 134 bp, Homo sapiens
cgaccagttatattctcacgcttatacttcctcaacgctttatactttctcagctttatcttcctcaacgctttatacttccatgcatacttaatattatactgcaattcaatacggaagtataaagcgttgag

SEQ ID NO: 491941 - DNA, 128 bp, Homo sapiens
  misc_feature (28)..(28): n is a, c, g, or t
  misc_feature (72)..(72): n is a, c, g, or t
  misc_feature (76)..(76): n is a, c, g, or t
  misc_feature (78)..(80): n is a, c, g, or t
cctcacttttccatcaggggagtatcanataagatggctgcgatcatcttatcatgcagtcttgactgatanaacngnnncgacaatcataaaaaagcattccataacttggatggaaccagttaaat

SEQ ID NO: 491942 - DNA, 331 bp, Homo sapiens
  misc_feature (9)..(9): n is a, c, g, or t
  misc_feature (243)..(243): n is a, c, g, or t
  misc_feature (319)..(319): n is a, c, g, or t
aaagaactncctacaactcaattaaaaaaaaaacaaaaaaaaaaatgaagaacccaattttaaaatgggcaaaaggttgggtgcaatggctggtgaatgactgtagtcccagctacttgggaggctaaggtaggaggatcacttgagcccaggagttcaaggtcagcctgggcaatacagcaagcacctgtctcaaaacaaaacaaaacaaacaaacaaaaacccaaaaacatgccaggtgtngtggcttcactcctattaatcttcaacactggttaggcttgttacttcgagggggggggccccgttacccattttngcccttttagtt

SEQ ID NO: 491943 - DNA, 335 bp, Homo sapiens
  misc_feature (47)..(47): n is a, c, g, or t
  misc_feature (69)..(69): n is a, c, g, or t
  misc_feature (89)..(90): n is a, c, g, or t
  misc_feature (107)..(107): n is a, c, g, or t
  misc_feature (121)..(121): n is a, c, g, or t
  misc_feature (141)..(141): n is a, c, g, or t
  misc_feature (164)..(165): n is a, c, g, or t
  misc_feature (178)..(178): n is a, c, g, or t
  misc_feature (185)..(185): n is a, c, g, or t
  misc_feature (221)..(221): n is a, c, g, or t
  misc_feature (242)..(242): n is a, c, g, or t
  misc_feature (245)..(245): n is a, c, g, or t
  misc_feature (261)..(261): n is a, c, g, or t
  misc_feature (297)..(297): n is a, c, g, or t
gaaaggtttttttgctcagggtcacacatctggggtaaagcgcgggngaccatcttggggacaatgggncttttcttattttgtgattnnccccccccccccccccnccctcccccccccncccccccccccccccccccnccccccccccccccccccccccnncccccccctcccnccccccncccccctccccccccccccccccccccccccccccnccccccccccccccccccccnctncccccccccccccccncccccccccccccccccccccccccctcccccctcnccctcccccccccccccccttccccccccccgcccccc

SEQ ID NO: 491944 - DNA, 167 bp, Homo sapiens
tactctggacgtagttatacggaggtaggtgttctagaccggctcgcctttgtacatcagaaacgatctttcaaagggaagctatattctatggatccttgtattcccaggcactactatattgctagaatatgatcattgcttaagacatgtaggctgaatacagg

SEQ ID NO: 491945 - DNA, 333 bp, Homo sapiens
ggggaaggggaatggaggaggagaagtcaaggattagaggtctcttcagcatctcaggactgcctctctctctctgtggtcacaggggtaggtttggtccacacggcagacatgaaactcaagatacagccctggcgtatacgggttgggaggccagtgctgcctctggtggtccccccagacctgcaattcatattttgaatgggtttaaagcctacttggcaattacttttatcctctaatgaaatagatttgaaccactttcccttgattatattttaaatgtttacccccatataaatataactgctctgaggtgggaggggttaagcc

SEQ ID NO: 491946 - DNA, 332 bp, Homo sapiens
cctgtctctcctagcacgtatcgtctgcttatccgattctctgtgtctcacactttgaactgctttatgttttggctttatgttgctgagttgaacatccgtgttttagtttattttgtttggtttttgtttttggctatcttatgtagaaaggcatgtatggtatggcatttattattctaaattatttttactgggaaagctttaccaagattttgaatagctaaatgtctacttttttcttaatagtattttcatctcagcctagtgacgatgattcaagtagtgatgaaaccagtcatcagccctagtcctgcttttagtacgacgcc

SEQ ID NO: 491947 - DNA, 129 bp, Homo sapiens
agcgggtggtctgtgtacggcttccggtggcgggacgcggggccgcgcacgcgggaaaagcttccccggtgtccccatcagtcgaggaggaatgcccggaggacagggccggctcaataccgcccagag

SEQ ID NO: 491948 - DNA, 1203 bp, Homo sapiens
ctgttcgacgcgagactctgttcccccctgggtgttttctgtagtctcctcgcctgtgcgcccccgtgttgttgtccgccccgggggaatttgatgaaatgtgcgcagtattttttgtgggactgtggtcctatgccccgtgaagaagagttttcaaaaagggcaccctttatccctgtgcccagactttctgggcacacatatgtctgtcaaccacggccccatttgggaaggtggaagaaactttgtggaaccccccaatgtgggcccagcgcacaagaaagtggcaccggagaagaattttggtgatggaatgaacctgatctttactccctaatatcttaaggcgtcggtacgctcttgccttcggattattcttaccgtggggccacaatggatgttcatagtgtgaatgagatgggaccgctcctgttaccattgatgccccctttgggtgtaaatgaagagagactttttgggagctccaaaatctgttggtttccccggtggggggtgctgttagatacccagccccctttgcccatgatcacccttgtgaaatctattgcccaccccgccctgggggttctccgggaaccaccgccttgccgcgttgccacgagttttgcccaagagttccctttctctgttaatttcccgcactaccacctatgccacgcttataatgtctcgccccacggagacttcccacccacgaattctcggttcgccacacaaattataagaggcctcttttcactataatgaaggccccacacgcgttataccccacggcagacacgctataaaattctctataaaatgggaattggtttctctgagattttgaggccacactggtaaaccctccgagaccacacccaaccacacgcccgcgggtgtcttgagacccacacccactaagttataagttaataagaggtttgagaaatttgcacaccacgagaagctgcacactcacccactttcttcgaaattgagtgagttcttattaaattacactccccgagaagtataaagatgataaaccactggaagttatgaaagatgctgttcacctctggaggcccctaatgagttgattctgatgttcctctttatttataaccacactgttaaaatgccattgtcttgtaccctgagttgagtattacacctttaagtctaagtacccagctgtta

SEQ ID NO: 491949 - DNA, 375 bp, Homo sapiens
  misc_feature (8)..(8): n is a, c, g, or t
  misc_feature (46)..(46): n is a, c, g, or t
  misc_feature (102)..(102): n is a, c, g, or t
  misc_feature (104)..(104): n is a, c, g, or t
  misc_feature (109)..(109): n is a, c, g, or t
  misc_feature (112)..(113): n is a, c, g, or t
  misc_feature (145)..(145): n is a, c, g, or t
  misc_feature (160)..(160): n is a, c, g, or t
  misc_feature (162)..(162): n is a, c, g, or t
  misc_feature (165)..(165): n is a, c, g, or t
  misc_feature (177)..(177): n is a, c, g, or t
  misc_feature (181)..(181): n is a, c, g, or t
  misc_feature (185)..(185): n is a, c, g, or t
  misc_feature (197)..(197): n is a, c, g, or t
  misc_feature (231)..(231): n is a, c, g, or t
  misc_feature (235)..(235): n is a, c, g, or t
  misc_feature (255)..(256): n is a, c, g, or t
  misc_feature (266)..(266): n is a, c, g, or t
  misc_feature (310)..(310): n is a, c, g, or t
  misc_feature (322)..(322): n is a, c, g, or t
  misc_feature (340)..(340): n is a, c, g, or t
  misc_feature (356)..(356): n is a, c, g, or t
  misc_feature (358)..(359): n is a, c, g, or t
  misc_feature (363)..(363): n is a, c, g, or t
aggctttntatcctcctaaaggagttcaggatttataggtataagnagctatatttttaggcatgagctttctatggtttaaagtgtcccccaaagttcatntnttggnagnntaacccccaaagccatatgttggtttcatttngaggtggggcctgtngnatntaataagggttnaatnaggncatcaggggggntcccattgatgttacaggtggctttataagaagngagncctgagctagcatgctcttnntctctcaccntatgatgctctctactatgttatgacatagcgggaaggccctcnccagatgcagantctttagtttaacttttnagcctccagaactttnannaatncatttccttttc

SEQ ID NO: 491950 - DNA, 183 bp, Homo sapiens
ctgatcgcctgtgtgcctgacctgtctgactcgcgactgatagcctaccccgtgatggttcttcttgtggttttctctcattctgacggtccttctttccggcacagctgggtgctctcaggtgtcctgatgtctcctgccgcttgcattcttccttttgtctgaaccgatcatatataagct

SEQ ID NO: 491951 - DNA, 720 bp, Homo sapiens
  misc_feature (64)..(64): n is a, c, g, or t
  misc_feature (206)..(207): n is a, c, g, or t
  misc_feature (241)..(241): n is a, c, g, or t
  misc_feature (275)..(275): n is a, c, g, or t
  misc_feature (279)..(279): n is a, c, g, or t
  misc_feature (298)..(298): n is a, c, g, or t
  misc_feature (305)..(305): n is a, c, g, or t
  misc_feature (327)..(328): n is a, c, g, or t
  misc_feature (684)..(684): n is a, c, g, or t
ccagggccagagccaaacccggcacggaccccccagcccaggcgcccagccacgccccaccgcnaccagggccgaagacgcagacaggcgcaaggagcgggaggagaggcagcgaagggcggaccagggggcggaggaggcgcgggaaagcacccggcggaagcggcaactgggggaagagaggaaagaggcgggaaacaggacannggggaggtgggaggaacaaggagaacaacgcgancggggcgaagaaggcaggaaccaaaacaaccaanacangaaggaggcggagaaaaanggaaaanaataagggaaaggcgggggccnnggcaaaaggccggggaacaagcggaaaacaagtgaggcggacaaaaaagccgggggcaaaaaacaggacggagggggggccagccagccggcacggggaggggacgaacgggagcagagggccaacagtggcggcgtcaaccgcagggaacaaaggaagcccgagaaaatgaaagggaagaaaacctagagcaggtgagcggcaacatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggntaagtgtgcccacccgtgttctcctccaaatgctgt

SEQ ID NO: 491952 - DNA, 100 bp, Homo sapiens
ggtgggtacgcggtgggcctggacacgacggacgcactctactgacctacgttgcctgtctacggacgcgtaactcggggactccttctacgacgtcgac

SEQ ID NO: 491953 - DNA, 410 bp, Homo sapiens
aatagcgggcattacgatctgaatcactgcgccagccttataagtatttttcatgtaaaaagtatcacactgaattctactgtggagttttttgttttttatttagcatcgtacatgagatctatccatgatgatatagatatagacctggtacacctttactctgctgtatagcataactatcgggtcactaacccacatctatttatccatttctttactgacagacattttggctgtctaccaattttttgctattacaaagacacaatgccaactatatacttctaccaatatatagtagaaattaccccatattcttgtcaaaaattaatactgtgagaccatttagttttaatttagtctttaatttcgtctttctgggtcctttgtattacttgtggcaaata

SEQ ID NO: 491954 - DNA, 1144 bp, Homo sapiens
  misc_feature (214)..(214): n is a, c, g, or t
  misc_feature (413)..(413): n is a, c, g, or t
  misc_feature (479)..(479): n is a, c, g, or t
  misc_feature (485)..(485): n is a, c, g, or t
  misc_feature (568)..(568): n is a, c, g, or t
  misc_feature (597)..(597): n is a, c, g, or t
  misc_feature (602)..(602): n is a, c, g, or t
  misc_feature (694)..(694): n is a, c, g, or t
  misc_feature (740)..(740): n is a, c, g, or t
  misc_feature (755)..(755): n is a, c, g, or t
  misc_feature (777)..(777): n is a, c, g, or t
  misc_feature (783)..(783): n is a, c, g, or t
  misc_feature (792)..(792): n is a, c, g, or t
  misc_feature (863)..(863): n is a, c, g, or t
  misc_feature (867)..(867): n is a, c, g, or t
  misc_feature (870)..(870): n is a, c, g, or t
  misc_feature (873)..(873): n is a, c, g, or t
  misc_feature (962)..(962): n is a, c, g, or t
  misc_feature (991)..(991): n is a, c, g, or t
  misc_feature (1015)..(1015): n is a, c, g, or t
  misc_feature (1025)..(1025): n is a, c, g, or t
  misc_feature (1047)..(1047): n is a, c, g, or t
  misc_feature (1053)..(1053): n is a, c, g, or t
  misc_feature (1069)..(1069): n is a, c, g, or t
  misc_feature (1127)..(1127): n is a, c, g, or t
aaggcggagcctggcctgcaggaaactgaagagccggggcctggtggacaggaacaacgagaccggttacacacgccatgtataacctggcctctttgcgtgagctggtgtgaggacccagcgccgtaccatgcaccatccagtgtgccctgatggcgccatccgtaccgcgatagataggagaccattcctcgaatcgcattcacggccctgntagggagtaggttcactgtggatcgcctccatgaactccggctgcatgagtgatgacatcttgcccttgggcagggactcagggtcctctgagtgaccctatcatcaggcaagccctatgtgcccctgttggaagcagaggaggtacgtctcagccagagtctgctagaactgtggcggcggcgagggccggtctggcnggaggccccccagctacctgtggacccacatcgggacaccatcctcaacgccattgagcagcaccnggtggnggtcatctctggggacacgggctgtgggaagaccacgcgcatcccccagctgttgctggagcgctatgtgaccgagtgccgangtgccgctgcaatgttatcatcacccaanctcgncgcatctctgctgtgtctgtggcacaggggtcagccacgaactggggccctccctgcgccggaatgtgggcttccaggtgggggtggaaagnaaggcccccatcccgagggggggccctgctcttctgcactgtgggnatcctgctgcgtaantgcagagcaaccccagcctggngggcgnggagcacgngcatcgtgggatgagggggcatgaggcggggacgtgaaacacagacttatctgctgatcctgctcaagggnctgnagnggntcaacccgggcctgcggctggtgctcatgagtgccacaggggacaatgagcgcttctcccgatactttggtggctgccccgtcatcaangtgcctggcttcatgtacccagtcaaggngcactacctagagggcatcctggncaagttgggnaagcaccagtacctgcaccggnaccggnaccatgagtctgaggntgaatgcgcactcgatttggaccttgtgactgatctggttctgcacatcgatgctcgnggggaccaggtgggatc

SEQ ID NO: 491955 - DNA, 713 bp, Homo sapiens
  misc_feature (713)..(713): n is a, c, g, or t
catgattaaccagttgtgacacttacttgttcaagttggagtatatatgactcatgtgggcagactggtcgtcggtcttatgtgaattgtcgcatcgggtgcagaaatgccgagtcaattttgacatagcccttaagagacttttggtaacagaattacacgctcttatggtccgtgggtataatagtgtgtatctaggcactttattataactggatatttcgacctcgacacgatgttcactaacttgatcagtgcgtctgacctatttttgtcgcggtagctatctgtagttgtactgcaagtctataatacaggatcatgcgtttccaaagcaggattaagtacgaagaatcggcgatccgtgccgctgttggatcagtctatccagctgtggaaatcgggcaagacctggtggtttctctgtactggtgtttaactggcgggcatacgaccttatgacacgagcgtattacaaagtagctggtaggtattcgttggtatacctactatttataaaattagatctggcgacgagtctgactgggccttgtggcgtggccttttgtagtgctcgcgcctcgtaagctaggataagctgtaagatcgaggagtgtaatcttgggcattcattgatacagtttaaatagagcttaaacatccgaggacatttgggttaaagaacttattgcggtagtacccttggattgacn

SEQ ID NO: 491956 - DNA, 440 bp, Homo sapiens
ggggctgattgacaaaaagggagtggaggggaacctactttgcacatgaaatctttctgtgatcatgtcatagatcttgaaggaactgctggcagctccagttcgtccggaggttcaaaaactttggagacacgaagaagccactatgacgagggcccagggaagacgtttccatccacagggcgaaaacacgtggccaggcttagctaagatggctaagtactgcggatttgcacattctaccctattgctagtcgtaagacactaactggttcataaagatcttccagtctgtccaaatacagatgtgactagcatattaagatgggcggacattgtaatttggtcaaattagatcttatctgccatactcgatatgatcgtcaatccacacaggacgttaatctgaatgacctggttgctagcagttgtcttgtcgc

SEQ ID NO: 491957 - DNA, 222 bp, Homo sapiens
ctgaggcccagcgagaattcgagcgtggcgcgagcgggccggaagtgctgtggtacccggtgcaccctccacagctgctggcccgggtgctaagcccctcactgcccagggccagcggcaccagccggctgctccaagtgcggggcctggtgagcccatgctgagctggaactcgtgctggcccacgagtgccacgcacctctccctccccctcaaaaaaaa

SEQ ID NO: 491958 - DNA, 719 bp, Homo sapiens
  misc_feature (17)..(17): n is a, c, g, or t
  misc_feature (101)..(101): n is a, c, g, or t
  misc_feature (122)..(122): n is a, c, g, or t
  misc_feature (125)..(125): n is a, c, g, or t
  misc_feature (136)..(137): n is a, c, g, or t
  misc_feature (155)..(155): n is a, c, g, or t
cattggataagcggatnaggggagactcgtcaccaggcgtgcagtgggcactgctgggctcccccatcccgtcctaacccggaatagccccgggcaggagncgtggaaagtcgagggggtanccngcgaatgtgcnnttgtgtaagccacgtgcncgggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaatgaaaaaaaactcgagcattat

SEQ ID NO: 491959 - DNA, 789 bp, Homo sapiens
  misc_feature (17)..(17): n is a, c, g, or t
  misc_feature (101)..(101): n is a, c, g, or t
  misc_feature (122)..(122): n is a, c, g, or t
  misc_feature (125)..(125): n is a, c, g, or t
  misc_feature (136)..(137): n is a, c, g, or t
  misc_feature (155)..(155): n is a, c, g, or t
cattggataagcggatnaggggagactcgtcaccaggcgtgcagtgggcactgctgggctcccccatcccgtcctaacccggaatagccccgggcaggagncgtggaaagtcgagggggtanccngcgaatgtgcnnttgtgtaagccacgtgcncgggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacgtgggttattgtacaattacccaccactggatttgactcagagaggacccccagaggtgggtaattgtacaataaattttttttggtcaaatttaaaaaaatgaaaaaaaactcgagcattat

SEQ ID NO: 491960 - DNA, 1218 bp, Homo sapiens
  misc_feature (1218)..(1218): n is a, c, g, or t
gatcaggtgctgctgagtgctgtgctcctacccacctgtgagtcttccctgtgcgaggaccaggtggtggtattcgcttggccatctccacacgacatgtcccgggtctgcgacttagtaccccttgttccgccgtggtgagtccttggcttggcaatgatgtcgatgtcaccactccttgtaccctctgagcctctagtagcgtcctctgtgtcgttcgtattccggcagcatgtctgtggtcgctctgaggtcacttgactgctgcgtgggggttggtcccctgggtccttgggttgccgcgggggcagcttcgtagggctagtgcgcagtgatgtggcgcgctcgtatggcctcgtgcgatgtgataccctctctccgtaggtgaagcgtccttttgtggtcccgcgctttggtatctagcgggtgactggtagtgagccgtgcgcaacagatcgccaactgattacatttccgtgcgtctgcggccggacttcccacggcgcttcagagcgctcggatctttgagccgttcgccgttgaggattgcgtagcgtatgatcgagggtagattgacagcgctgagctctgtgaacgtggcgttcgcactcccttttgcgcttttgagagcttcgcccttttgggcagcggcccttcgaggagtgcgtgccgatagagttctcgttggctgagtgagagcgcgacctttcggtttttgccactgcgtttattccatccccccttgtttgcccggtgcgccatccgaggttatagtagaggcgctctggtggcccatgttgcgtcttcgtcagccaacgggtcggttcctcgtttgttcctattggtttggtttgccgcccatggggattcagggtgtaggttctgctacgtgtcggtatcgcgtaccggatacccgtctttgtgcccctgtgatgcgcaactgccgcttctgccgagcgaggagcttctctgcgccgcaaaggccggtacgggacgtccacaggcgacggacttcgagtccgctgttctctttcgattcgcgctgtctgctttgttgcgcaccgatctgtgtcgcaaagggtctggtcaccgcatcgatacgccgttcgttcagttagcggttgttgcgccttaacgactctttggggcctaagaaacttttccccctcctttagcgcttggagggggatcggtatgggagggcggcatacatttcgn

SEQ ID NO: 491961 - DNA, 496 bp, Homo sapiens
tgagctagtttgtgtaggcggcaaatgcgacgcgagcgtcgaggggattggctgtgttgcagtctgactgcctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaatgaaaaaaaactcgagcattat

SEQ ID NO: 491962 - DNA, 502 bp, Homo sapiens
  misc_feature (17)..(17): n is a, c, g, or t
  misc_feature (101)..(101): n is a, c, g, or t
  misc_feature (122)..(122): n is a, c, g, or t
  misc_feature (125)..(125): n is a, c, g, or t
  misc_feature (136)..(137): n is a, c, g, or t
  misc_feature (155)..(155): n is a, c, g, or t
cattggataagcggatnaggggagactcgtcaccaggcgtgcagtgggcactgctgggctcccccatcccgtcctaacccggaatagccccgggcaggagncgtggaaagtcgagggggtanccngcgaatgtgcnnttgtgtaagccacgtgcncgggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggaaatccacatggtgcaggctagacacggcacttgtcggccatgtccaggaagtgctgcgcgttcatctcatccagcagagcgat

SEQ ID NO: 491963 - DNA, 458 bp, Homo sapiens
  misc_feature (17)..(17): n is a, c, g, or t
  misc_feature (101)..(101): n is a, c, g, or t
  misc_feature (122)..(122): n is a, c, g, or t
  misc_feature (125)..(125): n is a, c, g, or t
  misc_feature (136)..(137): n is a, c, g, or t
  misc_feature (155)..(155): n is a, c, g, or t
cattggataagcggatnaggggagactcgtcaccaggcgtgcagtgggcactgctgggctcccccatcccgtcctaacccggaatagccccgggcaggagncgtggaaagtcgagggggtanccngcgaatgtgcnnttgtgtaagccacgtgcncgggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacagaacacagtatataatacatatcacagccagacggtgagcaagtcatgtgtaccgagccta

SEQ ID NO: 491964 - DNA, 256 bp, Homo sapiens
tctgtggaccactgtgaaacaagaccaggtcagcagcttcgccggtcccacgtcctgtaaaaggctctaaagtaaatttcaagtaaacttcaaaagacacaaatcacatcaaatatcttttcttaccacatgatggaatatatctagaactcacttaacaaacgatacatagacaaataccctaagaacctagcatatacctaatcagtcatttatgccaataaccccaccaggttaccataagaacaaacaaaaa

SEQ ID NO: 491965 - DNA, 842 bp, Homo sapiens
acccacgcgtccgtggctcatgcctgtaatcccaccactttgggaggctgaggcgggtggatcacttgaggtcaggagttcgagactagcctggccaacatggtgaaaccttgtctccactaaaaaatacaaaaattagctgggtaaggtggcaggcacctgtaatcccagctactcgggaggctgaggcaggagaatctcatgaatccgggaggtggaggttgcagtgagtggagatcatgccattacactccagcctggcaacagagtgagactctgtctaaaaaaaaaaaaaaaaaaaaaaaatttttttggaaaaggccacaaaacagaataaacggttttatctctattttgtaaaaccagccaatgaaaagcaaaaacaaaaactaacaaagggggccaggctgggtgaatcacacctatgatcccagcactttagaaaggctgaggcaggaggactggcttgaggtcaggagtgcaagatcagcctagccaacgtagcaagaccctgtctctagaaaacaatttaaaaaattatccagactggtgggcacgcacctgtagtcccagctactgaaggctggaggcagaaggatcacctggaatcccgaagttggagggctggccagtgacgccgtgatagccacaaatgcactgcaggtctggggcaacaaagcaagatcctgtgtcaaaccacacaaattacaacaaacctgaaagacctagaaacgaacccaggtgtgaccttttttaataattctcgaccaacaaaaaaaggggggctaaaatttcccgggggccattacctccccttttgtaaagggccaagggcgtttaac

SEQ ID NO: 491966 - DNA, 400 bp, Homo sapiens
  misc_feature (26)..(26): n is a, c, g, or t
  misc_feature (46)..(46): n is a, c, g, or t
  misc_feature (63)..(63): n is a, c, g, or t
  misc_feature (107)..(107): n is a, c, g, or t
  misc_feature (220)..(220): n is a, c, g, or t
  misc_feature (240)..(240): n is a, c, g, or t
  misc_feature (305)..(305): n is a, c, g, or t
  misc_feature (326)..(326): n is a, c, g, or t
  misc_feature (359)..(359): n is a, c, g, or t
tatttgccggtgtaaacccgagaggnccccactgctttcctggggncgcttggaggccacacncacctgactgcagggcaggatccgtggacttctaggcccctccnagcctcggcagtgtccccagatccggatgtggaaaccgctgaggaagtcaggggccttggcaatcatgtcctcccagtcagcaaagcccagcttgccgtcaccatccaagtcncgcctcctcaatgaccttgncgcacacaagcaccacctcctcctcatccagctctgacttagtggagccgggccagcgtcagttncaggttcctccttcgcagatngaagttgtcagtgttggaagttcatagattttngaaagggcatagtttggcctttggagctttttcgggggaag

SEQ ID NO: 491967 - DNA, 111 bp, Homo sapiens
ggtgatacaactaggcggtgatgatggtggtgatgtggtggtgatggtggtggtagtgatgatagtgatgacggtaatggtgatgatgatgatggtgccgatcaatagcga

SEQ ID NO: 491968 - DNA, 743 bp, Homo sapiens
  misc_feature (377)..(377): n is a, c, g, or t
gttcctatgttaaattcaagggaagaaagggggacccagggctggtatttttaaaaaagggtggaatatttaggtgttttggttttttacaaatgctggattaaatttggcctttaaaaaagggtggaaaaattttataaaattttcatttttggggtggccagttccctggccaccggtttttcctttacccagtgtttttaaaaatctcaaatgaaaaagttttcgatccaatattggtaagctggattataaggaatggtacccaggggtaagccattcccggcctggagcatttttgaaattcaaaatgtctgtcctgtggaacaggcagggattttgttcccaaactttggaaacccctttggaaaaaaggnctttaaattttcaggggtttgtctgattttaaaggccgtttttaacccaactgctaacaggggttaattggatccccttccttccctgaaaaggaaaagtttataagcctacgttaggattgtaatatggaaaggaagccccaccaaaatttttaaaaatttgatggtcccccaaaaatttacccttggatgttaaataaatccccctttttggaaaaaaaattttccctgaaaggaattggcaaagaggacatggggataagttggatccccctctccccccttttattttttccaggggttttttggtaaaggagggttttttacaagttaatccttaaatttgttagatcctggtatgggcca

SEQ ID NO: 491969 - DNA, 613 bp, Homo sapiens
gccagaatccggcagtcggcccaatggggatagaggcccacaggtccacagggccccccaggaggccctggcgggctggagctgtgcacccctgagagaggggacctccgtgggccatcagggcctcctggccccctgggccccagcccctgttgggccaccctatgcccggatctcccagcatggagacccattgttgtccgacaccttcactgagagcaacaaccgactggccctcgagggacccaactgggcctccgaggcccttccagggcccatgggtcccctctgggcctccgtggcccctacaggtgtccctgggagttcctggtcacataggaccccgcaggcccacactggtaccctaaaggaatctctggccacccaggagagaagggcgagagcaggactgcgtggggagcctggcccccgaaggctctgctggagcacgcggggggaaccctggccctaagggagaccctggtgagaagagccactgggggcagcgggttgcaccagactacgcgaggcttcgcaagatgttaccctgagcagggtaacacatcttggacaacaatgcattgggctctatgaacccagagctggggctctg

SEQ ID NO: 491970 - DNA, 361 bp, Homo sapiens
gctcggtccccctagttttagaagtttcaatagcatatcatattattctgtagaatgtcaggtacttcactctatttccccccccccatattatcatttatcatacattaaaatacaaatttaagtaatgaccattgaataattcatagagaaaaaagtgaagaagtgcaaaattattcaagcatattcaagtacaattttacatctgaatcctttcctgccatttaagtcacagctccctagtattaaccacccaggctggatactgtgtatgtgagcggggttgcccaaaggcgccattgctaaaaccaccccagagtaaaagcagctattaaaataaaacaacttaatcccctgtact

SEQ ID NO: 491971 - DNA, 167 bp, Homo sapiens
tccagatcacaagcagcccggcgtctagtatcaatatcagatccttccaaatctctccttaggtactcctcagaattatcttcaaaggcttcttcatcagcagctacaaggagagaggatatttcagataacactccaaaagacgtcacggtactttacagcggaga

SEQ ID NO: 491972 - DNA, 860 bp, Homo sapiens
aatctccaccatgaaagtgatgcagtgttaatgggtatgaaacgcaggaagccagttctcccgtgccccctacctccagtcagcacaccttgacctcacccccaggccctgatgtgcctctcaccatcatgaataggaaactgatgaacaccaatgatctggaggagtccaggcagctcacgcgaggatgatccagcggcatctgagatgccgatggcacctctattgatgaatgtccacgttgcgtaacgatcgtctcctgtgctggcagatgtccgacgcgctgacgtgttggacgtcaactaccttgtgcccgatgaagagccccggttcaccggggcacgagcatcgcttaccacagcaggcccttgctgcagcttccggacccacatgcttcaacatgggcactccccgcacgtacgagtatgcagttgagacattttcgtacgctgctgggtctacatgctatatgttgacaaggccgtatccgggttcacacggataagagattgtccattggaccacaccgtgtgcctatggtcactactagaagagctgcctcctggaagctttcccaagtgtgatcgccccaacgactgtgtgctgatcagagactggagagggtggccgttgagaaagtctccggtgctcgggccctcctggggagcccccgatccagcggctcgctcccagagaccttcttcacacacgatgactttgtcgctgttgacctgcttcccccaggcttttctgaaaactacgcattagggtgggaaaaccctgcttgcgagggtctattgcttctacgacgttggggcgctgttgtttgggacggaggcccaggggctttgagcccttca

SEQ ID NO: 491973 - DNA, 475 bp, Homo sapiens
cttctgagacttagtcatataatgcatcagaaatgtggagaaaagcttattagatagcacggacatctcctgtcgaatatcacatgatacacactggggagagggcctatgagtgcatggagtgtggacaggcctgtcaacgcgcaagtcaaagcttagccagcaccagtgtatacatcagtggagagaagccttacaagtgcaatgaatgcggaaaggccttcacccaccgctccaatgttgtcttgcataacaggagacacactggagaaaaatcctttgtgtgcacagaatgtgggccagtctttcgacataggccaggctttctccggcactatgttgaccacagtggtgagaacccctatgagtgcttggagtgtggcaaggtcttcaaacacaggtcatatctcatgtggcaccagcagactcataccggggagaagccctatgagtgcagtgaatgtgggaaggtctt

SEQ ID NO: 491974 - DNA, 107 bp, Homo sapiens
gtggtccctttgccccagacgtccatgtggtagtagtagtagtacataccgccccgttctccggttggatctctcgcacagtactacacggcagtgtctcagccttt

SEQ ID NO: 491975 - DNA, 401 bp, Homo sapiens
cactctgctgaacacacattgctttgtttgtataaacaagagagtttcatcctgtagtgaagcctctgctttgaggatattgtaacatagcaagttcacaccactacctgtttttaaaaaaatacagctgtatacttcaaaacaagacgcaggcgaatgcaacggctttaaatttgttatgtccctttaacacacgaaagagccacggtcgtgtagtgtcacttttttatgacaaacgagctgtgccattcatctcttcactgtacccctgaccttaactctcagcttcacgggcaggcacgcagggtcatggagtgcctaaccaagctctacaaatcgcaacatcagtgcctgaacccctctctacaagtgcggctaatcatagaccatctgaacagcta

SEQ ID NO: 491976 - DNA, 218 bp, Homo sapiens
ctggatgatgcagcttcttacctagatgctgcatgaggcaggtacacatctgactgctatccacagagctagaacagcagtggcactaccttctctcccccgtggataggccccaccccatgcggaaatgctgaggactcgtgcaccatgagaacttctgaccatgagcacttttgacttccggatacggggcatctgcccagtgtgaacaccaatca

SEQ ID NO: 491977 - DNA, 146 bp, Homo sapiens
tcgaacaaccaacggcgagtcaaggaggcttccagctgtttgaccgaacaggtgatggcacgatcctgtacagccagtgtggcggatgtgatgagggccctgggccaaaaccctaccaacgccgaggatctcaaggctcctgggga

SEQ ID NO: 491978 - DNA, 1017 bp, Homo sapiens
  misc_feature (1016)..(1016): n is a, c, g, or t
ccacgcgtccggtctcgctctgtcacccaggctggagtgcagtggcgtgatctcggctcactgcaacctccgcctcccgggttcaagcgattctcctggctcagcctcctgagtagctgggattagaggtgcgcgccaccatgcctggctaattttgtatttttagtagagatggggcttcaccacgttggccaggctggtcttgaactcctgaccttgtgatccgcctgcctcggcgtcccaagagtgctgggattaccaagtgtgagccacgcacgccgggccaaaacatttttaaaaaacaaaatttgtcatggcaaaacttctccctagggccccatcgacatgcacaaacggagtatatttgtgtaattcatgtgctgggtacacagatatacatgactttagaacacaagcagcaggtcaggcatgggggtcagtgtcgtgaaggtcactcagcacatttggagagagcttgagggcgggcagatacacctggaggaggggagacgcagaggaccacgacccaggacagatccatggtgacaacctcgatagtgtaccaaaaaatctacaccaagataagcagggtgatgacgcgacgagtgcagtgtaataccgagtaaggaggggagagccgaggaggaaggctcagagagacacagagcaggggacaagagacgaggggcaacaggaacgtgcaagcattcacaggacggtgaggggatgaagaagggaagaacaggaacgcggctaaaagatgaagaagcaaaaagaagggaggagaaggtagagaaagaatagcacgaagacaataaaagaggagaatagaacgaaatagaaagaaaaggagagggggactgaaaagactttgctgtctaaccgtatctaaagtcagaagaagaaggaaggaagggagcgatagagaagacaacacagagtatagaagacgacatagaaaaaaggaagaggagaagaaaataggtatgtctctgtgcttgatctcgtgtaggttnt

SEQ ID NO: 491979 - DNA, 165 bp, Homo sapiens
ctggtccggtttggattgcggcctgggcggggtctggcgctgctgctgctggctctccttggcctcgccgtccttgtccacaagcactattgcccccggctcaagtgctgctctggcaaagctccggtgagtgcccaggatgtgagaacagtggcaggcgaccag

SEQ ID NO: 491980 - DNA, 753 bp, Homo sapiens
gtggtgtgcgttgcgtgcattgtcggagtccggagtcgggggcgagacgaggccccccattcgggtcaccgtcaagaccccacaaggacaaggagtgaataattgttgatactgcgatcgagaccgtcggatcaaggaggtccggagtccatggagatgcgtggtcataggagtcagtggcagaaccccctgggtccgaggatagtgatgtcatagagccgcgtggatctgtagtgcgtcacaatgagttatggccaagaccccagtatgcagcgagatttggaatgggatgcgtcataacgcgtgcagcatcaggagcaacgattgcgtccggactaagccccttggaacctccattgaggggccaggaacgcactgggtgaaggccttggctcgcggcaagtctccagagtcgcatgtgaatattcgcagaaaagcagtagaagtgccgagaaaaaccactgtgcgacgccgaggcgacctcatgaagcccaaaccctctttgagaggaggcaatccccgtgggagagggattataagatgcactcgtccccggccctgtccattggttactatcgtggaagcgctcctgagtgaaggccccacttggttcgagattgctggcgcggtggcaaaccaggtttggtgcaatcgggaatccccttcttctttccacgtggcccgggggtgactcctgatgatgcaccagtcgctccccagggcctcctgtagtgatcgtgtcgacattggagg

SEQ ID NO: 491981 - DNA, 258 bp, Homo sapiens
cacgagggcggtttcggtggatgctgcggttgcaacagcttcgggctcggagctttggcggcggtgccggtcggctaagctgcgcggtgcggaccccggagcgcggtccgggttgctggggcggcgcgttggatgcctctaatggaggagattctgagcagcacacctgacccagtggctttgtgagggagctcaaaccaaagactatttcaagccctgcatatcaaatcctgagggccataggacaccataacacgg

SEQ ID NO: 491982 - DNA, 1158 bp, Homo sapiens
  misc_feature (1158)..(1158): n is a, c, g, or t
actagttctagatcgcgagacggcgccctattctatcctaatgaatcatgcctaatatagcacattctctgttctatgtaggcaggggggggggaagatttatatggtaagaggcgacgagaagcgtaccgagcctggtgataagctaggctctgtccaagatagaatcttaagttcaactttaaataggccccacagaggccctctaaatccccacatatgataaaataatacactgtataagataccaacagaggaacagctctaatggacactaggaaataaacctatgtaagaggagagtaccaggatggtaacgagccgatagtcaggtcctagggatagtcaggtgcgagccaactctcgagggagagaggcgtatccacgcgctcggaaggagcgcgcgagcttaccctaagtgagagagtcgcgcaaaccattatacagcgtgaagagcttcccttcagaacccaaactaggaaccgaggtgcttaatcaaccccctaattaggcaaaggaaagctaaatggtaaagtaatttaaggttaacccaatgcagaagcgcgatttggtggctccggccataaaggcgcggccggtacagaagtttcagaagacgacctggaagactgaccaattataacatagtccccaagtagtgctaacaattcaaacccacacgaagttacagtgtgaggcaccccatccaccatgctcgaaacaccagagcgacagggcaatgctccatcaatggaagggggttaagacactcacggtccgagggaacatacgtgtgaagcctcattaacccccggcggtggttgaagccaagaaaaaagattcaccctccttgaggcactcaaccaagtaattcagcaagggatccgcgccgtggcccccgggtgatcaacgattggtttaaacccgggcccgacggggtagacccctaagccggggggaagagggtacagcgagtaaatcagctgggagtcctattaaaccttagaggaagccgggaagcgcacacgaggggccggccaagggtgtacaggcagggcgccaccccctgcaaagccaggggacaaaatgacctggccgtgtgggaaacccgggcacgggaaaagggatagccggagaagaacccgtagggcccccaan

SEQ ID NO: 491983 - DNA, 1081 bp, Homo sapiens
  misc_feature (2)..(2): n is a, c, g, or t
  misc_feature (101)..(101): n is a, c, g, or t
  misc_feature (107)..(107): n is a, c, g, or t
  misc_feature (185)..(185): n is a, c, g, or t
  misc_feature (206)..(206): n is a, c, g, or t
  misc_feature (247)..(247): n is a, c, g, or t
  misc_feature (274)..(274): n is a, c, g, or t
  misc_feature (312)..(312): n is a, c, g, or t
  misc_feature (314)..(314): n is a, c, g, or t
  misc_feature (323)..(323): n is a, c, g, or t
  misc_feature (399)..(399): n is a, c, g, or t
  misc_feature (414)..(414): n is a, c, g, or t
  misc_feature (562)..(562): n is a, c, g, or t
  misc_feature (680)..(680): n is a, c, g, or t
  misc_feature (832)..(832): n is a, c, g, or t
  misc_feature (1016)..(1016): n is a, c, g, or t
angaagctacagagacacaacccattgtttatgttcagcccctagttgatgctaacagcaggacccagtgttgccgtccctccccaggcaccttttgtttntgtttntaccgcaccaccgtatgtacagccacagcctggctttgtgtacagcatgtgagatgaagcgctgatcctgtagtcacntattttcgtactgaaacatcntctttacccacttctcagtttataatgggggaacacaggcnacgtgttcttgtaacctttatttcatnaagcacttctttttgtttctaactatatacttggatcncntatgttaanaccttatttcacattccacatcattttagaatttattttcgaaggggaatagtttcaatgttttattcacttggcntttttttctcccccnttttcttttaaagaactgctcaatattccatctgttgtgaagaacctcgatttgcactctgtagtgtttaaagaaaccaagaaactctaatattgaatctcttaaatttagtgtatgtaaaccgcttaccaatacgtattgtctaaangcctttaaatctgttttattcaaagaaaagcttaagccaaaaccctggcatatgaccatgccagactgtccagtgcccaccaagaccacccttatcagcaccatcgtacactggattnccgtgcttccccgattattgaaaaatgttaccagaccacttgcctgatttttaaatgagcgtaaaaggccctctaacctatgcaggtttcccccttatgcatatagaaaatgctagtatgttttgctcacttcatatgtaacacggtgcccntatgttgtgctgtatcctgtgctttttctgtgggacccattcccttcaggagccaagagcacccctgattcccatcttgtgtgtgtttactaacccttccctgaggtttgtgtatgttggatattgtggtgttttagatcactgagtgtacagaagagagaattccaaccaaatattgctgttnttcagttttgtttgtggaatttgaaattactccaatttaaattaattactggactgtggaaatta

SEQ ID NO: 491984 - DNA, 100 bp, Homo sapiens
cgcggacccgaaatgggagtcaggagccagaacagaagcagcacaaatattttcagaaatagtaaactgttccggggactcacaaatcatggtttttaag

SEQ ID NO: 491985 - DNA, 137 bp, Homo sapiens
tcctgcttctgccccccagggtcttgtgaggaaactcgatttggggattcattttacgttcttaaatattctgatttacaaatatcttaagattcagggacttggtgaggagacatgagaggggcagaagcaggaag

SEQ ID NO: 491986 - DNA, 346 bp, Homo sapiens
cccaacgccagtcgatcttactactagatagccttagccacaccatctactacacattaggtctcagccgatgaaactgaaacctgtggcagtagatatcacactggatgggaacgatgaactagtatgaccgagtatatgactgcagggactaactggtataactgctggataatgagctgaactagaagtatctgtgcaaggagagccaaagctaagacaccggagaccagaccagctacctaagaacagctgagagagcacacgcgcgtatgtaccagctgcttgtccaagatagaagcctagactaaccctagattggcccagagccatctacatacctggt

SEQ ID NO: 491987 - DNA, 158 bp, Homo sapiens
attggatatgccatgatgcagccattgccactaccttcacagccggtgtttgccccatgcttcagagcacccacgcatgctgacgtcgggcagccatccccagtgcatcgtgtcatcctcttaatcccctcatactgctttataccaatagggggtta

SEQ ID NO: 491988 - DNA, 467 bp, Homo sapiens
ggttatgaaggcctgggtcatggtgcatatagcattgggatatgacgagagctgtggtgtaggcagattctatctaaatgtggggtgggggagaataacaaatggtaatgtgtcctgttcattgtgtcagaagccaaaagcaggtacaatttccaatgtgttttagggtggatccagacagactcagaagtgttcatggcagctcctgttcactcatcccaccgttttacctccagtccctcccacctgccgtctctgtgtgacatctggcttctggtgcccctgtagtcgtttattcctatgtgggaaaacattccccttattctcaagtagctttacaccacctttcctccactgtcttggtcttgctgaaaaccaacattactaacattactgtgcagccaccatgatttgtagctctctcatgatggagtcatctgctctgcccacactctggaaagtggggt

SEQ ID NO: 491989 - DNA, 836 bp, Homo sapiens
cggacaactccagcatcgactgccgtctcagcctggcgcagactgtcagccttctgagcacccagcgaggaggggcgggggcgatgggctggcagcccccagtctgctgcctattgcggattctgtttttgagccgtggactatgggttgtaaatttatttgtggcggagtgcgctccaggaagagccatcatccctgcccccgtttatcccacctggggagatctagtactagagatttttctacagtagtattatttttgggcctcagagggatggcgattgtggaggaggggatggtgcatctggcagcggttggatggcatggtctgcggcgctcatctgtgtccagccttttcactcgcactaatgctggtcttcagtgttttgctctcctctctctttcgagcttgcactccggtacccgatccggcgccctgagcccaatcccatgccggggggccagttggacatagaagacaggtccgtccatcccgtgcccgcgctgcggcggcgggcacccagcaagtcgcgatcagcgatccgagtgccttcaccatgacttcaggccaatgagactctatgattcccaagcgcccttgtggaccgtccgctgtgtggggtagggggtgaagcatagttctatacgaactgttccgcccgtgcatctgggcctgcgctctatcgctgcaatgtgcccagcaacgcaatctaacatgcaagaatagctcccgtccgacagcaccgtcactggagggaccacgcgctggcgagccggcttcgcctccaagtttgtcataaaggttgtctcctgtgttccctcctcccttgccccat

SEQ ID NO: 491990 - DNA, 490 bp, Homo sapiens
tccacgactgcgcgtcatatgtaaagaatcaggcacaccatcaattcagtcacatccattgttcctcactcggcgacaaggtgtgacgcgcatgagtcgcaatgtgcttcatccaaaggtaagggcagaggctccccggacattgagatgacttttttgcctcgagcttatggccagttgatattactcacgctcgacgccatgctctgcggttcgtgaggccagagtaaggaaaccagcgttgcccacgcactccacccgcacaagcatctcccgccaatgggaaatgctcaaactgcttccaaatcgtgccccaggccttactgccgccggactcctccaacagttggaagaggccggccatcgcacgacaaaacgtacggttgagcgagaccccaacgaactgtcgagcctgtttccattgcactgcaacgataaaggcacgcctttatggttggtactggcaacctggacgcgccatcgtgcgctt

SEQ ID NO: 491991 - DNA, 326 bp, Homo sapiens
  misc_feature (70)..(70): n is a, c, g, or t
  misc_feature (82)..(82): n is a, c, g, or t
  misc_feature (89)..(89): n is a, c, g, or t
  misc_feature (93)..(93): n is a, c, g, or t
  misc_feature (119)..(119): n is a, c, g, or t
  misc_feature (124)..(124): n is a, c, g, or t
  misc_feature (131)..(131): n is a, c, g, or t
  misc_feature (133)..(133): n is a, c, g, or t
  misc_feature (160)..(160): n is a, c, g, or t
  misc_feature (163)..(163): n is a, c, g, or t
  misc_feature (167)..(167): n is a, c, g, or t
  misc_feature (182)..(182): n is a, c, g, or t
  misc_feature (196)..(196): n is a, c, g, or t
  misc_feature (207)..(207): n is a, c, g, or t
  misc_feature (210)..(210): n is a, c, g, or t
  misc_feature (212)..(212): n is a, c, g, or t
  misc_feature (227)..(227): n is a, c, g, or t
  misc_feature (262)..(262): n is a, c, g, or t
  misc_feature (272)..(272): n is a, c, g, or t
  misc_feature (276)..(276): n is a, c, g, or t
  misc_feature (294)..(294): n is a, c, g, or t
  misc_feature (297)..(297): n is a, c, g, or t
  misc_feature (302)..(302): n is a, c, g, or t
aattcaaattccagaattttatggatccagtagattaataaaacctgaagggatgataaaaggggataangaattcagtccnttatttnatancacactttttaaaattaaaatccttnaaatntttcttntnaaaattttaattgccatgaagggccanctntttnacaattggcagggtngccctcctatcagnggcatccttcnggngnaagggcagacatttnagcacctttgaagattaagggtgcccaggagtaancactaggtangatncacaaggggaagagcccnttnaactntccaacaaatggggacatcaagaa

SEQ ID NO: 491992 - DNA, 564 bp, Homo sapiens
aagcataaaacatttaccatctagctcttcatagataaagttgctgactatgaattagaagaatatatatcatataaaatataaacagagaccttagggaaacgcaaatcaaaaccataatgagatattatttcatacacactaggaaggctgtaatttaggggaaaaaaggacaataacaagtgttggccaggatgtagagagattggaactctcatacattgctgatgagaatgtaaaatggtacagccactgtggaaaacagtttggcagttcctgagaaagttaaacatatgctaaagagatgcaatgaaaaacgaataaataaagtaacaataaaagaaaaatatagagttatcttagcgacccagcagttttgctgctaggtatatacccaagagaattggaaacgtatgtgtacactaaaacttgtgcaagactgtgcattacaataaacaaaaagtggaaagaagccaaatgtccatcaagtgataaataaagcaagatgtgatatagccatacaatggaatatgatttagccataaaaaggaatgagatactgac

SEQ ID NO: 491993 - DNA, 460 bp, Homo sapiens
ctagtataggacatgctacctaaaaacagaccatatattccttaactatgcatcagttttggtctagccttatgagattctgttttagaacaagtgtaacacactgatggtattataatgtatctttaaccacttattatagttatattcctacaatccaatttaaaaatagtcttattatattatatttaatgcttctgtgtcatgcttacagcaacgctgttatattagttgtcaccagtagtattcacattaactcttgcttcaaaaccccttaaaaacaagaaaaacaattaccaaacaataaactaggctaaaaccttgatccagaggattatccaacgacctttgatagcgatcagatcttaaaactccattgcacatagaaactgcttccttacttctttccagtcagatattggtcttaccagctgtaataatctaaccgtattgtatacag

SEQ ID NO: 491994 - DNA, 110 bp, Homo sapiens
  misc_feature (70)..(70): n is a, c, g, or t
aatatgaaagttacttgggaagacgggggccaaccccgccaggcaactcgaccggccgcggccgttctancttaacattccaggtgtaagttacagagctcaagttcatc

SEQ ID NO: 491995 - DNA, 242 bp, Homo sapiens
gtaacggcgcagtatgctaggaatatcggctatggtccagtgtcataggagccaacgactagatactattcacctgtagttcctaactaacctagctggaagcgacctacctggataataataaagcagttagataagagtatagtagaggctacaacacactagcacccacggactagtaggacataaagctacctagataatagacagacctagggaccagcaggactagctagtactag

SEQ ID NO: 491996 - DNA, 182 bp, Homo sapiens
agacacatgataggcagccaagtgtaaagggctatattgttagctctattatctgaatcactcagcatgtctgtccctgaaggttaccatataaaacatctagaaggagtttcacttagcaatcagctgaaagacatagaccggtggccaatcagcaagactgaataatagaactagcatta

SEQ ID NO: 491997 - DNA, 502 bp, Homo sapiens
catctctcccactccatagtacatacttgccagaaagttctaccaacccgggtttatctcacatctatgtgcagggcataagcttcatcactgggcagacccgggcgagggtcctggcccaacacttaatctgactggccctgtgtaagctacttaacctctcagcacccctggttactcctctatacattttaatacttaccttgcagggtccttgggagaaactggggaggtctaagggccatcaaactgaccactgcagagcatgcatgagtggatgccgggtcaggcagcctgggctggagtcccagctctgtccctaaatgtcagctctcttcagtaaagtagggtgagtaatgctgactccttgcctgacacagtagcttcaaagcacatggaaacttcttccattttcctactttaaatatctttattcctccatcctagcacttaagggtcagctgcctttgagatttttactttaaagcccaagaagcaccct

SEQ ID NO: 491998 - DNA, 290 bp, Homo sapiens
cgaggcgcgagagtcgcttgaaccctggagatggaggttacagggagcagagatcgcaccagggcactccagccagggcaagagtggagacaggtgtctcaaaaggaaaaaaaaaaaataaaaaggtggcgggtattacatcaaacctactcgggataaatttcccagtagggcatctgaaatggcatgggcaaaagcaaaacaggttatcaatacaccagggacatcaagtagttttaaggcaactacagtgtggagtgcttttttacggggagaaaaatcctagcaga

SEQ ID NO: 491999 - DNA, 655 bp, Homo sapiens
ggggagacgcaagatggcggcagccgcgaactccggctctatcctcccgctgttcgactgcccaacctgggcaggtaagccccctcccggtttacagtctggatgtactcaaaggagacaagactaattgagaaactgattattgagtgagaagaagtattactgtagtttgggagaaacccctgatctgtagtgactgttaccattgaagcaccagtcttgtctctcgggtccatgactgcacttgtctaccacaagcatctgaagagagttctccctgatagatctcaactagtacacacggcagcttatcttggtgtcacaattcggttggaacctcacaagcactcagcaatattcccatcgattccagcggatctcatattgggtcgcatccctacaaagggcatacagctctgcgcgatgaagtcctcaggactagttgctcatccgtgctggtgaatagggagatcgacgaaagattgggttggcatgacgcgatggatcgacacttccgagggagcctaaactctgggaggcattcccagagggacggggaatacgtgagctctcgactagagcttgcacaggatgtggccaatcaacttgtacccaagaactccgcaggtagttgctgacctggtagcgatgagct

SEQ ID NO: 492000 - DNA, 403 bp, Homo sapiens
tgaggctagaaaggccttggggcgcttcccaagggcagtcctcccgtgcgctgaccactcgccgcctggtctgtggatggagcctgtggggcaaacaagtaaacaggcacacaaaactgtcatgcaatgaacgcagcctaacatcagaaagcttggcatagctacttcccacagcgggaagtgcagtggaaaacacagcaaagccggaacgcacagcctgggcttgtccatgggcgctgctgtggccgggtcggctgggtgtcccgtgatgcatgaagccggttgctgccgaggcctggggcagcgtggaggagggcgatcccagagctctgtgggccataaacacgtggactttattctaggtacctggcagggtttcctaaagggggctgcggggaaaagg

SEQ ID NO: 492001 - DNA, 443 bp, Homo sapiens
gtcgacgcagtagccaggttgtggttacagtgggccctgggtgagaccaagtgctgtctggcttcagatctgactcagcatagtctcaggggtggtggctacaagggtgcttgcatcaccccaaaatcaggcagctcagcacagaaagagagacttcatttctttgggagaaggtgagggaaaagaacaagaggctttccctggtaatccagagaattcttctatatcgaatccaagaccaccaaggtggtatctctatgagtcagcataaaccacagaatgattgggcttggggcatgagttccttagaatacttggaaagctttcccaaaaaagatgagcacagactgcaaagcctacaataaatgcctaactcaacaatgcgcagacactgatgaatgtccacaaagcatcaagaccatccaggaaaacatgacctcact

SEQ ID NO: 492002 - DNA, 921 bp, Homo sapiens
  misc_feature (919)..(919): n is a, c, g, or t
  misc_feature (921)..(921): n is a, c, g, or t
aggtttgtatgtgagagtttaaatctgatgtgaagctcaaaaaaaaaaaaaaaaaaaaaaaaaaaaaaaaaaaaaaaaaaaaaattctcgggggtaattttggggtcccccacttcttgggattttaaaagggcgagagagagcggttccccagtatttagacacccctctttttttaagattggactttcaccctttgccccggtggctcctttatattccaggtccctcgtgatatattggccctggcttggtggctctagggaaatttcacctacattccctttttaaaggggcgtactaaccggtattcccggtgtagctttgggctttccccgggttttttcacacggttttagtggcacaggaaacccttcactttttcaatttacgtgtcccgaatgaggggcgtaatagtgggcggcgaggtcccacaattggggtctcatctttctcaactcggggggtttacgcggtgttaccccttttttttttgcggggttaaatattccccaattaatggtttttttcacctttcgctttgaccccaggctggcaccgttttggttaccccttccgaaggaaatacactcgggcgcctcgggttatttttacattaccactgtgtcgggccattgtgaacggcggctatttttttggggagcgccggggttcttaccgcggtgcgccttgtcccagtccgtgtttacccaaattaccttgggttaattcgcgcgtgcttacttccctggtggcttggccgtcggcttgtggttggaacgcttaattttcggtaccttatttttgctagttcggtgatgcccaggttggtggatggctaaaccgcgaagattacgagggttgcgaacagggttttgggggcaaagtgcctctggcttcgttgtcgatgacctcctcntn

SEQ ID NO: 492003 - DNA, 279 bp, Homo sapiens
  misc_feature (1)..(1): n is a, c, g, or t
  misc_feature (5)..(5): n is a, c, g, or t
  misc_feature (44)..(44): n is a, c, g, or t
  misc_feature (137)..(137): n is a, c, g, or t
  misc_feature (234)..(234): n is a, c, g, or t
  misc_feature (277)..(277): n is a, c, g, or t
ntcgnccccgcccgcgagcccgccccgcacgtcccccgccggcngcaccatgagcacaggcctgcggtacaagagcaagctggcgaccccagaggacaagcaggacattgacaagcagtacgtgggcttcgcacacntgcccaaccaggtgcaccgcaagtcggtgaagaaaggctttgacttcacactcatggtggctggtgagtcaggccctggggaaagtccacactggtncacagccttcttccttgacagactttgtacaaagaacggaaantt

SEQ ID NO: 492004 - DNA, 275 bp, Homo sapiens
attaggttggataggtggggaatctgaagtgggtacattttttaaattttcctgtgtgggtaacacaaggtctacattacacaagacagagttcagggatggaaaggagaatgaccacatgtgggggttcatagttttccttgaatccaccttttaattaccagagtagtgccaaaatgtgatttttgaggtccacagggacctatgaaaccagacactttacacaggcaccccacggggtatgtgatacgtacatgtacaggagtaggggtagt

SEQ ID NO: 492005 - DNA, 313 bp, Homo sapiens
acctttacaggatgaaggaggagactcccctgtgagatgccaaaagaatcttatctgatgggagacatagtacagcttttgtgcatttatgttctgaatgcagtcaacaattctgatctagagtttcaaagtgaaagtacattagcaccataacatgcgtctataaagcctacccaaatcttagtaatcatgaccagcaatgacaagaaaaaagaggagcacctttacaagcagttgatatccactattaaaataattgtggctttaaaaatatttctataactacttgcattacactttacttcttcaacca

SEQ ID NO: 492006 - DNA, 146 bp, Homo sapiens
ttttttttttttccaaagcacattttaatcatttattttaaaagggggattaaagcatttaaactgccaatcctataaactaggacttgaacttcaagggaaaaataaacaaaaactaaatgataaattctttcaaaagcacaaaa

SEQ ID NO: 492007 - DNA, 161 bp, Homo sapiens
cgggtgacgctagaggcctgtttatgagctggaaggagtgagaggggacaaaacccaccttgttggcgcctgcagggtgatgctggcacatgagcccgtcccaggcgcatgtatatgacctggaggtgggtttgcgattggaggctggagccagccttcct

SEQ ID NO: 492008 - DNA, 1380 bp, Homo sapiens
  misc_feature (785)..(785): n is a, c, g, or t
tggctataaaacatttaaggttaccctacaatacaaggtaaacttttatgaaaaaaatttaaagtccccctaaattttctttcagtaaatttatctcacatgtgactatattctcaggcgcagtacaagtgtgggggcccgtgcatctcctttgggtggatgtggatttcccggtggcgtggtgttcccctcacaagtctccataaaaaaaccaggtgtgtgttaagagcgcgggacgctctcctgtgtgtgtctcaagcgcccccgggatataatgtgattcgcccctgtgattttggacattctctgtggggagttatcatccgctctccttctctctcagctcatttttctctgtgaaacctctcttgtgtggcgtgtggccctgtggtgcccccccatatatagacacatttttctcacacacacgcgtgagcctcacatgtgtgaagagggtgtctcatgagagtgtctccatatttaaaggcctatatagagtatattataaagagagcagacacacaggtgtgtgtctactctctctctctgtggcgccccactctctctctatatatttctcacagatatatctcaggtgggagtgagagagcgacacagcgccaaaggggcgtgttgggtgtcggcacacaaaaccgcgtgagagagcgcggagcagcgaagagagccggttctctgtgagagagagagagaggctgtgtacagcaacaagcagcgagaaagagacaccacccccagagtctccacagataatctcccgcagaganagcgtgggaagaaactcccgcacaagaaataaaccccgacgtgataacaccgccggtgtggcccacaccatactccacaagcagcacatcttccagcacatactactcttccgccgggggcgcctattaacaacacgacggacttctattgagaacgccgagagggtgctctactcaccgccgagaggggcggaaccacgaaaggaggcggtgttgataccaccgccgcccctaattaaacagcaggtggcgggccctgaatgggcgcacctattaattgttggggggtggcaacccccccaaagaagaaagagccctcttatcaccaaggttactacttggggggagggacatcccttcggtgcgcccgacgccgcacttatttgtcggaaggcagacattcaatttaccaccccacagagacaggccgaacgtcgcgtgctcgacaacaacccccccaaccaaactatccccacaaatggtatacaaccacgacaaaagtggttattacacaggacgggccctcttgtgaggacccccccccgatggttgtgagagatacaaacccacaacatagcaaagaaacaaccgccag

SEQ ID NO: 492009 - DNA, 694 bp, Homo sapiens
  misc_feature (1)..(1): n is a, c, g, or t
ntcaagtactttgaccagttgctgcctatgtcgggacacaggctccagaagttctgtgcgctcctagctttccactatggcaagctgtgtaaggggttctacgagattccatataacctctaaaagagcgtgtcagtgtatcagtcggtgtcacacgagggcgctgagcatgtcttcatgcgccatctgcgagcccttggggccattgttgtatcagttatgtgtctgggccaccattgtgggttccctgtctggccagctgctacaggagcgggcccagtcctgggatgagcgactgcgcaccctgatggatgagatggctagccggatcctgtactgcctggacaaggtgaagcatcaggtgtcggatgtgctcgcctaactggaggaacaggcccagcatatacgcgtgcaggccgagtctttcctggaccgcctcaagatctggttccagcccttggtgcaaaacatacagtatcagtgggccgggctgatgcagaaggtgtgctttgccgttggctccagagcggtccctgtgctcagttacaatcattgaccgcccaagcctgcagccatgcgacccctcgccctcccgtgcttcctgcctcagcgcagcttgcatcgtggagaccctgtccccgccccagcggtcctctggggtggtccctagtttaataaagattcaccgagtttc

SEQ ID NO: 492010 - DNA, 425 bp, Homo sapiens
aagggctagtgttccagcgatccaagtggaaaatgtacaaccttttatactcagcctctggagtcccaaaatgtcacttccactgcattctcttggtcaagcaagtcactgaggaccaacccagattcaaggggaaggtaatcagattctgcctctcaatgaaagaaatagcagagacttgatggacaactttaacgtgtcacagacagccagagctgcttgatgagattatatgccaatggaacaagcagcagactggtcagcaaatagtccaggggcagaggctaccttgaagaagtgactagaaagcctattgagtagtatagtgaataccgtttgaggactaagctgctgagagtctgaggttgctgccttgtgctctcttggaggattcctgtgatgccccccacctctactaaaaatac

SEQ ID NO: 492011 - DNA, 360 bp, Homo sapiens
aacatctccgccttacgggttcaagtgattctcctgcctcggcttcccgagtggttgggattacaggcccgtgccaacatgcctggctaatttttgtatttttagtagagacggggtttcaccatgttggtcaggctggtcttgatctcctaatctcatgatccgcctgcctcggactcccaaagtgctgggattacaggtgtgagccacggcgcccggcctattcatttctaaaaacttaaacatgcatctcccaagaacaagaatattctccaacagaatcatatcattgttaatctgaagaattttaacactgatatgattctgttggagaatattcttgttcttaggagatgcatg

SEQ ID NO: 492012 - DNA, 515 bp, Homo sapiens
ggcttattttggaaaaaaaaaaaacaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaatttcccttggggggcccaaatttacccctccccaattttttttgaaaaaggggcccctttaggggggcctttttaaaccttggccctggcccgttttttaaaaacttggaactggaaaaacctgttatttgggaatttttgaaaggaaccttttttttggggggggaaaaaattggaaaaacttcctcccgaattttaaacctttaagggaaatttaaaatttttaagggttaaaggggtaaaaccaactgaaaaaccttggcgtttaaaaattttgcttaccgggttttatttttaaaaattttttcccccgggccttgggatttaaaagggtggggttttttaaattccaaagcccaagggttttt

SEQ ID NO: 492013 - DNA, 2775 bp, Homo sapiens
  misc_feature (26)..(26): n is a, c, g, or t
  misc_feature (2353)..(2353): n is a, c, g, or t
ggaacgagcgacaagggaaaacaacnaaaaacatacggctaggtacgaggctgggtgttaggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctggtgcgcgtgctaggtcccacggggggccagggggcgggggcnaggcctgcaggtgcctgacgggggctggcctgtgtccgcagctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 492014 - DNA, 297 bp, Homo sapiens
tctacggaatagtagcgactctgctgatgtagatgtaggctcctcccagcagtaaggagatgatgaggactgggatgaagatagccaggggcgtgttacccccttccagcgacgtctctgctgccgcttctgctacttctaaagcatgttcaagaactgtcttgattaactttacacacgggcaggagcccgttccagtgtgatggctgtcccaggatgcagcggatggtcacttgagccatgagttcaaagcctccgtagcacatgaaggtaagggactctcttggcttactttaa

SEQ ID NO: 492015 - DNA, 138 bp, Homo sapiens
agcgcgatgtaagcgcgatcattgccgagctggacaagcaattccctggcgtgcccgagctcggtgaagacatcgagcaattcatggaggttgcccgtgctcagcactggatcgaacttgcctgacctgccaccgaaa

SEQ ID NO: 492016 - DNA, 2574 bp, Homo sapiens
  misc_feature (26)..(26): n is a, c, g, or t
ggaacgagcgacaagggaaaacaacnaaaaacatacggctaggtacgaggctgggtgttaggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctggccccatggtctcccttaattctactgggttggggtgcctataaattcttt

SEQ ID NO: 492017 - DNA, 1058 bp, Homo sapiens
cacgcgtcgcaacgggatgccacatttcataactgtttttaatggtaaaaaaaaaaaaaaaaaaatacaaaaaaaaattctgaaggacaaaaaaggtgactgctgaactgtgtgtggtttattgttgtacattcccaatcttgcaggacccaagaaagttcgcagttgtgaacagaccctgttcattggagaggcctgtgcagtaaagtgtaaacccttttcattgttactggtacgtggtacaccgtggaatactggtaaacattaccgggtaataataagtgtctcacagttggaaacaggaaaacgcgtggggtcagcagcaagcgtgtagtttttctaaaaagtgttttagattaacacgtttgaggagaaaaaaaaaaagaggggttttccccccaaggttttcgtgtgtgttggacccttacaacaccctgtgaacctctcttttctcttccctcctgttgttggtattgaatttcccctgtgtagatttcccccttctttagacctgtgtttacacccttttagcgcttgacggggattacgcgtgccaggtgtgtgttattattttttgcggtcgtcattggccacattactccttggtctcccccacagttgtgggccctcccttccagagatacccccttttaattagtattgaccagcttacacggtgcggggacccggcacaagcgggagacaccggttttttatatcttgtttgccagaattatttcgccccctttgggtgtgcgatgccgtaaacctgggtcctcgtataaaggttcctgtcgtgtctcagcgccacatcacgcttatagggttaattatacaggagcatgcgaagggaaggacattctaaaacgcggctttgcacaagttccttgtcagcgtagacctctttgtgcagaaccccagtggaattttccggatacacgcggtttgtgttcaccggtgctaactagtgtgtaaccccatatccgtatggcaaagagacacatcgacagaactaatattatgtcatcgatagtcaatcatgtataacaaaggagcgt

SEQ ID NO: 492018 - DNA, 2666 bp, Homo sapiens
  misc_feature (26)..(26): n is a, c, g, or t
ggaacgagcgacaagggaaaacaacnaaaaacatacggctaggtacgaggctgggtgttaggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgcgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 492019 - DNA, 242 bp, Homo sapiens
tttcagcatcctaggaatttttaaactaaaagcaaaatgttttttccagtttgtttttttcaaggaattactattgttccttttgtcccaggtaaaatcagtgttgggaattataattttagaaaaatatttccccgtaaccttgaatgtagatggctaaacgatttttactcagtgtgatgtataattatgcaacaggggcccttgtaaattgtcatacgccaataaaatgtcccaagtta

SEQ ID NO: 492020 - DNA, 1844 bp, Homo sapiens
gggtggctgtagctctccagctctagcagccgggctcaccatgcctccctgcatgctcacactagctgttctcctgacagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 492021 - DNA, 1847 bp, Homo sapiens
gcatgtccaggtagcctggggcctagtctgccagccctggacttgtaggtctaaggaagaaatgggttgagaagcaattggtgaggtccttaggggatctgaggtgcccgtcagcttgcttgtttcttctttggagggagtcaggactgaccggtaggtctgaggtgatgagacttagttctctcagaacagacctccctgcagggcgggacctgtgaacaggtagaggtggggatggggggacaagggaacgaggctgcagtggggacctgtagaccacctaccggcatggccagctgtctactcgggtgttgcccctgggaggctgtggtcccgggtactgcatggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 492022 - DNA, 221 bp, Homo sapiens
tgaggctcccctctcaaccctcaagtagccgggactataggcattaccacgcctggctaattgttgtattttttgttttgtagagtcggagtttcaccgtgttgtccaggctgctctcgaactcctgggctcaagtgagccgtctgcctcggcctcccaaagtgctgggattacaggcttgagctaccatgcccggaggcccttttcatagatcttgtaca

SEQ ID NO: 492023 - DNA, 357 bp, Homo sapiens
gggcctgagtgctgtttgagttgtgcagggaggtggtcttgtggtgcctgagccacttccctccccagcaggcttcctgggcttctcgcccctcctggctgtgagcttgccaacaacccaaacccttggcctggtggtttgcaatggacagattgaatttgctacttcccagttatgtgccttgagcaaatctaggcttggagccccagtttgtaaaatgagggtcgtttgcaaatataaggccaaagggagaagcagcctataagcttttcaggacaatttgttaaggtgagcttttagtgagcaagatactttcacatacctctcctcgcgtccacaggggcttttttcagggag

SEQ ID NO: 492024 - DNA, 1768 bp, Homo sapiens
  misc_feature (26)..(26): n is a, c, g, or t
ggaacgagcgacaagggaaaacaacnaaaaacatacggctaggtacgaggctgggtgttaggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagaattgccccgaagtccagaattgccccgaagtccagaattgccccgagtccagaattgccccgaagtccagaattgccccgaagtccagaattgccccgaagtccagaattgccccga

SEQ ID NO: 492025 - DNA, 1502 bp, Homo sapiens
  misc_feature (26)..(26): n is a, c, g, or t
ggaacgagcgacaagggaaaacaacnaaaaacatacggctaggtacgaggctgggtgttaggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtcgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 492026 - DNA, 930 bp, Homo sapiens
  misc_feature (13)..(13): n is a, c, g, or t
  misc_feature (80)..(80): n is a, c, g, or t
  misc_feature (89)..(89): n is a, c, g, or t
  misc_feature (144)..(144): n is a, c, g, or t
  misc_feature (220)..(220): n is a, c, g, or t
  misc_feature (317)..(318): n is a, c, g, or t
  misc_feature (332)..(332): n is a, c, g, or t
  misc_feature (342)..(343): n is a, c, g, or t
cacgagatcaagncagcagaggccgctcatgatggcagctcaaaaaataacccaccaatcagagtccgtgtcctgtgacngtggcgcgntcggatgcagaggagcttctcagtgcgttcctcctcatctcggaacctgccaccncactcaagcgcgacataggccagacagccaggacggccgcagcgagcgcaacacgaggcccgtcgacatcctgagncccccgcgcctgtcgccgagtcccggcttggggagtgtccccgggccacactggtcctgctcccggctgtgtgatcaaccaggcgcgtggctccaannacggggaccagganctggtgtgannaaaatttaccataggagacgcccatacttgcagctcacgcctttgtctggtgccctggcctcacacctataggaattgggtacctgggggcctcttcatctttacttgtctcagcttagagaagcccagctacacttcctccatgcctggattcatgcacggccccacagggtgaggcctggacaccctcacgggcactggggctccacggatgcagaaggcagcctggcccggtagctcgggggtctgagatggaggtggagtaagacagagtgacaaaggctgcgtcctggaggcaggctcggagcctccctgagctcagagagcccgcgtgcgccaggaagccacacctgcaggacccgagtcggaactcagaggctggtacagccgcggtgcttgtcctgtagataagaatggcctcctctggcggccaaagttaattaaactgacaatcttgataagttgcacagttacctgctcggggacaaagaagatgggagccttgtttgtggtttcttcttgttctttcctgtgccccacagtcattttaaaattaaattaaatggcttatctgcactaaaagagga

SEQ ID NO: 492027 - DNA, 159 bp, Homo sapiens
tcttaagatcccccgcgtaaatagtaacgaaaacggaaaaccatatatcatgtagagatatataaaacacaagagccaataggcatagtaatatcccggtacatcacacactcacataaaatgtgtaaagagctcaagcactatcaatccaaagggtca

SEQ ID NO: 492028 - DNA, 829 bp, Homo sapiens
  misc_feature (2)..(2): n is a, c, g, or t
tntcggcagaggggcccctgtagccttttcgggacacaccttatgatgctggccccattgcccttccatggtggctgagcaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 492029 - DNA, 931 bp, Homo sapiens
  misc_feature (13)..(13): n is a, c, g, or t
  misc_feature (80)..(80): n is a, c, g, or t
  misc_feature (89)..(89): n is a, c, g, or t
  misc_feature (144)..(144): n is a, c, g, or t
  misc_feature (220)..(220): n is a, c, g, or t
  misc_feature (317)..(318): n is a, c, g, or t
  misc_feature (332)..(332): n is a, c, g, or t
  misc_feature (342)..(343): n is a, c, g, or t
cacgagatcaagncagcagaggccgctcatgatggcagctcaaaaaataacccaccaatcagagtccgtgtcctgtgacngtggcgcgntcggatgcagaggagcttctcagtgcgttcctcctcatctcggaacctgccaccncactcaagcgcgacataggccagacagccaggacggccgcagcgagcgcaacacgaggcccgtcgacatcctgagncccccgcgcctgtcgccgagtcccggcttggggagtgtccccgggccacactggtcctgctcccggctgtgtgatcaaccaggcgcgtggctccaannacggggaccagganctggtgtgannaaaatttaccataggagacgcccatacttgcagctcacgcctttgtctggtgccctggcctcacacctataggaattgggtacctgggggcctcttcatctttacttgtctcagcttagagaagcccagctacacttcctccatgcctggattcatgcacggccccacagggtgaggcctggacaccctcacgggcactggggctccacggatgcagaaggcagcctggcccggtagctcgggggtctgagatggaggtggagtaagacagagtgacaaaggctgcgtcctggaggcaggctcggagcctccctgagctcagagagcccgcgtgcgccaggaagccacacctgcaggacccgagtcggaactcagaggctggtacagccgcggtgcttgtcctgtagataagaatggcctcctctggcggccaaagttaattaaactgacaatcttgataagttgcacaagtttccctgctcgggggaccaaagaagaatggggagccccttggtttgggggttttcttttttggttcttttcccttgtgccccccacaattcattttttaaaaattaaaattaaaat

SEQ ID NO: 492030 - DNA, 1230 bp, Homo sapiens
  misc_feature (12)..(12): n is a, c, g, or t
tcgccgcgcgcngcgccgagcgaatctcggagtcggtgggtgcagatggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttgtgagtagtctgtcccgatggccatgcccttgctccttctggttccccgctgctcccctgggtccagctggcctcagcagaaagctggtgagccgtcctgataaccaggaacatgacagagagagagtcccagggattcctgtgcagcgtgtcctggacacaggtgtctctcttctgtcactcaccttcagtcccacagattcatgccttgaccctggtaaggccctatgtggcttgtgtctgcagcagcaaatttcttagcaactccaaacttcctggactctgcagaattccactgtgccttttgtcgatcctggggaggaatgattctcaccctcgtcgacattccttgccctgtaattgtgaacagaagcttgctgctgcttctctccaggaagatcaggtcactgtgagggcaagcagtctcttgtcagttttggagagg

SEQ ID NO: 492031 - DNA, 731 bp, Homo sapiens
  misc_feature (12)..(12): n is a, c, g, or t
tcgccgcgcgcngcgccgagcgaatctcggagtcggtgggtgcagatggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagaccccgcccgcccgtgtcccagaatgcactgctgaggagcatgcccacccccacccccgcagtgtgcagattaaagcaagtcagatcatcaaaaaaaaaa

SEQ ID NO: 492032 - DNA, 128 bp, Homo sapiens
  misc_feature (11)..(11): n is a, c, g, or t
  misc_feature (101)..(101): n is a, c, g, or t
gggaataagancttccacgaggtgatgctggctctcacagtcttagaaacctgtgtcaagaactgcgggcaccgtttccacgtgctggtggccagccaggncttcgtggagagtgtgctggtgaggac

SEQ ID NO: 492033 - DNA, 209 bp, Homo sapiens
  misc_feature (13)..(13): n is a, c, g, or t
  misc_feature (16)..(17): n is a, c, g, or t
  misc_feature (27)..(27): n is a, c, g, or t
  misc_feature (30)..(30): n is a, c, g, or t
  misc_feature (46)..(46): n is a, c, g, or t
  misc_feature (55)..(55): n is a, c, g, or t
  misc_feature (63)..(63): n is a, c, g, or t
  misc_feature (74)..(74): n is a, c, g, or t
  misc_feature (76)..(76): n is a, c, g, or t
  misc_feature (83)..(83): n is a, c, g, or t
  misc_feature (86)..(86): n is a, c, g, or t
  misc_feature (94)..(94): n is a, c, g, or t
  misc_feature (104)..(104): n is a, c, g, or t
  misc_feature (107)..(107): n is a, c, g, or t
  misc_feature (117)..(117): n is a, c, g, or t
  misc_feature (119)..(119): n is a, c, g, or t
  misc_feature (124)..(124): n is a, c, g, or t
  misc_feature (143)..(143): n is a, c, g, or t
  misc_feature (172)..(172): n is a, c, g, or t
  misc_feature (176)..(176): n is a, c, g, or t
  misc_feature (204)..(204): n is a, c, g, or t
ctgaatattaatncanngctttccgangcngtaactaagtcctccncgcggtttnttttctcngttaagccagntnttaactnggnttttttcngcataaaacngangactcaagangnatcangcactgtatacagaaacgngctgcgtatcctacagaaagctacagacngccnggggtcagaatcattcggattgtttcangttcc

SEQ ID NO: 492034 - DNA, 174 bp, Homo sapiens
  misc_feature (18)..(18): n is a, c, g, or t
  misc_feature (23)..(23): n is a, c, g, or t
  misc_feature (57)..(57): n is a, c, g, or t
  misc_feature (63)..(63): n is a, c, g, or t
  misc_feature (108)..(108): n is a, c, g, or t
aggggagaatccacatantcaanacatagctttcttaaggagatggagctatttaantttagnaagggcagctgctcttctttctgtgttctgaaacaaggcacgaantaaagcttttacttcactggaagagaaagcagctgccaggggtccttttccatctgcccaccgatc

SEQ ID NO: 492035 - DNA, 399 bp, Homo sapiens
acgaggtgatttctgcctctagttcattgtccagttaacttcagtgagcctttcaaagttgacattgtaaataaaacaacttaagaaaagtatgctgaaatagaattaacaaaacatgatacttgttcatgaatcggaaactggaatagggcagcttgaagttaaccatgtgggtgtcttccaacctctatgctgctggtaacttgagtgcagctgggctctcttaattggatctgaggccttgttttttctttttttttttcttttttttttttttaatcttctcagctttgaatatgttgcctagagatttagtttactacccagtttgtggttttggagtgggaactgtaactcaacaatttgttagcttttcaattaaaaaagacacttacttca

SEQ ID NO: 492036 - DNA, 466 bp, Homo sapiens
atagtgacatgtaattgaaattgattaaatagttacctatagactaagggagcctacgttaaagtgcttattgttggcgtattttaactttatagcgaataccacgcaatgcaatgagcccgctgacgctgcggggttgccgcgaccggcagggctgattaaccccacaaagaaattgggacttatttagccgccgaccaagtgcaagtgcaaaatatatgtagttgagcagtataatggtggtgctgctagtataaaatagcaattacagtttgtatttatttatactaattaaccccaaagcgggacgagggcataattttggtactacgagccagacgcctgtatggttaaattaacaaggcaaaattaaggtttacgatgcgtactacatactacatggtgcttttaaagaagggtatggaatggaagtgaaacgcagacttgatacaaattacttgccgtg

SEQ ID NO: 492037 - DNA, 459 bp, Homo sapiens
gcactatgtagattgttcacaactcgtacatgcttaggtgataatgctattaggtatcatggcccactacagtaatctaatgcttacctgggtcaaggcatgacacatatctctacgcaataatatgacagaagcaaccaggttttctccgccgttatctgtcatccccagcctcattcagactgtgccgtattataatagagcactctgaaatgtggagcacccccatcttttgcatacgcgtctcgttagtgaactcatgaacagcacatggtcaaacaagcgttgtccgcactgcgctactgcaggattcgaaagccttaactgtttacccagcggtgcggtatgaaaccaatatcagctttaaattatctaaacgcaccacgcgtttgacatgcatattttgaaggacttataccacccggcaaccgttagggcaggccccggacctcatgtcgc

SEQ ID NO: 492038 - DNA, 134 bp, Homo sapiens
tccaagtgtcgcgttatctcatctaatcttacagatactttcctacccccctgtagtgtggatccgtcataggagctcgggaacctcgcaaagtgcgatcgcgagagtctctcgggcacttcggacactgttcc

SEQ ID NO: 492039 - DNA, 390 bp, Homo sapiens
ggtagagctgagagtgcggagtgtgtgctgcgggctcggaacacacatgtatgattaaaaaatccaaatcagatctaaaggaatcttttaaaaaaccgcaagaacatttacaagtccgcggcttccccgacggagacttatattttatttcttcctctcttattaacccggtgaagcagccgagaccgacccgaccgaccgtgggcccgcagcagctgcaagaaggaaccacgagaccgagggcttaccgctggccggacccgacaccgtcaccctcgcttcccgacggcagacggtagacagcgcgagaggaacgacccaggtctgaggccgttgagtagttatcttccggatgattgttgaccctctgcgcttgctccccgctcattt

SEQ ID NO: 492040 - DNA, 743 bp, Homo sapiens
  misc_feature (1)..(1): n is a, c, g, or t
nctgcctgcctcctaaagtgctgggattacagtcgtgagccactgcgcctggccccgagtgcctgtcttatggatgtattgaatgctgctgtgtacaagatcacatgggaagtatgaaacacaagagactgtatgtttttaccgtgtaggagcttatagtgcaattgcggaaacaatgcatgtactgaaacgataatttatttggttatatatgcagtgtaagtgctagcaactactggggttattgacaggaaatcagaggaaagctgtagccttgtaattaagtcagaagagcttcatggatgacatggaagttgaagtgggacttacatgatgcctgtattgaaattgcataagggaacttcaagcaaggggactggtctgagcaaaggcatacaaagagatggggaagctaaaggtaggtttgggagttcagagtggacaagtctggctcgctggaggggaaatttggagtctagttttggagggtgttgaagagcagagtttgactttaacttgaggaaaatagggaactttggaccgttttgggcagattgaagcagtaaatggtttatgttgtgctacagcatataggattctttggaggagagagacaggctgttcttttccaggaatacactttgttagcaggaagggaccagactcgtagggacagtgggaagacaactttcattcaggaaaactatgtaggaaaaaatcagtagtcagacatgactgcacgt

SEQ ID NO: 492041 - DNA, 845 bp, Homo sapiens
  misc_feature (26)..(26): n is a, c, g, or t
ggagtaagtcttatagatgaacgaantcagcgcttgaacttactagcagataccgctcgcgcccgttgggacctttttcacataattcgctgccgaacggatcctccccggtaaaagactgtactgaaaccgtgtgtgttaaacacccgcgggtccccacaaccgggttcggaaccatatttacgggccccccgaaaaggggaaccaccaccacaaggagtgtcgagtccccgaaaagccgggccctttcccagaaaggctcgtgaatctgcgcaaaaattaaaggggaaggatacccccgggggggagcacaagtcgtggaagacacccctgcggaaggccccccctaaatggccagcacggaaaccggtgtacaaatcggggaaaaagcagagcgggaaacaacaaagggggggtaacccacacccggggtaaacagggccctaagtaccaccaagagtgtccccccggtagtcacctccggaagccgcagacccccaacgggcgggcccagcagaagatgtgttttaacaagaaattgcttcaacaatgcattgcgtatctttgagcgcacccacttattaaccccgggggggaatccacagatgtgcgactccccacagggcacaccgcgactttgggaacttgatgtatcttctggggagcttatatagatgtggacaaactgatctgtccactaacaaggaattaattggggaccggacaacaatatagttgccgccgaaatgggatgcaaccacccctttctgattaaagccaatcaatttcccctttctcctgcggggaattatttacaaaaaaaaatttttttcaacccaaataac

SEQ ID NO: 492042 - DNA, 275 bp, Homo sapiens
tgcagcttccccatcgtcactctttaggcacaaatgcaggtgcagcttccccatccccactcttagggcacaaatgcaggtgcagctttcccatccccactcttagggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactcttagggcacaaat

SEQ ID NO: 492043 - DNA, 769 bp, Homo sapiens
  misc_feature (136)..(136): n is a, c, g, or t
  misc_feature (334)..(334): n is a, c, g, or t
  misc_feature (339)..(340): n is a, c, g, or t
  misc_feature (352)..(353): n is a, c, g, or t
  misc_feature (559)..(559): n is a, c, g, or t
  misc_feature (572)..(572): n is a, c, g, or t
tctccacactgggtgacagagtgagaccctgctcagacgaaacaaaacaaaaaaaacctcaggacatcaggctaccgtgggccaacattccatctggtaataactggcaatcagctgggctgggtggccactgtcntctttagatgggatctgctctgcactctacttcgcagtcaccacgtttcttgatcatctcccgacacccagctagcttcccttgtttgaaatttttgtttggtctctgtgggtatttgagttctcaaaacttgagtgtccatcagaactacctgagatcctattaaaacgcagattctgccaggcgcggaggctcaanaaaannaaaaaataaaanncagattcctgggcctcatccaatttggaatgtccggggtggagcccaggggttgagtttgcaacctctgccttacctaacagtgtgttcccaggtccctgtgcccaacaggtgctttttgggcccagtaatgtctgcttctactcctaggcgtgggtctgtcaacatctctgtttctgtctctctgcaggctgtctctcaaggtgntctcttctgctgntagcaactcaaaaatcccaacagcactccctatcctttccctgaccccagaccgctgccaagcctgttctcccccattacaacatggtctcactcagggcctggactgctccaaaactcgcccaggtctccagctctcctctaccacccaacaccctgggctcacttaaggatcccaaataaactctttatttatat

SEQ ID NO: 492044 - DNA, 105 bp, Homo sapiens
ggcccggcatcggaatgttcgaggctataactacgatgaggattttgaaggatgatgatctctacgggccagtctgtaggaggatggattattgtattttcgccg

SEQ ID NO: 492045 - DNA, 417 bp, Homo sapiens
  misc_feature (136)..(136): n is a, c, g, or t
tctccacactgggtgacagagtgagaccctgctcagacgaaacaaaacaaaaaaaacctcaggacatcaggctaccgtgggccaacattccatctggtaataactggcaatcagctgggctgggtggccactgtcntctttagatgggatctgctctgcactctacttcgcagtcaccacgtttcttgatcatctcccgacacccagctagcttcccttgtttgaaatttttgtttggtctctgtgggtatttgagttctcaaaacttgagtgtccatcagaactacctgagatcctattaaaacgcagattctgccaggaccagtgtggagagagccagtgtggagagagagccagtgtgccagtgtggagagagggagagagggagagagccagtgtggaggggtaccgagctcg

SEQ ID NO: 492046 - DNA, 332 bp, Homo sapiens
cctaagttgaagttttacagagagtgcctaggatcaggcagggcacacagaaatatcttgggccagggtcgcctggtcacattcatcaaagaaactagacagaaagcaacccaccgtccgcttcccagtgaacctaatataccctagaaagtccagtaattctacctaatctacccaatttgtgcctttgatacgagcttcagcattctctttttcacaagacgctaagtcattttgagtggagtgccatcacacgttaattacctagcctgacaaaccccagggcagctgcttttcctggggctgtgtctgccagggaggcagcgggagtt

SEQ ID NO: 492047 - DNA, 1131 bp, Homo sapiens
  misc_feature (275)..(275): n is a, c, g, or t
  misc_feature (344)..(344): n is a, c, g, or t
  misc_feature (360)..(361): n is a, c, g, or t
  misc_feature (375)..(375): n is a, c, g, or t
  misc_feature (377)..(377): n is a, c, g, or t
  misc_feature (403)..(403): n is a, c, g, or t
  misc_feature (410)..(410): n is a, c, g, or t
  misc_feature (415)..(415): n is a, c, g, or t
  misc_feature (418)..(418): n is a, c, g, or t
  misc_feature (427)..(428): n is a, c, g, or t
  misc_feature (434)..(434): n is a, c, g, or t
  misc_feature (436)..(436): n is a, c, g, or t
  misc_feature (438)..(438): n is a, c, g, or t
  misc_feature (446)..(446): n is a, c, g, or t
  misc_feature (448)..(448): n is a, c, g, or t
  misc_feature (455)..(455): n is a, c, g, or t
  misc_feature (462)..(462): n is a, c, g, or t
  misc_feature (479)..(479): n is a, c, g, or t
  misc_feature (494)..(494): n is a, c, g, or t
  misc_feature (513)..(513): n is a, c, g, or t
gtgacgcgtgggtcgacccacgcgctcgaagggctgacggaggtaccctcattggcagtatgggggcattcacttggcatatccttagagaagctctaaggtagctgcagtcaccttacctcgatctggcaggtgctagaaccaacatcatacagtattctatgtctaatcaggcgcccttacccaatctgccattgctctgccaagcccatttacgccccgacctcatgcatccgaaggctctactgggtccctggacctaaccctgctttcancctggtggccttaactacagtggaggtggaacttcccaggaggggaagggacagaccagccccaaccgntgggccaacttccaannattccagctagaanancttccccctgacaccctgtgactgancctgtgncctgnctncctgcccanncatgcncnancggctgtnanggcagtncccgganaggccagagggttgganctgcagggacccgtntggacccacagcctctgtnctagagatgcttgtataggctgttaattgtgatgaataaacgttcaaccctcggcctgcagccagagtaagccaggcagcgcacccaaaagaagagcaacaaaagggcgacggacagcaaaagagtaccgaagatgagcccaaagaacacaagaccaacgagtatcaggacaagatggagcaataaagagagcgagataagaaggcaagattagccaaatacaacagagaatgcgcaaacatggaaactagtaaacacttgcgaaagaaaccatactccaagcgggcacacagtggagaccacaccacgacaagatataagaacatgagacactaaccaatacacgatcacaacgatacaaaaagagaggcaagagcagggagggaagcaaccggacacaggccgagaaacggacaacaaggagcagcgaacagacaacacaaaccaagagaacagcacgacaagccaaacagaaaacaagagcgaccacgacgcacgggcagcaacaagcaacaggaagacaaaacaccacgaccagcaacgacatcgacacgaacacacgcacaaccgacagcaccaccagaacaagaacgacgacagaagcagaccgacagagtg

SEQ ID NO: 492048 - DNA, 117 bp, Homo sapiens
agagcgcctcaatcccggataatcctgcattatcacttttaaatgttcccaaatccgttttggtttcccaattctcccctgaccaaatgactgcatgaatggttttagaggcgctct

SEQ ID NO: 492049 - DNA, 640 bp, Homo sapiens
cgtacatgcaggcctcacgcgctgctactcccaatctatattctgcgccaggcccgactgccgacctaggactcattgcacgcggtcccagagcacatctgaatcacccaatccttggcgtcacacggcgtgtgcacaaccaccctgtcctccataacgtcacacacattgacctcacaacacaataccaaggcgcctgagttaccatgccgtgcacctggggcagcgagctcgggaccacgatacaagtgtacgcgcaaggcctttaacactccgcaacgctacaagacacgacacacgccaagacgaatgacaactccgacgcgaactgtacagagggcaccaaaggtaacgggacttcgacacgcgacactcgccgaacgctagcagggaccacatgcaacaccccgctacgccccaaaccttggacaacacgtcccatcgaacccaaggaaaaaattggacaagaacacacaatctgcatacattcaatcacacacccaaccccaaaataaaggcaaaacacaccaaacaccatctaacaaaaacccacacctcccaaaacaagaaaagcaccatctcaccaccgttcccaactcatacataacgccacaacacaaacactatacttcgatccaaa

SEQ ID NO: 492050 - DNA, 892 bp, Homo sapiens
  misc_feature (281)..(281): n is a, c, g, or t
  misc_feature (368)..(368): n is a, c, g, or t
  misc_feature (376)..(376): n is a, c, g, or t
  misc_feature (380)..(380): n is a, c, g, or t
  misc_feature (394)..(396): n is a, c, g, or t
  misc_feature (398)..(400): n is a, c, g, or t
  misc_feature (407)..(407): n is a, c, g, or t
  misc_feature (410)..(410): n is a, c, g, or t
  misc_feature (418)..(418): n is a, c, g, or t
  misc_feature (438)..(438): n is a, c, g, or t
  misc_feature (448)..(448): n is a, c, g, or t
  misc_feature (461)..(461): n is a, c, g, or t
  misc_feature (464)..(464): n is a, c, g, or t
  misc_feature (468)..(468): n is a, c, g, or t
  misc_feature (470)..(470): n is a, c, g, or t
  misc_feature (474)..(474): n is a, c, g, or t
  misc_feature (479)..(479): n is a, c, g, or t
ctgagactcggggtaccgttctgctgacccagctccctttagtcacgttggcttggctctggtaccaaatagttgggattaccgaagagtccccttccttgcgtgtcagcacggatgctgtgactgccacctgcgtcctcgtcaagtgcccgagctcgccgcgtgtgtgctgcgctgagtgagttatgaggtgcctttcccggaaccctcctctcgcctggacccaagagaggcgacagctgtggctggggctcttggtttccagagggtctggactggtntgggtgctttaaaatagatatttagttcagtggtgcttatgggggagatgggactagaacttaagtgtgagactgggtggatgggcnaagttaantatnggtctcttcaagtnnncnnncttggcntgntaccactngtcactgtctccatgtcaanatgccaaaanatgatgtagtgtngtngctntncccntattntccaccccagtcgctccttaccgtgatcctgccttggagggcatgtagcagcggtctgctcctgccacgtcccaaggccctgtggcgcaggacgactggcctgcatctctctcagcacttagctctgacgccacgcgcatctctggtactgagttcaatcagtagtccaggcgagaagcttctgctacttcagagcttcggctaagctaacctaatttgtccaaatcaccccaaaaccaccatctctgacgtaacgcttccatgcgacaggctgatccgtttccctggcacaggtctcttcctggaactgcagcccaggcacctgtgcctcctggcacccttgacgtctctcctttgacgccgcggtcacccacagggctgagcgacgcatgtcccgaggtcccgcccttgac

SEQ ID NO: 492051 - DNA, 510 bp, Homo sapiens
gcaaataatcaggccaagtataagactaaaatttattctacaaacaacacacacggtcctatcataatttgtttttacaaaaaatgaggactggagagagaaattgtgctccaaagcttatcatacatttgtcattaaatcctagtctaattgtttttaagctttttgcctacattttagactaaccctgcttattcctgtgaatcaagtggcgatctcctacagcttggatgaaacaaaatgggatggataacataaaaatctggatcaatatgctggttctgggcaattatcctgcaaattctgccaggagtaccaagacaataaaatagagaaagaatgaatagtcttttcaacatatgatgctgagacaactggatatccacatgcaaaataataaatgaagttggaacccttcctaacaccatacacaaaaatcgactgaaaatgaatcacagacctacatagcaacaatgtgcccagctacaaattacgattctatcacacaaa

SEQ ID NO: 492052 - DNA, 233 bp, Homo sapiens
  misc_feature (10)..(10): n is a, c, g, or t
  misc_feature (30)..(30): n is a, c, g, or t
  misc_feature (32)..(32): n is a, c, g, or t
  misc_feature (45)..(45): n is a, c, g, or t
  misc_feature (52)..(52): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (86)..(86): n is a, c, g, or t
  misc_feature (93)..(93): n is a, c, g, or t
  misc_feature (95)..(95): n is a, c, g, or t
  misc_feature (160)..(160): n is a, c, g, or t
  misc_feature (162)..(162): n is a, c, g, or t
  misc_feature (166)..(166): n is a, c, g, or t
  misc_feature (175)..(175): n is a, c, g, or t
  misc_feature (177)..(177): n is a, c, g, or t
  misc_feature (185)..(185): n is a, c, g, or t
  misc_feature (187)..(187): n is a, c, g, or t
  misc_feature (193)..(193): n is a, c, g, or t
  misc_feature (200)..(200): n is a, c, g, or t
  misc_feature (208)..(208): n is a, c, g, or t
ggagacacanacacacacacacacacacananacacacctgattnggaaganaggacaacagaagactntctaanggntgcctggnttccttntnatctcaggactctaaatactctaacagctgtccagtgttggtgattccagtggactgtatctctntnaaanacacaattntncctttctntnattctntttgagnaagttggnagtttaattaggtttccaaccaacc

SEQ ID NO: 492053 - DNA, 297 bp, Homo sapiens
tgggacgtagctcacagatcccagtccttctctaatactctgttataggtgctttattaaatattcacttcctaaagtggactcctgaggtgtacctattcagtattcggctttcactggactctcaataagctctaaactttaagaaaaaggccttcttggattctggatgagaacaccgagatgtgcaccagaaccagacttcgatggtggcccttttgaattccttcttctttatactttatttggtggtgggtctggaacttctggttccccaaatatggtgatggcataaat

SEQ ID NO: 492054 - DNA, 514 bp, Homo sapiens
  misc_feature (75)..(75): n is a, c, g, or t
ccctacttcagatatatcagcaccctcatcgatcaatcatctctctactggtatctctggagagagtactgtagntgagacgagtcccggctacttagagaaccagtattaatgtggtaggaatttagtttccaggaattgtctcgtcatgttcagaaataagccaagttctgctccagcttccttatcggagtctactccctgaacgcctcttgaggtatagctttctgactgccattgctgctggtaactgcggcaagattgccattctgcccagtactgtctttttctgttgtaattctctgctggtacctggtcttcttctgttccccgtccccagttgttctttgtcggtgggccccaaaggctcctgcttatattaatagtttctggggcctctttgaaggctcagatctagtccttaaggcctggtaggagataagtgtatctcattccagcttccatagttcttcctgacttgctgtcccacccaggcaccagagcaaataattcc

SEQ ID NO: 492055 - DNA, 893 bp, Homo sapiens
gtgtcgcccatggcagttgatgggagaagatgaaggttaaatatggtggaaagtgcagtctttcaaaatgtgtccctttgcttctgtgaatattagggcaagtcgtgtcgcataatagaatatgtagtagagggggtggggaggtaaattcctcgtgactgtgccaatgaaaagagaagggaaccacagtggatatgctagcattttagtgtgcaaagggaggtagtgtgggaaaagtgttccattcgtgtgaaaagcccaaacagaatacggtcagaaggtcaactcgcagggtttgtgctgtgattcctgatgaataatagtttggagcatcttgtggttaaataacttcgttaaaatctgcctagtttggatgaattctttgtgtgaaactttgaaagagaatagaagtatgacatatagaagttaagtacaaaacagtttaacaaccgattaactgggggtaggaaaatggaactgtgactcatatcgctactggcatctggcatctagtatgcattctgggtgtgtaatctgaaagggaagacatttctacctaagatccaattgcattatgtatcacatgaggtgcacgttcactggaaattctattcccttctaacactttctcactgagtgaccaaataagttgagaagtttagcactggttagcctaagtatgtgctggacatgtttgggccgaatcggtcctgggcctgtgttctatcaaacttcatcatgtcctgtcttatggataactaggcctgaccttgtggtcattatagcaaggttccgtctataccaagcctatgggatccatgagatgcccaccatggggtctcggtccaagggtccccaccaaaggggggacccggtagatagttggaagagag

SEQ ID NO: 492056 - DNA, 192 bp, Homo sapiens
gcactccagccttgggaccagactaagacgctgtcaaaaaaaaaaccaaaaacgacaaaaaaaaaccaaaccagaaaaattaaactagggcatgacagtccctggcaaatgctgggagggaggcagcagtggtcagggaaggtacccctgagcaggacttgtaaagcaataagattggaggccaaggtggtg

SEQ ID NO: 492057 - DNA, 722 bp, Homo sapiens
tggaaatgaagtctccctctgttgcccaggcttggagtacgggggtgcgatttggatctcactgcaagtttccacctcccgagtttccaggaattctccttgcctcaggtactcagggggctgaggcaggataatcattttgacacccgggtttgcagtgagccgagatcgtgccatgttgcactccagccgtggattggcagagcgagactctgttcttcaaaaagaagaaaaacaaaaaacaaaacaacagaagagagttaccactagagaggagttgcccggccacaacaacaaaggggtgcaccaaacaggagaaaacgccgggaaaaagcaggcaacccacgcctggagccacaccaatgtgtggggttgtccttatgtggaaaagccccccctaaacacagaagaggggttataaatcaccaggggagtgcaacgtcgtgccaccgggttaaaaaaacccccacccctgggggtatacgtgctgcagacgtggtggaaacaaccatgtggggcgcggcgccaggcaaaacaaattatgagaaggacggcgaaaaaacatcccccccccgtgtataaagcacacgcgttgtaggggagaaaatccgcccgaggagggaggaaacacactgaaccagcgtcatgaatccggggcttcgagaacagtgttacaacccacaacaaacgcgcattctggagaggaagaaccaaaaaccaag

SEQ ID NO: 492058 - DNA, 144 bp, Homo sapiens
atcagcagagcatacaaacttgacactttctaaccgacactctggtactcccccggtcacgacccaccctctctgctctttcttatagcaacgcgttcagcaacagagatgcagagattcgtcgaggttgggtacagaccgtcg

SEQ ID NO: 492059 - DNA, 383 bp, Homo sapiens
  misc_feature (82)..(82): n is a, c, g, or t
gggattttttgtttgtttgttttgttttgtttggtgtttgttgtttgtttttttgcccccaattttaggattccttcggccntgctagataaaagctgaaggtcctttatgtttgtcttttaatgcttcattcaatattgccatttgtagttgagcgggggggttgggttgcttggggtttaaatttttccagggggtgggtttggcttgttatattaagcagaaatcccgcaatgaaagggactatatttgctagcctctagccaagatattggccataaaagaatttttttgtctttaaatagaaccaaatgtctatcccctttaaccaagggggaacttatattgaagcccatttgatacataataaaaaattttgccca

SEQ ID NO: 492060 - DNA, 297 bp, Homo sapiens
ttgccatcatatctacgtcgtacacttgaaaagcaaaattgcaagtatttttgtaatttagatcaatagaaactcaatcaagagcctctgcaaggagacacttgaatctggtgtcacagccacagacaacacacactcagtggcccctgctgcgtcaccctccctgggacgcagagctagatccagagtcctgaagtacatctaaaacaacgtactgtacacggctccttcctcacccacgctaatgtgctcggcattatgtacaattctgtcaatacggatttagttctaaagaca

SEQ ID NO: 492061 - DNA, 312 bp, Homo sapiens
cttgaaggctttgcagtggtttggcacatggaggaggaggaagggcattccaggaggagggaggagcaaaaacaaagactcagaggaaatgagactggaaaggcagttgggggacagaggggccttgcaagctagggcaggacgtactgtgttaggttctgtggcaccataagaagccttaaatcatgggaagagccaggcgtggtgggtcacacctgtaatcctagcactttggaaagccaaggtgggaggatcacttgagcccaggagttcgattcctccctgggcaacatagggagacctcatctctac

SEQ ID NO: 492062 - DNA, 203 bp, Homo sapiens
cacgaggccgcccgcaccgagccgcgggacccgggccgtaccggggaggggccgctccgggccgcagcgcgagggcatcgaggggcggcggggacctggcaccgggcggggccggcggcagcgaccatgatcgcttttgttcaacaagctgctggactggttcaaggccctattctggaaggaggagatggagctcactctgg

SEQ ID NO: 492063 - DNA, 178 bp, Homo sapiens
ttttgtatttttagtagagacaaggtttcaccatgttagccaggcttgtcttgaacacctgacctcaggtgatctgcccgccttggcctcccagagtgctaggattacaggcttgagccaccgtgcccggctataacttcttaaaattagtaaaattggtccttaactcacaggccca

SEQ ID NO: 492064 - DNA, 403 bp, Homo sapiens
  misc_feature (333)..(333): n is a, c, g, or t
ccagactgcgaacaggtggagacggaggaggaatcattctccggaagtatgtgtaatcagatgactgactattaagcacggcttcaggatcagtatgaagacactattctatggtaattctttccttaaactttggcacttagaaaaaactgatgttgaaagattcctgaccttacctgtagattaatctttgagatttaaaaaatacactttgggccgggtatagcacttacacctgtagtcctaacactttgtgaggctgagaaggttggattgcttgagcccagaagttagaggtcagcctgggcaacaaagtgaaaccccatctctacnaaaaatacaaaaattagcagggcatggtggtgtgcatctgtagtcccagctactcaggaggctgaggtgg

SEQ ID NO: 492065 - DNA, 427 bp, Homo sapiens
atgtcgcgggatgtcgtctgaagtcttggaacactcatcttcttagttaccgttcacactaatatagccataacatatagcttttaaccgtctcctacccttgatcacaacacaagacacacctcttattactcctgtcatcatgacccttggccataatatgatttatctcctcactagctgagtaccaatcgaacccccttcgaccttgctgaagggtagtccgaactagtctcaggcttcaacatctattactgccgcatgctctttcgctctattcttcatagccaaatacacaaacgttattataattaacaccctctaccactacaatcttcctaggaacaacatatgacgcactctcccctgaactctacacgatatattttgtcaccaagatccttcttctaacctccctgttcttatg

SEQ ID NO: 492066 - DNA, 129 bp, Homo sapiens
acatgatagaccgagcttgtaccccgatagccgaaggattgctcgttgcctcggctgatcgaaagggagtgggttcagatcccgactagccctgacagtgaggaagatgggggcagcgatgggtacgag

SEQ ID NO: 492067 - DNA, 205 bp, Homo sapiens
atacccacctgagagttctatcatctgtaggctccatcatttctctcaacgccagtaatcattcaatcaatattcatgatatgagaagccttcgcttcgacgcgacaggtcctaatagtagaagaaccctcccataaacctggagtgactatatggatgccccccaccctaccacacattcgaagaagccgtatgcatctcggca

SEQ ID NO: 492068 - DNA, 1605 bp, Homo sapiens
gccaacaactgggaacaggaaaacgactcactatcaacacttgtcgtcattggacacgctagattcgggcaagtccaccactactggccatctgatctataaatgcggctggcatcgacaaacagaaccacttgacaacacattctgacgacagggacggctgcttgacgcactggcgaccacgcggctccctctcacacggtactgccatgggcctctctgcgataaacccctgcaccacgccctgcacgccgctgcacaccgatggctactcgaccccacttgaactcactcctctcctctgctgcgaaacactctctgcacgcatcccacgccacacgcctactcactgcctgcaccctacatccacctctgcaactgcacccccagcgcaccaatctagtacgcatcctctctacatcgaagacacaccactggcactttacacgcggttatcaaactcgctccagcgcccatgcaccatggtgtcttggctccctgtccactctggcgtctcgtgcctgccctggcgctgcctctcgcgcccgcaccctctctcgcacacgcccctgcgtttacctcatcccacacgcacactgggcggcctacgcaccccccgcacggagcccattgctccctcttcctgcgccctctcaccacccaacccatgcgcgcctcgccgcacacaaccaagacataaagcaaaagcatccagggctggctcccccacccacacaccccctgcgaacttctcccccaccctgcacacgcccaaccccccataaccaagccaccaaccacagagcaccccactccctgcgccgggacaaccactcgcgcccccacccgcggacacacgcctccaatccccacccctccaaccacctccccgcccggcgacaccccccagctccggccgcctccacccaccaaccccccccacaggccaccccaccaaccgccactcgccccaacacccacgccccgtctccaccccctctcccccgcacgctcctggcgcacaaccctggcccagacaaccacgacccacgtcgccctcagcggccgaccctcacaacagcctcgccctcaccacccacacctggcccccgtcggacgcgcccaacccgcgaccgcacgcacacctgcggcaacccaaggcccctgacaccccccggacctaaaaggcgccagacctggcccccacgccgtgccccactagcacccgcccccaccccacacccggccaccgacaccacgccacgcacgccccccccgtcccagccctgccccaccaccccccacgccccgcccccaccaccgcttcacgcgcccaccacaaccgcctgcgacccaaggccccacccaccaacccgccctctcgcccatcccgtcaccacgagacacaccggcgcccaccccccaacaccccgcaccgcgcacaccccgacaccaccacgacgccaccctcggactcggccacacacactgcacgctgcaccacagccagcaccactcctacaacaacccacgcacgccacgcgaccaacccacacgcacgaccccccacaccgccacacccacacccaccccggccacagaccc

SEQ ID NO: 492069 - DNA, 101 bp, Homo sapiens
tagcggagcttataaatggctgttacctaaatggctgttacttaaatggctgtggacaactgtggaaaaactgaagcgtatacagcgctgttgtcagaaca

SEQ ID NO: 492070 - DNA, 375 bp, Homo sapiens
cgtctattggccacgcgcagtggctccggctgtatcctggaactttggaggacaagtgggtggatcacaaggtcaggagatcgagaccagccatggccaatatggtgacaccccgtctctactaaaaatacaaaaattagctggatgtggtggcgggcgtctgtaatcccagccacttgggagattgaaacatgagaatcacttaaacccaggaggcagaggttgcagtgagtcaggatcatgccactgcaccccagcctgggtgacagagtgagactgtctcaaaaagggaaaaaaaaaaagtttgttactattctggttattaactttatcagtaatcaaagaaaggtggcccatcatctggcacccctgttc

SEQ ID NO: 492071 - DNA, 104 bp, Homo sapiens
cgcaccaagcgcctgagccccacctccggggagtcgccagtggaggaggccacgtcacacaccctgcatctctcctggatgcgctgacggagggcacaatcctg

SEQ ID NO: 492072 - DNA, 136 bp, Homo sapiens
  misc_feature (98)..(98): n is a, c, g, or t
gggcatggggttgtagcatcatcgcagcacatggcacggaccgtttattgtacagatgtcggtgcaggtctcttgtccatgtgccagcgaaacattgncctcaacagccaactggctgccactggaggtggtatag

SEQ ID NO: 492073 - DNA, 1878 bp, Homo sapiens
  misc_feature (995)..(995): n is a, c, g, or t
  misc_feature (1261)..(1261): n is a, c, g, or t
  misc_feature (1675)..(1675): n is a, c, g, or t
gtgtgttgatcttggttttatagctatcactgtatgttgcctgtaggccggatcacctgatgttcagcagatcggtgtgttccctcccgcctttttttctgcgttgaggtgcacgcgcccttggcggtgatatatgtccgcagaggctggtggatgtgcacacggccttcgcttttgccccccggtggtgttgcccgaagatcccctccgcgctgttcgcggttgtgtttgtttgttgtagtccgccacgcggggctttgtttgctgtaggtagctccacgcggtttaaacaccctggggtggagatagctcgtgtcccctcctccgcgcgcgcgccttttgttgggaacctgttgttgtctttcgcgccccttcccggggtctctagaaggtaatgtctcgggtgtccccgacggaactgttccccgccccgcgtgtgtcgcccgccccttcgccttagatggaggtagaagggtgtccttttttttcccgccctcggggggaggcggaatatttttccccctgagaaggggaaattgttgtggagaaccccttgccccagcgaataggtgtgttatgagaaccccgcctcaaaggctgccccccatcgtgtataagccttttgaagggggtttctccttttggaagagacccaacgccttttgggcctgttgtaggagaaatactcctgtgaggtaggccccctccggagggatgagatggtaaaggagtggccgctgtctcaagaaataagggcccctcatttattgtaagggagtgtgctcccactccccatacttgttcctcaccgttataaaaaagttgggggccaacgaataagtagaatataccttgtgagccccccccacctcccaacatatggggagaaagtcgttttatatatttatatagaggggatttccccgcagcagaagggcgccacacacaagatatgggcctttctgtcccccacaagaccctggggagaacgccgntgtgtgctcctgcacagaaagagataggataatatatagcccaccgcacctcgtggaagatcagagatgagttcctccggcgggagaagaagaagatcccccaacagcaggagatgtctccccaccacaaaggagcccccgcctcgctctcgtaagcacgcaggagagctcctcgtagaaagctcttcggagcagcttataatattatttgttgtgttcttcggagagagaacaccgtcgagaactcgttttctccgcccaactgngcgccgcctctgcgctcgtatagataattccccacagagagcctcgtgatgactgcgcgccacacgtgggtgcacatcttgtatttgtgttgtgtgccctcgctctcgacgcacacagagagtgtgtgtatagagagagtctataattgtataggacctcgtaaatataggtaagagtctccacagagtctccacagacctcgtgagaagagttggtgtggtgtttttataggggcctactaaaggcgggagagaatacactcgagaaagtgtgtgttttacactctctctttttgctactaaagtgtgtgtggtgtctctgttctaaatgtgaagctaatttgtgttgtctctgtgtggccatactctttgtctgacttcccagagcacccctctggtggtgtactcgggttntaataggcgttagtgtactcgtgtattgggctcctgtggaaaacacataatattgtggaaaagaagtgtatagttaatgggctttcttttggaactcgtgttagatagctgaatatctgttccactgttccagtcccccttctgtcccccatcttacccgatgctactggaccttgaatggttaattaaactgccccgtgcct

SEQ ID NO: 492074 - DNA, 200 bp, Homo sapiens
  misc_feature (8)..(8): n is a, c, g, or t
  misc_feature (13)..(13): n is a, c, g, or t
  misc_feature (43)..(43): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (103)..(103): n is a, c, g, or t
  misc_feature (111)..(111): n is a, c, g, or t
  misc_feature (121)..(121): n is a, c, g, or t
  misc_feature (145)..(145): n is a, c, g, or t
  misc_feature (182)..(182): n is a, c, g, or t
  misc_feature (188)..(188): n is a, c, g, or t
  misc_feature (193)..(193): n is a, c, g, or t
cagaagcnagatncacgaagggaacgtcatcgtttggaaagcntcgcaataagacgcacacgttntnccgncgctgtggctctaaggcctaccaccttcagangtcgaccngtggcaaatntggctaccctgccaagcgcaaganaaagtataactggagtgccaaggctaaaagacgaaanaccacnggaantggtcga

SEQ ID NO: 492075 - DNA, 519 bp, Homo sapiens
  misc_feature (2)..(2): n is a, c, g, or t
  misc_feature (90)..(90): n is a, c, g, or t
  misc_feature (97)..(98): n is a, c, g, or t
  misc_feature (103)..(103): n is a, c, g, or t
  misc_feature (147)..(147): n is a, c, g, or t
  misc_feature (153)..(153): n is a, c, g, or t
  misc_feature (155)..(155): n is a, c, g, or t
  misc_feature (179)..(179): n is a, c, g, or t
  misc_feature (206)..(206): n is a, c, g, or t
  misc_feature (208)..(208): n is a, c, g, or t
  misc_feature (210)..(210): n is a, c, g, or t
  misc_feature (304)..(304): n is a, c, g, or t
  misc_feature (518)..(518): n is a, c, g, or t
gnagaggaggaacatctgtaaaaaaagcagcctgaaagtcagctgtttgcaaactcatagcatatcctcaagttaaatggaaaaaaaagnaataaannagggncaaaaagaaaagggagaggaggaagaaaaataacttaaataaanacacananaaagaaaagagaaggcaacatgangtgagctggtgatccatgaaggtaggnangnaggggaatcgttttagcctgtgctgaaccaagggaagaatgcggagagggagggagggaaaggggaaaaaaaaatcagaagaaacactgggggnagagggaggaggggacacggagacaactttatacaacttgagacgaggcggcccggccggcgagttctcagtgcggtgtggcggcggaggatctggtgctggtggtgctggcacttcagggtggggggccgaggacgggcacagtctctaagcagctcccccaccccaaacacggaggccccaaggggcttgggaacaagagtctgtggcgaana

SEQ ID NO: 492076 - DNA, 265 bp, Homo sapiens
  misc_feature (173)..(173): n is a, c, g, or t
atagaattttgggggaaattctggaaaatagttttgcagttcctgaaaaggttaaacatagagttgccatatgacctagcaattccactcctaggcagtggaaaattccatggtatgtatataccgcattttgtttattcatctgttgatagacacgtgggttttttctaccncttgactgttgtgaatattgctgctatgaacatgggtgtgcaaatatttcttcaaggtcttgccttcagttcttttgggatgtatgcccagg

SEQ ID NO: 492077 - DNA, 296 bp, Homo sapiens
caacttaaaaaggactggacaatacttttaccactttcgcttctcagaattcaggcctgtcctcagaatgttacaggatacagcccatttaagctcctgtatagatgctcctttttattaggccccagtctcattcgacaccagaccaacttagactgtgccccaaaaaaacttgtcatccctactatcttctgtctagtcatactcctattcaccattctcaactactcatacatgccctgctcttgtttacactgccggtttacactgtttctccaagccatcacagctgatat

SEQ ID NO: 492078 - DNA, 587 bp, Homo sapiens
  misc_feature (587)..(587): n is a, c, g, or t
gagcctaggaattcgaggccagcctgggcaacatggcgaaacccagtccccattaaaaaaaaaaaaaaaaaaaagggccgggggggggggccaaggctggtaatcccagacacttggggagggccagagggggggcaggattcccaggggtcagggaagattgggagagaatattctgtgggttagcacaggaaaacccaattttttattaaaaaaaaaaaaaaaaaaaaaaaaaaaattttgggggggggcggaggcccttgagaaaagagttttaaagacccaattcggtgggggcgcggggggcaccaaatagagttacaggacaaccgtggcgcacaacgggtgtgtgccacaaggaggaaaccggggcaagaaaaaaggggggggggattcccccccaaataaaaaaaagacgccgcggggggggaacacacggggagggtttttggggaaacaacattcgccgaagaggggagaacatcaggagggagcacaaacaaggggggagatcttataaacaacgggggggtccaccaaagggacagcacgaaatatacaaaattagcccgcgcggtgggggggcn

SEQ ID NO: 492079 - DNA, 461 bp, Homo sapiens
  misc_feature (73)..(73): n is a, c, g, or t
  misc_feature (92)..(92): n is a, c, g, or t
  misc_feature (112)..(112): n is a, c, g, or t
  misc_feature (125)..(125): n is a, c, g, or t
  misc_feature (197)..(197): n is a, c, g, or t
  misc_feature (202)..(202): n is a, c, g, or t
  misc_feature (205)..(205): n is a, c, g, or t
  misc_feature (295)..(295): n is a, c, g, or t
ggacgaaggggtagttctttcacctcggctgggcgcctagaaaagcctagaaacagctccttttttcttccgnctccgagtcttcgcgtcangactgcgcagggcccttggngaaatcgcggtgncgttcggggcgaccgctgacctccctgggaggacgagggggctagcggcgacggctggggcgagcgctctgnggcgntgnattttttcacgtgtcgccagggccggactgcgagtctctttgcggcgctacactagagcagagtacgagtctgaggcggagggagtaatngcaggacaagcgtttagaaagtttcttccactcttttgaccgagtattggtttgaaaggagttctgctgaaactgtaaccaaaggagggcattatgcttccagaaaaatttcaagggaaaagtatttgcaaggcaacagtagttcgctgtttgggttcgggttttt

SEQ ID NO: 492080 - DNA, 668 bp, Homo sapiens
cacagcgccgagtatactctgattaccgccatgctccacgacccgcactgacagtccccacgtgagggacctgtggatgggagtgctaaatggcgggaggaggtgagagcgaggacggcactgtgcatctgcgtgtgcctcgcgagacgctccagcaggggtccccctattctgcaggatgcatgtcgcggtggcgcccgccgcccgtcaacagctcccgttcatctgtcatcggttccctcaatggagtccacgatgttagggcagaatctggacgtgcagttgagctctgcgaggaccgagaacacgactgctggtgtggaacaagcttccatgacagcatcaccctcatagtactgtcatctgaggtgggcatctctgagctgaggctggagagactactccaaatggtgtttggcacgccatggtccttccttgtgggacttgaagaactgaccaatatccgcaacgtggagagactgaagaaggacttgagggccagttattgcctcatcgacaggttcctgggggactcggagctcatcggggaccgtgaccagatgtgtggactagccgtgattcctccagagggggtccctcttgcaggaagccctctccgtggttcgctgaggccgcgggcacgagcttcgtgcagtctggtggtgtcc

SEQ ID NO: 492081 - DNA, 974 bp, Homo sapiens
aaaagggccaggtctttaacgagccaggtcagagcacagacatgtcaatctcagacacttcaaaactttatgcatggacaggagatcccagaaagtggcttttttttcttctaaaacatttcagaagtttctagtaacttccttgagccacagtttgcacatctgtaaaggagggataaaggccccccaagctctgataagacaaccccggttctcaagcttacctcgcctcacagtcctggggtgcaggaggttaaggatgtagagcccgaatcccgaactcatttgccatccttccagctgtgtggccttggccaagttactgccagtctctgagacgttttctcaactgcaaaacaggagtaactggagcaacctttcgtggagggtgccaggcgctggagcgtggctaaggcagggaccacgtcccagccgacctttcccgccctgcggcgcaggcccactctcttggctctcctggcccgcacactcagctcggccgccgcggctgccgcggaagcgcgcagtgaggctagtggggccaacgagcggcgcgctgagcaatgcgcgcccgatagagcctcgagatgcgccgggacgagctgcgctgcaagtacccgccgcgagctagcagatgtcgctgcgagcacaggctgggcacagatacaggagtgtaaaggtcataaccccggcgcgtgcgggcggagcagcacagaggctcacctgggcgtacccgaccccgttcgacccgaggctcccgagactcgtgaacggtacccggccccggacaccacaggtgccaactagggcagcaatcccaaggccgcccggtgacctcagaacgatacctagagtaggagcaaacacccgccacgaccacaaagaagatcccaccgacctacagccaagcagtagcactaagacccatcaacacacggccagggcacagcacaacgggagaccctgccacagaa

SEQ ID NO: 492082 - DNA, 594 bp, Homo sapiens
catctcctattcaacacgtgggggggcagctgtgagacataaactaaccagggcatgatgcataagctactcaaatgccttcctctagtacatagaatcttgccctacacaccagactgtggatagctgaccttatgagcctcctacgcagagcgacagatgccaatgtgttcgcgtgctgggggacagactcactccatgctgccgttgaacatgagggctgaccttctgccaagggcgcgattgcaggacttgaatcggatgtcacaactttctgtggactactctggatcacgctcaggttccatatccgtctgtgtatcaggatcagggagagggttcctaacgcagacggaacacgtttaccaactagctgacaaacgtgcagctttccatgacagccttaggtctcttgacaggaaacagccctcatgacagtcagtactcgggtcaacagggctctgaagaggattttatatgtaacagaggatgtgcccaccttgacaccgaggatcggctatagcatattagaggtaccatgattatttgaccaacattcgcgacatagaattttatagactttgtgtaacatcg

SEQ ID NO: 492083 - DNA, 112 bp, Homo sapiens
  misc_feature (13)..(13): n is a, c, g, or t
ttataatttctcnagccttatgatacataatttcatcctctgtcatcaagtggaaattgtgttatcaaaagccatcagttacctcaatcttccaagccaaccgtggactagt

SEQ ID NO: 492084 - DNA, 439 bp, Homo sapiens
cgggcagtacggatgtgaggaggtccggcagcttcctggagtactcgtttggccagcatggctggaaaatacatggaggtcagtcgccacagtaactcatgaacattctcaataaggtcgtgacctgacaccctgcatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttgg

SEQ ID NO: 492085 - DNA, 981 bp, Homo sapiens
  misc_feature (401)..(401): n is a, c, g, or t
ctttagactaaatatatactttaaagaaagaaatattatggattctatagaaaaccattaaccaacggaaaggacacgaagatcaagctaccggagcaaaagcgtgttgagaggcccaggctgtactagccgtggcggccttacctcgcggccagagtggaggccccaggcggctagcacaggtgtgaaggctggaggcccggggagcggtgtgatcgtgccgggggcatccatccgggcttctctacctaagttcatttgggccccaaaaactcagaggtatgtgcctatgctctcgggaggacacgggtacctacctacactgggaagtgggctaagcggtaccacacgggccgccgaggtggaggtaaggagtgagaatggtggcggtcgtagtacangacgttggacaagccccacgctggacacccaaggggcaatatgtaagctaaggcacaagggccaacggggactttagcagagtacacttctagaaggggtggtggcctgggacgccacccatctacacaatgggggctagtgcgcacaggacaggccacaataacaccccacaggtggagaaattaccacacgagagaacagacatcctcgcgatacaaaggggacaccaaaaaggggactgggagataaagatgaggggctacaatttcattcagcgaccatacacataaattccaaacaaatacacagacccctgtggaccacccacatacaacaaagaaagaaacacaagagcaggaggacaacacacaaaatcgagaggggaaacaggctagaccataccaaaacaaaagagataggcagccacaccacactctttgaaccgcggttccaccgaggggataacaaccccgagcgacaaagctgggaaaccttcgcccacaaacggggtccccccccacagggacgaaacgtccacaaaaaagggggaggcacaagaaggaaaggggctaccaaaca

SEQ ID NO: 492086 - DNA, 179 bp, Homo sapiens
tatctcagtttcgggacgcacgctctctctgttggggtgctttgggtctgtgtccctgttgttgatctgccttgcccttgtgtgggtgtgcagttggtgtctgtgccctagtgtggggtgcctgcgctgtagtgggatgcgatggtgtctgtgccctgtgtgaggtggctggcctatgt

SEQ ID NO: 492087 - DNA, 630 bp, Homo sapiens
aatcaaaacattgtttttattatgtattttttttacttatccctaccttaccttacagtgtgcaaacacaccccacattacacattccaagctaaggggataaccaaaccaccgggcgggtaatcaaatccttatttaatgcaaaggattacataaaatgtaatccccgtcccgaacaatcaaacccccttccccccaacacaatgccacacttcccgtaccaaaaaaaaaaagatactcccgcccaccaagctatgaagagcctttagccatgccattcccgttttctaaacgaaactgcctccccaacaaaaaaatactttaccatttcacatgcggccgcatgattcatattccaccacgcctttggtaatccaacccccccgccagaatcttaaccggagaagccggttaaaaaaccctaaccgtacctttttgttaacccaccaccccccccttcaagaaaagcccccccggcttgcaatagctccccccccctcaatggtctggggaaaccctacccactctttggtgaaaggaaatacgtttcctgtgcacacacccttacaaccgggaccgaaacattaaactacacccccgcctctcttttggcccccccacttacatttc

SEQ ID NO: 492088 - DNA, 156 bp, Homo sapiens
caaggttaggactataattatgcttaagaagcctgggctgtttaacagctcagagagttgaaagggaggggagggatgaagttgcatgtgttgtgtgtccagtgccacagccagcttctgtgcccctgccatgagtgatcttgtattgcttgttcc

SEQ ID NO: 492089 - DNA, 263 bp, Homo sapiens
ggggtcggcacatggacaactgtacaacagaggagacaatagggtctgggcgataaggcaaaatacatgctcactctacgaaggactctcctcgaataccagacactaaatattgcaagataagccagaaatcatctaacagtgctcttttcgctatatgttcgatatgtctcttgtatattaacaagatggcacatcactttctttgaaacaaagacagaaggtgtctcctcctgtgacattcatatcatccccccgtcttt

SEQ ID NO: 492090 - DNA, 328 bp, Homo sapiens
ggatcccctgaattcagcgggcatgacgaccctcgtctggggggtcctcccaagtggaccctgtccacgtgtgcagttgtacgcacacgaactgcctgtggatgccggtgatgaagccctgggccaggcggttgggccagtagcagcccacgacattggtctccatctcggtgcagttcggggaaactctcatagtacaccatgaactcggacaggttgcaccatttccagacgtccaccttgctcatcatgtctgcgaaagcctgcccacacaggggccgcctctccaacatgcctatctcgttgcagccgactgctctggggcacc

SEQ ID NO: 492091 - DNA, 147 bp, Homo sapiens
gcttacccggacccccagctctgaagagatcagccctactaagtttcctggattgtaccgcactggcgagccctcacctcccttttcttcctcgatgagcctcctgatgtagggtctgatgatgaaatagatcatgggaagaaaaaa

SEQ ID NO: 492092 - DNA, 126 bp, Homo sapiens
ctgaccatttgagaaatattgctgagttgaagagttaattgacataattggttttctgcctagaggtccaatcatctatttcagactgtcatggttggcattgttctcagaggtccaatcttccgg

SEQ ID NO: 492093 - DNA, 904 bp, Homo sapiens
caaatgttactctccgggacgcaaatatactccggcagcgccactatccccgggggtgtccaggccgcgtatcccggcgcccccgggggcgctgggaacggtgaatcagggccaaaagcgccaggggtgcggaatccccctccgcgcagcttgtgtacaccctggggaccccaccccgcggctgtaaggaggagtggccgcaatgaccaaacccaggggcgtgcatacccaacacggattggcggtcaccaccaggatgggtccaaaatccctcctgggcgcaacccagattggcgcaggtggagcactagcacccacgggggcgttggggcagcccgtcttgctcccggaagccgccccggcattcttcctctgctgtaaacaaggtggcccaaacaacgccgacttttgtcgtgttccacccccctttgtttttgtgacgaccgcgccccgccccgccacactgcggtggggctacacccggacacccggtgattccgccacgttgaatgggagggtcgctcgcagtgatcttcactcgctccgggggatgaatcagtttctgcgggttgttgtagccccccgcggcgtgtctctgcgacgagaaaggtgccgcaccactcgggggagatggcagcctgcgatgccgctggaggcgacggacgcccccctcttaggagcacgcacgtgggcaggcgaccccagatccaggtggcgagacctggaagcaggcatccgcccccgagaagcgagcagacacgcacgatctaaaggcacaccgacgaagagccaacctggggagaccccgacgcacctcgcccctctctcgcacccccaagaggccccccccgggcccccccgccttggccccaaaaaaagggggttgttcccttcaaaaaaaaaa

SEQ ID NO: 492094 - DNA, 129 bp, Homo sapiens
ttaccggtttttaactagggttgggggggtttttttggggggcccagggtggtttttcaaaccaattttttttttttaaaaataaggtttggggttggaaattttcctttaaaggccccggtttgggga

SEQ ID NO: 492095 - DNA, 343 bp, Homo sapiens
  misc_feature (96)..(96): n is a, c, g, or t
  misc_feature (112)..(112): n is a, c, g, or t
tcccacgtattgaccgaaaagggtgtacagtgccttgctgtaaatttatgatggaaaactgattttgaaccccaaaaaatagctaactaacgttanttaaaggaaaggacancaaattgggctaacagagggtgaaagctggtcacatttgtcaacaaaatctgcttgctgcagtagtagcctcaagtggttaaaacttgatttcccgagaaaactaaaccctttgtgcctaaaattgatgacttgagttcaagtgggatgagcaaaaagttgtgttaacttgttgttcaacagtattgagtgtgaaggaaattttgatggcttaataaaattccacagcgac

SEQ ID NO: 492096 - DNA, 423 bp, Homo sapiens
  misc_feature (290)..(290): n is a, c, g, or t
ataggaaacccattccagtgtacaactgccttcaaggattgaaacccttgtatgtagtccccagcctactctggaaactgaggtagtaggattgcttgaggcctgaagttcaaggcctgcagtatgcctgattgtgccctgtgaatagccactgcaccccagcttgggcagcatcagaattatagagacagaaagtagaatgatggttgcccaggggttgcaggaagggcagcgagagggaattactgtgtaatgtgtacaaggtttcagtttgggaagaagaaatgagncctggagatggattacggtgatggttgcacagcagtatgaatgtacttaatactactgaattgtatactcgaaagggttaatatggtgaattttatgtgtattttatcacaataaaaacattgaaaaataatt

SEQ ID NO: 492097 - DNA, 83 bp, Homo sapiens
catgactcccgtttgtcccaggctgtgcgtagtagtgaggaaggggtactggaacaataaacaggcactatccaaatatacat

SEQ ID NO: 492098 - DNA, 146 bp, Homo sapiens
tcacgcctccgtccccattttcctcattctcagcattcccgttagcaggggcgtctcttccatgttctgcctcttccacaacttccttcttctcctttaagtccttgtgtggtgcatttcggagcatggtgtctacaggctgcgtc

SEQ ID NO: 492099 - DNA, 137 bp, Homo sapiens
cattcatgtacaagtttcattcattactattcaccttggtagacttggtgacacctgtaaaagaattctgtctttggctcagtcttgggaactaaatttgtcgtgaattggggactgtcacagattgcctccagtgt

SEQ ID NO: 492100 - DNA, 601 bp, Homo sapiens
gccccagcaagccccactcaaggagaggctgagcccagaaatacccatccctgcacccaacctggagttctttctctacccgccttggtagccaaagacaaaggtcatcatctcttgggagctctatggccctgctcaccacacctgagaaatctgaatacttaaccaggtgaccctagggcaagtttgcattctccctatagtaccacagctgatgagctcttgaaagcaccacctcctggctggaggccaaacaacacaaaaccagtgcattaaacaaaaacacaaccaaggaccctaagggagtccagttcactcctctgctacctccaccagagtaggtgtgggtatccacagctgaaagatctgaagacagatcacatcagagcactcttcgcaaatactccctagtgccaacccagagcccagtagccctgctgggagagatttctcttctcaggaacaccaattattcttatgttggacgtttaacagtcccaaatttcttagaggctttgttcattttttaaaatttttgtcttgaatagactgggtcaatttgaaagcttgtcttcaagctctgaagtctttctttttgctg

SEQ ID NO: 492101 - DNA, 478 bp, Homo sapiens
  misc_feature (282)..(282): n is a, c, g, or t
tgagaagagtcactagccatgatctcgatattgtgcatcatgatcatcagtcagccatcattcactgtgagagtgtctccgtaatcgactgtgagctcatccatgtgcgcagctatggacacgtgtcattatattgcgtgagctcgcatcatctgctcattcagtatgtatgcagttcatctgaatatgaccatctccagattatgctcaacagtcctctcctgtccatcctgagtgtctgcgctcagggtctcaggcatcctcaggcgtctcagttcctgnaagactgtgcagttggctacgattggcatgcgtggcatgtcaatacggagcctgtatcccggatgtctttgctgcaggcctctgtctcctctcatgttcagaatcgtcgcacggtgtcgcaactcgctagcaatatcagcgtgcatactgctcctgcagcacttcagctgggcacatcaagcgcaaactgctcaag

SEQ ID NO: 492102 - DNA, 211 bp, Homo sapiens
accagtcgaaaggcacatatatccacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagtacacatggaatgcacacaca

SEQ ID NO: 492103 - DNA, 824 bp, Homo sapiens
agaacccgaggaaatgaaaagtggtcaaatcgaagtcttcttacatagggggagcgtataacacctggtggtgatgtgatgtttgatttggctggagctgcaatccatggtgtcaggtgtcttgggttatgagggctgggcttgctggacgtacgagatgagctttgaacagtgccagatagtcgaaagctgagtaagtgaatagatcgtctgagagtgggttacaggacatgtggagttcgcgagatacagactaatgtctaggattggacggaattgggaggcagtcaatttatcagaaatgttggtgaagatcttgaactacttcgaagtgaaaccattgcgttgtgacatcaggtagcaactgcactcgtcgggcaatgcagctaacatatcaggtaggttcccgctggttccagtttctgcaagagtctaactacctctagcttaattggagtaggcaatactcagactctgagtgtctggggtgctgcttatccgtctctgctcatggtagaatgggaaagaagcagttatactgctgggatggacaactagagggtttgaggggcggtcacatggaagctgtgggacggcattaagtcggaggatgggaacgtataacttttgaggagactgggataatcaagaaggaattatggacattaggaaatactacgccattggtggcaccaaaggagtgagggttttttgaccccctatgaaatgattggctggaatacagagcggtgtgaactcgagcataacttgttctttaaacgaattacaacaggcgttgaaaacggacagaagtggagaataag

SEQ ID NO: 492104 - DNA, 301 bp, Homo sapiens
cctactcctcattgtacccattctaatcgcaatggcattcctaatgcttaccgaacgaaaaattctaggctatatacaactacgcaaaggcccaacgttgtaggccctacggctactacaaccttcgctgacgcataaactcttcaccaagagccctaaaaccgcacatctacatgacctctacatcaccgcccgaccttagctctcacatcgctcttctactatgagccccctcccataccaacccctggtcacctcacctaggctctattatctagcaccttagctagcgttactaatc

SEQ ID NO: 492105 - DNA, 137 bp, Homo sapiens
tcgatttctatgaggatcccctatttgaaaccttaatcaaagaattaatgcccatcattacacattttctatagacaggagacaaaaatgttacagcaaacttaggggtactctggtgagttattgagttataccat

SEQ ID NO: 492106 - DNA, 174 bp, Homo sapiens
  misc_feature (4)..(4): n is a, c, g, or t
cttnttctcacttcagtgcaagtccgagaaaataaaaaatcaattaattaaatattttaaaaggccaggctgggcgcactagctcacgcctgtaatcccaggactttcagaggctgaggcgggtggttcacctgagggtcaggagttcgagaccagcctggccaacatggtgaa

SEQ ID NO: 492107 - DNA, 564 bp, Homo sapiens
  misc_feature (347)..(347): n is a, c, g, or t
gataattttagtgcatgctcacccggtatgttttttttttttaactgtgaacatttggctggtttggtttttcttttttaattagataatcacacggaaaattaagctgttcatatctttaaatttaggatgtgcaaaccaaggaaagaacgcattgtgagattttaagagtgtcacttataaggggagaaggtgttcttaaaaagtcaaccagaaaacgtgttatgccttttattggttgtgcaaggactgtcttgtgtaagtgtgttctcatgaattacgattatccaattagagaataagcgtgactgtgaatacatttgtgagcacatttgtgcccgtggtgnttactatggttgtttcagcgcacattattgctgcagtgtggattttcttccaacagaaaaggtggctttcacttacgttggcacatttagacagagcaccagatgaggtttttagttccaagctccggagcacgtggggtgtgagttaacattcgacctcaagttttcttatttatcgcttaagagactatgggcatttctcatatctctttacttc

SEQ ID NO: 492108 - DNA, 320 bp, Homo sapiens
aactgatagggtcagccaactaccttaaacatgttttcattaaaacaaaaattaaaaacccagctcctatagccagacgtggtggcagatgcctgtagtcccagctaattgggagactgaggtgggaggatcctttgagcccaggagtttgcagccatcttgggcaacatagtgagacccttatttgaaaaacaaacaaacaaacaaaccaaaaccctagcaaagcacattttttatagaagctactcagtggacataattaaaacaaatggtaggatcttgaaaaaattaaaacatttagtgtgacccccatgtttaga

SEQ ID NO: 492109 - DNA, 684 bp, Homo sapiens
tcccccaaccttttcactccgatccccctaacaacctcccctccgtaatactaactacactgactcctacaccctcacaatcatggtagagccaagagccacttatccagatgaaccactgatcacgaaaaaaaatctacctctctatactaattctccctacccacatctcgcttgattatcgacattcacagacacagaactacatcctatgtatactcttctacagagaaccagcactatatccccacctatgggctcctcatcaccccgatagaggcaaaccatgcctagaacgccgtgaaccagccgggcaccagtactgtccctaatgctacacacccgtagtgaggctgccccttaccctattcatacgccacctaactgacacaacctacaacgaaagagacccttaggctccacctaacacaatctatcttaatcagcattccgccacatgacccaaagacaccataatctaagactgaccttgagagcaaaacgaacgtctaattcatgacctcagctatacaccacaatagaccatacaatacgtccaaacgcataaccccctatcacccgactcccgaacatactggatattccctgaagggcccacatgatcggcaaacacccatcccatgcgctcactagaacttgcacgccagaaccttaccaatacgg

SEQ ID NO: 492110 - DNA, 1143 bp, Homo sapiens
agcgggccagacacagtggctcacacctgtaatcttaacactttggaaggctgaggcaggcggatcacttgagcccaaaaggttagagaccaaaacccagtctctacccaaaaaaaaaaaaaaaaaaaaaattagccggggcatagttagccacagtgccggttagttcccagctatactggggaggcgtgagggtgagaaggattcaccgtgagccatgtggggaaagttggagaacgtgcacggtgagccatgtgagtcgccccaccgtgcactctccagccgggggcaacagaagtgtgagacctctagtgttcttgaaaaaaagaacaaatgtgattagaaactttagatttagaaccttattatattacccaacggggctattataggggatactggaaatagcttctcttataccaccagcctgtggtggggcccagaagccctgtgcaagacagccttttagaagaaaagctttaaaatcttttatagaaaatctctctcccagagtattctccttctcttatgtgtgtgtcctggtggcgccctgtgggcctctcttaaagttgggggcccaatctcacaaattgtgcgcgcggctaaaatgcggtttgacagaaatatatgggggcgcacatcgggaccatcacgccttctggggtgcgcggaaaaactcctttttccagagaaacgaataacactactcttcagaaggttagcaactctccccgaggttgacaccacattctgtgtggttatatgtgtctgcgtatcctccttaaaccaaaggagagagacaacggcaggaagacgatgcgtgggggctccactgtgatgtgtgggccccccgacgacgcgggtgggcctccgcttgggacaacaagacgtccgccggagggcgacctgatgaaagaacgacaacatgttcatctctccccgcggtgtcacctgagacgccgcttcgccaccaaaagaggagggtgcgccctaacgacaaccatctcacaccgcgggggggtgggtagcaaagcgcaataaccccagccagacctgggggggccgccaagaagaaacccctctcgagctacgtacacactccgctgatggcgcgggggaccacaatctgcgcgctggcaaacg

SEQ ID NO: 492111 - DNA, 143 bp, Homo sapiens
ctgcctctagagttttagactacttttcttatagcaaagctcttttatgtctgtgagtacacgactcatctatgtaaaagagcctctgtaaacaaggactgatatcgcatctgtgctctatattcatatgtacttactttcct

SEQ ID NO: 492112 - DNA, 190 bp, Homo sapiens
acatcatcctccttcacatacaggtttggattctccagtatctagggattactctagggaaggcagttaggccaaagggctacccagggtgacactgcgcatgatccgttattacagaaaagactgtctctatctttgaaagtcttgcaatgaagaaaggtagttagactactaaatctttcaatacacg

SEQ ID NO: 492113 - DNA, 382 bp, Homo sapiens
aagcgagatgtatctggaataccagtgagcgctccatgctccctgcagtggggcggcagccggtgagtctgttgctgctgccaggagaaagtgctggtcagtgtatgctgaagttgtcatgtgcctgtgtagctgcagcatccaggctgcaggaggcgattccgatgccaggtgcggctgcatcaacctaagtccacgcaggacatcgacaactctcatgatagaccagcgcgagaatggttgataatacccccttccttcctcccaggaggatactacaggacgcagatgatgatgtgactcatcagggctgagcaaccctggtgccagaagaaagatgttcctgccaaagatatgcacctccaggacatgcagtgagctg

SEQ ID NO: 492114 - DNA, 534 bp, Homo sapiens
  misc_feature (99)..(99): n is a, c, g, or t
aggtagtctaagatccctgtgctcctcttcagctatgactgtacggtgcatcagcatgagccacgacaacgtgctctgtctctctcatgtggcaggccntctcggcctctcgctgggacggagcaggaacagaatcatcattcaccgggctctctactatgacttgatcagcagcccagacatccatggtacctataaggagctccttgacacggtcactgccccccagaagaactcaagagtgctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaag

SEQ ID NO: 492115 - DNA, 482 bp, Homo sapiens
  misc_feature (433)..(433): n is a, c, g, or t
  misc_feature (455)..(455): n is a, c, g, or t
  misc_feature (467)..(467): n is a, c, g, or t
attgtcgtgtgaaaatctacactttcaatcaaagcaggtacaatgagtaaaaaattaactctgggtatgttactcctgggaaaggacttctttatcttgtttataacagagcagtttcaagatgtacaggtaccaaatattgatgttcacaagtgtttgatgcccataaaagctgagcatttgttgatatgtgattgttataatcactctggttctctaatttccagttcttaaaattcagtctgcttgagactctgttccatgtccagaatatttggggatagtttaagcctttgctttctgagagcatatttggtctccagggtggggtctgtgaaaatctttttatattcctacattattgataacctttcctatgggaaagggaatttcctttcaacacctttttatggggcttgggggtaatttaatnaaattctgggagggaatccttnggggaatagtgnggaaaaagtaaattc

SEQ ID NO: 492116 - DNA, 217 bp, Homo sapiens
tggggtttcactctgacacccaagctgagtgcagtggtgcaatcacgggtgactacagccttgacctcctggactgaagcgatccttccaccttaatctctctagtatcggggaccacatgcacatgtcaccatgcctggctaatttttgattttttgtaaaaaccaggtctcactattttgcttaagcttgtgttgaacttctgaacacaagtgat

SEQ ID NO: 492117 - DNA, 840 bp, Homo sapiens
gttgagaacaatccaactggggggtcttgtcctgttagtgagaatgctggcccacattcgtggtgagagcacccacgtgagtatgtgtcggtggtgaaagagccactgtcgatgcccgacacgagatcgagtcgatggattagcatctggcttggtgagctcaagcagaggtctcaattcacgatgtgatgatttgcctccgccgaagaagaatgaaagtcgttggcgatgaaatgaggccgcaggaagcgtcgcgagctaaagaacagcgatcgtcggtgtcgaacaagaacaaaccagatgtgaggagtcctgtgctcgaaatagtgtgtctccgacaagatttagtttgtgagcaagagtgtgggtttttgttggggatggatgtgttttgcacacacaggtggtagatagggcaaccaggtgtgggggggtggttctcccacgaagccgactgatagattgtggctgggtgagcaccgactcggtgctgtcccacaagacacatagggggttgccccacacacgatgagtggctgcgcactatggatccacggatggtttgctagacatgtgttcgcaagagccatccacctacgtgtgttggtccctttgatgttggtgcggggtgtgtctcactataaggactctgcccgtgtgtgtgcgcacgacgcgggggaagaagtggtgcggagtcgtgtgcacccactaagagggttgttttgccaacagacagaaaagtgcgcgtgtgttgagggaaggggagatgttgcgccctcctgccgtcggtataggtgatctaggtgagcgtccatccacgaccacgaggggagaagaggt

SEQ ID NO: 492118 - DNA, 111 bp, Homo sapiens
tatagcatctgagcctgaatttcacacattcctagagagaagaaatgggggttcaatcttggaccataaaattggtttcaaaggagcacaaaggccaggagcggtggagca

SEQ ID NO: 492119 - DNA, 231 bp, Homo sapiens
  misc_feature (23)..(24): n is a, c, g, or t
  misc_feature (31)..(31): n is a, c, g, or t
  misc_feature (49)..(49): n is a, c, g, or t
  misc_feature (55)..(56): n is a, c, g, or t
  misc_feature (59)..(59): n is a, c, g, or t
  misc_feature (67)..(67): n is a, c, g, or t
  misc_feature (74)..(75): n is a, c, g, or t
  misc_feature (94)..(94): n is a, c, g, or t
  misc_feature (119)..(119): n is a, c, g, or t
  misc_feature (182)..(182): n is a, c, g, or t
  misc_feature (195)..(195): n is a, c, g, or t
  misc_feature (219)..(219): n is a, c, g, or t
gagagtgcatagaaatatgcaanntaaaatntttgcatgaattcatccncacatnncangtgaagtnctccccnnattccataagatggaacantatagaagtctcatttctctgtgancttctgtccattaggaaagtaaggagattgttatctatatctagtctcctttccatattgaantgcatggctctanatcctcagtgtatttttatccctnctcgagttattt

SEQ ID NO: 492120 - DNA, 425 bp, Homo sapiens
  misc_feature (425)..(425): n is a, c, g, or t
tctcccagaaagtgcgagagccagcaaaggaaggcccacactcgagcctctgcaagactggtggtcagcacctccctgtcagtagtctgctctgcatggagtcgtgagagggcgcgaagtgtgcatggtcatctgtctgagaagtagtatggcgtcaggttactcataggagcgaagctttgggaagtagcaaagtgacttgagcatgtgcatccttggtagcttccctgtaacctaaacaaaagtggagacacgagagcatcacggcggcgtaactgacagctgtccacaatcttggatggatcccgggtgcggtgcggtgtcgctggattgcgcgtgcggcctccctctgtgtgcttgtccttcgtcaattttgttgtggtgtgctagttacattctgggcattgattgcactgtgtaattcn

SEQ ID NO: 492121 - DNA, 586 bp, Homo sapiens
ccaagttgacacttaaccctactgctcatgttgccacatcagggcatatcctgctctctgggtccaacacttccctgcactccttctttcctggagttgagccactcacagctgggactgagtttgtagagtaatgtctcagagtcacaaatcctggctctgtgggaagcctacatccaaccctagcacagagagtgaacctgtaacccaagaccccaggtgtcacgaataggttggcaagatcctgggcataagactctagtcccacggacacttcaagcacctgcacctagaactcagcaccactgcacttgcttgtaggtcatgtgatatctgacatgaagagacagtccccttggctaaatctccccattatgaaaaaaataagaataggaggacctcaaaagcccttgacaactaacattctttacaatatactttacagctggctgctcctcagacacatcaaggcccctcacatctcaatcttagtaacatgtgtcaactttgacctgtgagttcttgaaagaatagtctatatctaatgcactgacatttaaatatattgagccatggagtaataaca

SEQ ID NO: 492122 - DNA, 214 bp, Homo sapiens
gagcctggtccgctagcggcattagtgaacgtatcaaaacagacgacagaccaatggaacagaataagaatccggaaataaaccctgacacctatggtcaattaatctttgacaagggaggcaagaacataaaatgggaaaaggaaagcctattcagcaagcattgctgggcgttcacttaatgccgctagcgccgttcacttaatgccgctag

SEQ ID NO: 492123 - DNA, 143 bp, Homo sapiens
gtgagactggccatgccttacaagtgcatgcatgctcactgatttcatcctcaagtttccgcactgtgcccaccagaagtatgtcctacaagcctggcagaaggcagacatcgatactcatatacagccacggggctacccga

SEQ ID NO: 492124 - DNA, 411 bp, Homo sapiens
ggaaggcagccctgccagcatctggacattagagtttcctacccatagaactgtaagagtcaattgtatggtttaagccactaaacttaatgtggtaactgttagagcagccacaggaaactaatacacccttctgtcctaaaccagtcacttagaaacattgaagctacaatttctttgctcatttgagtgcagaataaagctaatagagttctattttattttttctcccattcattttcctagtaagatattatttctgactatttgatgagcaagaacattgaggggtaaggagtgaagttcagtaactttgcccaggttgaatggttaatgattgagcaggattaatctaagctgcagagacactgtctgggaacatcatgcaagatcagggtctcatataaaaat

SEQ ID NO: 492125 - DNA, 778 bp, Homo sapiens
  misc_feature (34)..(34): n is a, c, g, or t
  misc_feature (51)..(52): n is a, c, g, or t
  misc_feature (140)..(140): n is a, c, g, or t
  misc_feature (150)..(151): n is a, c, g, or t
  misc_feature (201)..(201): n is a, c, g, or t
  misc_feature (205)..(205): n is a, c, g, or t
  misc_feature (217)..(217): n is a, c, g, or t
  misc_feature (221)..(221): n is a, c, g, or t
  misc_feature (229)..(229): n is a, c, g, or t
  misc_feature (266)..(267): n is a, c, g, or t
  misc_feature (273)..(274): n is a, c, g, or t
  misc_feature (277)..(277): n is a, c, g, or t
  misc_feature (289)..(289): n is a, c, g, or t
  misc_feature (297)..(298): n is a, c, g, or t
  misc_feature (300)..(300): n is a, c, g, or t
  misc_feature (304)..(304): n is a, c, g, or t
  misc_feature (307)..(307): n is a, c, g, or t
  misc_feature (311)..(314): n is a, c, g, or t
  misc_feature (317)..(319): n is a, c, g, or t
  misc_feature (322)..(322): n is a, c, g, or t
  misc_feature (324)..(326): n is a, c, g, or t
  misc_feature (329)..(330): n is a, c, g, or t
  misc_feature (332)..(333): n is a, c, g, or t
  misc_feature (338)..(340): n is a, c, g, or t
  misc_feature (343)..(343): n is a, c, g, or t
  misc_feature (350)..(351): n is a, c, g, or t
  misc_feature (421)..(421): n is a, c, g, or t
  misc_feature (426)..(426): n is a, c, g, or t
  misc_feature (440)..(440): n is a, c, g, or t
  misc_feature (471)..(471): n is a, c, g, or t
  misc_feature (496)..(497): n is a, c, g, or t
  misc_feature (517)..(517): n is a, c, g, or t
  misc_feature (528)..(528): n is a, c, g, or t
  misc_feature (614)..(614): n is a, c, g, or t
  misc_feature (617)..(618): n is a, c, g, or t
  misc_feature (621)..(621): n is a, c, g, or t
  misc_feature (623)..(623): n is a, c, g, or t
  misc_feature (628)..(628): n is a, c, g, or t
  misc_feature (634)..(634): n is a, c, g, or t
  misc_feature (654)..(654): n is a, c, g, or t
  misc_feature (664)..(664): n is a, c, g, or t
  misc_feature (666)..(666): n is a, c, g, or t
  misc_feature (670)..(670): n is a, c, g, or t
  misc_feature (672)..(672): n is a, c, g, or t
  misc_feature (691)..(691): n is a, c, g, or t
  misc_feature (702)..(702): n is a, c, g, or t
  misc_feature (759)..(759): n is a, c, g, or t
cgctccgaaccttgtcctcgctgtcgcgccggcncctcggagccccacagnncgggaaggaggccgccgcgggccgggcgcccgctctgccaagcggacccgcaacccggaaaggcggcgcggcggagtggagccggatnatgctcaganngggccccggccggccagagccgcgggcatgtcggaggcgcggaaagggcnggangaggcggagganagcnagtacgantctggcattgagtctctgcgctctctgcgctccctanncgagtnnacntcggctccagcntccgggcnntngganggnagcnnnnagnnntgnannnatnntnngggannngtnaaggaannaaaggagaaggaagacgcggatggggagcgggctgattccacctatggctcctcctcgctcacctacacnctgtncttgctggggggcnccgaggctgaggacccggccccacgcctgcnactcccccacgtgggggcgctgagnnctcagcagctggaaacactnacttacatctncgaggacggagacacgctggtccacctggcagtgattcatgaggccccagcggggcggcgcgggggccgggcggggcggccccagnagnnccngnacatncaaaanaacctttaccagacagcacnccatctggcngnacancnggaccaaccgggcgcagtncgggcactggngctgaagggggccagccgggcactacaggaccggcatggtgacacagcccttcatgnggcctgccagcgccacact

SEQ ID NO: 492126 - DNA, 418 bp, Homo sapiens
  misc_feature (14)..(14): n is a, c, g, or t
  misc_feature (27)..(27): n is a, c, g, or t
  misc_feature (86)..(86): n is a, c, g, or t
  misc_feature (115)..(115): n is a, c, g, or t
  misc_feature (140)..(140): n is a, c, g, or t
tagccagttggaanaaaaagtaattgngtaggatattacctgtgccggggtatttcccccgttatttgatcaagttcctccccatncccttttgaaatatatatgtaagttaaanagaaaaaacttggcccagtccgcgngtcgtcacgccctgtaatcccaacactttgggaggctgaggcgggcagatcacttgaggtcaagagtttgagaccagccctggctaacatggtgaacccagtctctactaaaaaaaaaaagacaaaaacattagctgagcatggtggcacatgtctgtagtctcagctactcgggaagctgagatgggaggattgctttaacccaggaggtggagattgcagtgagctgagatcacaccactgcactccagtctgggtgacaaagtgagactccatct

SEQ ID NO: 492127 - DNA, 220 bp, Homo sapiens
gatccacctcggaaaatcatcaccttggacaagtcacttaacctctatctctaaatattaccacactttataaaatgaccaatattactaagtatgtaccttatgggcttacataacgtgtacgatactatgtgtaacaaggcttggaatgatgcctggaatatattacaactgccatctacttgtaaacttgtgacctatagtaactggtgctgctgac

SEQ ID NO: 492128 - DNA, 146 bp, Homo sapiens
tacccgtcagcattccagcagccgggaaggtagatgcgatatcatcgcaagactccgggagaacgggatcaaaaacgtgtgatacaggaagggcgaggagagctcccggactttcaagatgggaccaaggccacgttcccataccg

SEQ ID NO: 492129 - DNA, 524 bp, Homo sapiens
  misc_feature (45)..(45): n is a, c, g, or t
  misc_feature (57)..(57): n is a, c, g, or t
  misc_feature (102)..(102): n is a, c, g, or t
  misc_feature (111)..(111): n is a, c, g, or t
  misc_feature (125)..(127): n is a, c, g, or t
  misc_feature (129)..(129): n is a, c, g, or t
  misc_feature (133)..(139): n is a, c, g, or t
  misc_feature (141)..(142): n is a, c, g, or t
  misc_feature (148)..(148): n is a, c, g, or t
  misc_feature (153)..(153): n is a, c, g, or t
  misc_feature (155)..(156): n is a, c, g, or t
  misc_feature (162)..(165): n is a, c, g, or t
  misc_feature (168)..(170): n is a, c, g, or t
  misc_feature (174)..(176): n is a, c, g, or t
  misc_feature (187)..(188): n is a, c, g, or t
  misc_feature (195)..(196): n is a, c, g, or t
  misc_feature (199)..(199): n is a, c, g, or t
  misc_feature (201)..(201): n is a, c, g, or t
  misc_feature (204)..(205): n is a, c, g, or t
  misc_feature (210)..(212): n is a, c, g, or t
  misc_feature (215)..(215): n is a, c, g, or t
  misc_feature (217)..(217): n is a, c, g, or t
  misc_feature (220)..(220): n is a, c, g, or t
  misc_feature (222)..(222): n is a, c, g, or t
  misc_feature (228)..(230): n is a, c, g, or t
  misc_feature (232)..(232): n is a, c, g, or t
  misc_feature (249)..(249): n is a, c, g, or t
  misc_feature (257)..(257): n is a, c, g, or t
  misc_feature (275)..(277): n is a, c, g, or t
  misc_feature (288)..(288): n is a, c, g, or t
  misc_feature (290)..(292): n is a, c, g, or t
  misc_feature (298)..(300): n is a, c, g, or t
  misc_feature (305)..(305): n is a, c, g, or t
  misc_feature (314)..(314): n is a, c, g, or t
  misc_feature (316)..(317): n is a, c, g, or t
  misc_feature (321)..(321): n is a, c, g, or t
  misc_feature (326)..(326): n is a, c, g, or t
  misc_feature (329)..(329): n is a, c, g, or t
  misc_feature (334)..(334): n is a, c, g, or t
  misc_feature (336)..(336): n is a, c, g, or t
  misc_feature (338)..(338): n is a, c, g, or t
  misc_feature (342)..(342): n is a, c, g, or t
  misc_feature (344)..(345): n is a, c, g, or t
  misc_feature (354)..(354): n is a, c, g, or t
  misc_feature (356)..(357): n is a, c, g, or t
  misc_feature (364)..(364): n is a, c, g, or t
  misc_feature (375)..(375): n is a, c, g, or t
  misc_feature (400)..(400): n is a, c, g, or t
  misc_feature (408)..(408): n is a, c, g, or t
  misc_feature (417)..(417): n is a, c, g, or t
tcactgaaaatagatttcatttcattcaaattagaaatgtgttcncccaaaccgccncccaacaaaggtctctgcttgataaatgaaaagatagtaaaaganaacttcccntttctttttatttnnntntatnnnnnnntnnataatnaaaananntttaannnnggnnntatnnnttattattgtnnattattnnctntnaannaaaannntananaananataaannntngggttattttaattttngaaatttnttatctatttcacttaannntggtataattnannnagaaannnaaatnaccctcaanannaagntttcnttnagcanancntaanannaacaataananngtagggnacacctcctgngaaggtttgcttgtgttcagctgangattaatnggaaacagngaaaaagcaacgtcctgtgatcagtaactttaaagacaagcttggttccccctttctggcactactgacattcccaccattctagcttccaaattctggaaaaagag

SEQ ID NO: 492130 - DNA, 140 bp, Homo sapiens
aaattgtaaactttcttcaaatactgagggtttgtttttgtattggtattaagctcatcagctatagttagtgtaatgtattttatggtgtggcccaaggaagccaaaagattggatacccttgggcacacattatggag

SEQ ID NO: 492131 - DNA, 199 bp, Homo sapiens
aaaccccccccctggggttccttttttttcccttaacccttttgggtttttattaaccccattccgggccaattcttttttgaaaaccccccaggtttttttacagagccacccaaaaattttttgtccccacaaagcaattttttggggggttgagaaaccaggtttggccccaaaaaaaatccattttgggaaagga

SEQ ID NO: 492132 - DNA, 741 bp, Homo sapiens
tttgtgattaaaggatcgtttttatttctcgcgaagcggtttggcactccctcgggctcctccaggccacacggacacacacggacataagcacacaggtactaggataacagccaggccccaagcttagtccgcggggatttgtgggggaaggaggggggtgcctggcctccccgagtggcctttgaggaagaagaggccgcagccgatggagatcggtcggtgaagctccggggccaagcccctcccttccctccacgacccagcgcccaggctcatatggcctggtcctgcctccgtctcaggctgagctcgcgggctgctgccaggaaggctgccccggtgagcagctcggcgatgaagctgatccagcccagggccagggaccagccgaagctgatgtccacctggtccaggagggccttctcctccaagagacacagcgcctcccggaaggcggcggctgaatacgctatgtagacgctgatcccagcgagggtcaccatggtgagaagttgccggctcgattcgctgactgtcacgttctccagcctgaaggggttcatcagcggtgtgcacgggctctgcacccggcaggtccgccagaggccggagtgggagctcagaggctcgggctggctgcgattgatggaccccagcaggtcctgcgcccccgggccagtcctctccagccgctcggtgtcaatgatataccagaagtccgtgccgatggcggccgca

SEQ ID NO: 492133 - DNA, 499 bp, Homo sapiens
  misc_feature (24)..(24): n is a, c, g, or t
ggcacgaggctgatgctaatattntaataaacattcttcccaattcatatagctattcacatatatgtatagattctatttttcataaccatgataatatcatatgatatcatatggtgtgaagctacaatctggttttatccgccattctgttttataccaggaacttctttccatgacggcaaagccctgcagaagttttccattctattgattgactgttaataattcaccattgacatccatggagctatcaaaaagcatggtgagaagttgccggctcgattcgctgactgtcacgttctccagcctgaaggggttcatcagcggtgtgcacgggctctgcacccggcaggtccgccagaggccggagtgggagctcagaggctcgggctggctgcgattgatggaccccagcaggtcctgcgcccccgggccagtcctctccagccgctcggtgtcaatgatataccagaagtccgtgccgatggcggccgca

SEQ ID NO: 492134 - DNA, 879 bp, Homo sapiens
tttgtgattaaaggatcgtttttatttctcgcgaagcggtttggcactccctcgggctcctccaggccacacggacacacacggacataagcacacaggtactaggataacagccaggccccaagcttagtccgcggggatttgtgggggaaggaggggggtgcctggcctccccgagtggcctttgaggaagaagaggccgcagccgatggagatcggtcggtgaagctccggggccaagcccctcccttccctccacgacccagcgcccaggctcatatggcctggtcctgcctccgtctcaggctgagctcgcgggctgctgccaggaaggctgccccggtgagcagctcggcgatgaagctgatccagcccagggccagggaccagccgaagctgatgtccacctggtccaggagggccttctcctccaagagacacagcgcctcccggaaggcggcggctgaatacgctatgtagacgctgatcccagcgagggtcaccatggctccaaagaggaagagaattccagtgagcaggaggaggaggtaggcttggaggaggaagctcagaaaccccgtcatccccccaaaaaccatcaggatcaggctgagcggcagcagaatcacaaatgtcccatgcatggtgagaagttgccggctcgattcgctgactgtcacgttctccagcctgaaggggttcatcagcggtgtgcacgggctctgcacccggcaggtccgccagaggccggagtgggagctcagaggctcgggctggctgcgattgatggaccccagcaggtcctgcgcccccgggccagtcctctccagccgctcggtgtcaatgatataccagaagtccgtgccgatggcggccgca

SEQ ID NO: 492135 - DNA, 413 bp, Homo sapiens
tacagagctccaaagctagaggacagaggagtgatttccaggggtgaagcaaggactataagggggaccaggcacagcggctcacacctgtaatcccagcactttgggaggctgaagcaagaggatcacttgaagccaggaatttgagaccagcctgggcaacacagcaagacgccatggtgagaagttgccggctcgattcgctgactgtcacgttctccagcctgaaggggttcatcagcggtgtgcacgggctctgcacccggcaggtccgccagaggccggagtgggagctcagaggctcgggctggctgcgattgatggaccccagcaggtcctgcgcccccgggccagtcctctccagccgctcggtgtcaatgatataccagaagtccgtgccgatggcggccgca

SEQ ID NO: 492136 - DNA, 106 bp, Homo sapiens
aacttttttcttcccccctgaaaaaaaaaatttgaaaaaaaatttggtttttccaaaatttgctatgaaagggtgatgggtttattaaaaaagtccattcctggga

SEQ ID NO: 492137 - DNA, 366 bp, Homo sapiens
ctcatgtttgcagatgaagttggaggtggctcctgtattttgctggtcttgctgatgcatagcaacggttttcctcagtgttggaggaactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagc

SEQ ID NO: 492138 - DNA, 1214 bp, Homo sapiens
  misc_feature (307)..(307): n is a, c, g, or t
  misc_feature (381)..(381): n is a, c, g, or t
agcgggctggggtgggagcgggcgagatgcgccgggcgggcggtgcccactgacctccctcggcggcccggcccgggcagcgcccgagcccaggcagccccgcccgccgcgccccgccagccatgggccacgggcccacaccgcgccgcggggaggaccgagccataagagggcagccgctgagaggaacgacgacggacgagcccgcaggtattttcagtgctgtacaagcgtcttgagttactctggtagcttttccagaaagacccatgagcttcaccagcagtttctcgaggttacgatgaanggtcctctggatgtcagcatggcagccacaaagctggagaaccagctgcacagcgcacagagagaacctcctgnttccttcagacgggagcatgccagcacgcatcaaggggctgtaactccgagaatcaggcggtctgaaagcagcactgcacagatttacacatatgagctgacagtcaaagagttcggaacagacaggagacgggacttctaaaagcaggtgaattaaagacaagatgtgaagagcatggagaaaccaagactgaacacgtgcaccagacgcaccgcacacaatgcctgcaggttgttgacacggacactgcagcagcagacaaacgccgacagcatacacaggagcaggggaggaaacacgcattcgaagagaacgaagagaacaacgtacctggaaagaagcatgacaggacgcagagaagtgaaaaaagatggacaccaagaaggatcagacacgagaagcaggaaaggagcgcagaggcacaggacagaaagagccagtaaccgaaaaaccacagaagagagaaagcgagcacaaaacgagagatcaaagaacacacaaaacggagactacagaatcgccaaaccgcgacagggagagcgcgccgagcgagcgcgacgcgtacgcagagaagagagccacgacgaaaaggaagagagatcaccgacaaaacgagccgacaagcgagaagagaaaagacagagcaggacacaagcacacgtgcaccacggaagatgaacaaacgatacaaacaaataggagacagagcggacacaaaccagcagcaggcaccaacagacgtagaggccgaagaccacacaataggagagagaaagaagacggacacgaaaaagcaccagtagagcaatcgcggcaggagagagagtgacct

SEQ ID NO: 492139 - DNA, 1291 bp, Homo sapiens
  misc_feature (384)..(384): n is a, c, g, or t
  misc_feature (458)..(458): n is a, c, g, or t
agcgggctggggtgggagcgggcgagatgcgccgggcgggcggtgcccactgacctccctcggcggcccggcccgggcagcgcccgagcccaggcagccccgcccgccgcgccccgccagccatgggccacgggcccacaccgcgccgcggggaggaccgagccataagagggcagccgctgagaggaacgacgacggacgagcccgcaggtagcccagcggagtggagtcctgaggcatccaccggaacagcgcccacgaagtgtgtccgtgatgaaagctatcatggcttttcagtgctgtacaagcgtcttgagttactctggtagcttttccagaaagacccatgagcttcaccagcagtttctcgaggttacgatgaanggtcctctggatgtcagcatggcagccacaaagctggagaaccagctgcacagcgcacagagagaacctcctgnttccttcagacgggagcatgccagcacgcatcaaggggctgtaactccgagaatcaggcggtctgaaagcagcactgcacagatttacacatatgagctgacagtcaaagagttcggaacagacaggagacgggacttctaaaagcaggtgaattaaagacaagatgtgaagagcatggagaaaccaagactgaacacgtgcaccagacgcaccgcacacaatgcctgcaggttgttgacacggacactgcagcagcagacaaacgccgacagcatacacaggagcaggggaggaaacacgcattcgaagagaacgaagagaacaacgtacctggaaagaagcatgacaggacgcagagaagtgaaaaaagatggacaccaagaaggatcagacacgagaagcaggaaaggagcgcagaggcacaggacagaaagagccagtaaccgaaaaaccacagaagagagaaagcgagcacaaaacgagagatcaaagaacacacaaaacggagactacagaatcgccaaaccgcgacagggagagcgcgccgagcgagcgcgacgcgtacgcagagaagagagccacgacgaaaaggaagagagatcaccgacaaaacgagccgacaagcgagaagagaaaagacagagcaggacacaagcacacgtgcaccacggaagatgaacaaacgatacaaacaaataggagacagagcggacacaaaccagcagcaggcaccaacagacgtagaggccgaagaccacacaataggagagagaaagaagacggacacgaaaaagcaccagtagagcaatcgcggcaggagagagagtgacct

SEQ ID NO: 492140 - DNA, 942 bp, Homo sapiens
taacacaggtatctcctgcatgccatcgagccaggtgagatctgaatgctcccgtggtaattgctacactagctcttgtggtgacatgtctgattcgtttcaaggctgtcctagtggatggcctaggtgtactgtttgtcctgaactttagacgatttcatgacagagaaagtagtgtccataggatccttgaatactattggcgcaagattctcagggtagagccgaatcgactaggctagggttgtgcggcgtctgcttctccccagaggtgaatgggctgatactactgggggcctagcccgaccgttcacgtgaatttgcgttgaggcgtgcctgcgaacccatcattattcattactatgaggggtgtcccttcggctccctaactgcctgatcgtttgtgatccgtcgcaagttctagccctctcgtgttcggccatttggctgtgcttgccctgtccctgtggttccttgcccagtgtcccacccttggactggcagttttgtgggcccctgacattgtcgcctccgacatgtgtcgtgtcattccatcctgggttcttaccctgaatgagcgtggttcctgctttcttgggctggtgagtccttgagacgaagtgtggtgggcctggttggaagctcttggtttgttgatgctcccccgctttgagtggacaagcgtttgcggctgttttgatcgctttcgtggcctgtggagcaccgtcgtccagggattgcgaaagcctggtcaggctgtctccagttggccggcccggctaccggccgtttccggggcggggcctcaggttctcgtttggccttaccgaagtggtttcaagacaacgcccgcctttcgcgtttgggcgcgcaatggcccacgaggcctttccccgcctttctagagagagggtctcccctcggttgggcgaccacttgcgg

SEQ ID NO: 492141 - DNA, 188 bp, Homo sapiens
cagtgttctcaagacacataattgtcagattcaccagagttgaaatgaaggaaaaaatgttaacggcagcgagagagaaaggtcgggttaccgcacaaagggtaagcccactcaggactaaacagctcgtatctcttgagcaaaatgctctacaatgcgcagaagcagtgcgggcgcgcgatagttca

SEQ ID NO: 492142 - DNA, 359 bp, Homo sapiens
  misc_feature (247)..(247): n is a, c, g, or t
  misc_feature (251)..(251): n is a, c, g, or t
  misc_feature (258)..(258): n is a, c, g, or t
  misc_feature (262)..(262): n is a, c, g, or t
  misc_feature (350)..(350): n is a, c, g, or t
gtctgattccatctttataaccaaagccaattaagatcttaaaactaaacatataacttcatcttttgacaagtacttagagcctgagttgctccacaggaatccaggaactggcacaggaaaaggatctcagctggtggtgtgggaagatggaaaccaacttctccattcctctgaatgaaactgaggaggtgctccctgagcctgctggccacaccgttctgtggatcttctcattgctattttnttgnattcacntttntttttttgggtaatgggaaatgggcttgtgatatgggtggactgggttaacgcggtggacacgcacacagtacaaacaacacatactngttgacact

SEQ ID NO: 492143 - DNA, 111 bp, Homo sapiens
ggcctgttttatttcttttaaaaaaaggtgatttctcagaaattgatattaaaccctatcttatcttctcctgaactgttgattttaattaaaattaagggctaattccca

SEQ ID NO: 492144 - DNA, 776 bp, Homo sapiens
ggtggcatgccccctgtggtcccagctactcaggaggctgaggcagagaattgcttaaaaacccaggaggtggaggttgcagtgagctgagatcgtgccagtgcactccagcctgggtgacagagcaagatcttctgtctcggaaaaaaaaaaaaaagtttacaaagcagacttgagttgcagttggcacgaatctgggctttacgtgcagccttccaccttccgtggaatttcagggtggttctccttgccttcggcctcccaaattagctgagactccaggcattccaccaccacacctccctaattttttggtattttgggtacagacggggtttggccatgttgggctacgctggtctcggactccttgagctcaagtgacccgcctacctcggcctttcaaagtgctgggattacacggtgtgggccacttgcacgcagccatgtttccagtttccttgacgggagattcctaggagtagaatggctgggctgtgtggtaacttccaggcctccttaaagcttaagcctggacaggggtagagcatggtttccactgcattctctatagtcacagtgagtttgcaggttcacccacagcgttcagtggcgggcggaaacttggggactgacacaggggaccttgaagtgtccaagggggggctacattggaagccctcatgtgaagtcccccgcattggaccctgacacatcgaagagtcctcaaacaaatgtcaatccctgtagacacttcgtgtaagtactaagaatca

SEQ ID NO: 492145 - DNA, 339 bp, Homo sapiens
caagtacgcctggctaattttcttatttttgtaaagactgggtcttcccatgtgcttaggctggtctggaactcctggcctcaagctatcctctcaacatggcctcccaaagtgctggaattaccaccatggcctcccaaagtgctgggattaccaccatggcctcccaaagtgctgggattaccaccattttaccaattcatatcttgagtgcattccttccaacttttctttatatcatctatggtgtgtttacagacaatttgagaatatataacaattttatccgtactttcatccatatattattaagcttacacaattttctcaggtcattca

SEQ ID NO: 492146 - DNA, 155 bp, Homo sapiens
tttctttttggctttctggacagtgctgactccagctctttccttcttgggcctctagatcaaataataagaaggtaatcaaaatgtaataattattagtagtaaggctaggagggtgatattggatcaggagaacgtggttactagcacagaga

SEQ ID NO: 492147 - DNA, 377 bp, Homo sapiens
ttaaacaccaaaattgtgtttaacagaaccaaacagcgccacgcacttgtgaccctgacctgaagcttctggtcgagaaggcccttgaactcccaggccctccctgtaagcaggttgggcagtgcagagggcacagggcacaggcggagccacagggaaagatgagcagggtgctacccacaggaaggtgccctcccgatccccccacagcctctgccccctgtaaacacagtggcctgtcttctctgggcctcttcccttttctctgcatcctgccctctattttcttctcactaacacagaatggaacatttattttgtttgttacatgatcttggtaaatacttgtttgattgtaaataaaaggtgaatgagta

SEQ ID NO: 492148 - DNA, 127 bp, Homo sapiens
tgatagatcgagctcgtaccgaatccggcaggcacaaccctcacattagaacatccaatgatacttcttaattaggttttttttttgagacggagtttcgctcttgtcgcccaaggtgggatgcaat

SEQ ID NO: 492149 - DNA, 431 bp, Homo sapiens
  misc_feature (323)..(323): n is a, c, g, or t
  misc_feature (342)..(342): n is a, c, g, or t
gattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcagtgggcaggacaactgcggagatggggaggatgagagggactgccgtgagtgtcagaggtggtggtgggccggtggtgggagatgacacggaagcagggcaggcagaatctccccacagctttgagaggctctcaaataactntagtagatgggcaacacanattatattgggtgtaacttgctttgctcataaaaatcatcatgcatgatatagagacatagagatccagaaaacaaaaagcaccaaaac

SEQ ID NO: 492150 - DNA, 803 bp, Homo sapiens
  misc_feature (14)..(14): n is a, c, g, or t
  misc_feature (21)..(21): n is a, c, g, or t
  misc_feature (287)..(287): n is a, c, g, or t
cggcattcgtcccntcgactntacgccagtcagcccagtcagcccctcaaccagttccgtcgctgctgtgcactgctgcacgtgctggacgtgcgctaggcctcagtacccttgccaagtggcacgaagagcccctaactgcttccattagccgtggccattgggacacttcgagccttacccatgtgcaagtcccccatggaattaagcacaagttatcttctggcgcctggctggctcacgtttgaccaattctcactctagggctaggttcgcattcacggtcncgtctacttcggtgttcaaccttaacttgcaagcaacacgcaacccgtcgcacaccaacactatacgccaaggcacaccccgttgtaacttctcactggtggaccccggcaacacgccacaccaccccggtcaacgcggtaaaccccgaacattttcctcacagggttcacacgtggcacaactacacccacacgcacacctttttgacaccctttatcctggcggcctttgggcacacacgggcacctgtttacaccctgtaaacccttggcaaacgccgtgcaaaagagccgtcaggaccccgagcaggtctcataggtgtgtcacaactcatcactctgctgtatcacagggtcgaggcacataacgaaagcgccgagtgggttccatcaaacagagccgcggcagcatgacttacacgtacgagcggccaacgcctcaacacatatgcgcgacgctcccgcattttggggccacgcaagtccccctttgcggccgactcgtcccacacatac

SEQ ID NO: 492151 - DNA, 1083 bp, Homo sapiens
gggtcaatcaagatgatctgtgaatactgggggcattccataaccttccctccttaggtgggtctaaaacaaatggatttggctaactcagtgggctggagttggagaagcaacactcccttgaatctataggtggaatccagacctacaaactctggatatctggatgctggttcaagaactggccaatctggcgttccccaagaggcaggtctataccattgggtttctcacccgggtcaacaattccagggtctccccatataagagggaatctaagaactggccagtcttttcctctggggtgatccaagaatctcgtgggtgagaacgtggaggaactcgagggctacataagaggggtccctcagggagggagcacagaaagccagagaggaacttagaggcccagtagtgttccagtggggggttcaccgaggacagtggcagaaacctttaccaccatagtcatttacccagaaggccgtgtcggatattcaggaacacctggcccccatcccaggagagagccccattccctccatcttggctacctgggggaagggggcatacacggggaaggggacatcagttggcactcagggaggcagggtcagcgccaggcttggtgtgagaacctcgggggcatagcaagccccatctatcggtttcaccccaatcccttcctacagtcccatcggccccattcacatcggggcagcagctcgaggcagtccatcgccaatacaaatggcgtcaaagagcgggaaactagaacttgaaggccggggaaagccggactgcccgacaacccaggcgctagcgagagggcaacggggcccggagctctttccccaataggggggcgccccaagcgggcagagaattgcgggaacacgtaagcggggagacaaaagctgcagaaaggagggtaccccgcgaaaaagggtccggggtcagagagccagccccagaagagagagaccctcagggagaaaacaccacaagaagacacacagaggggtagcccactatacaggaacgacaccacgaggtacggtgcttgataatgttctatatttg

SEQ ID NO: 492152 - DNA, 269 bp, Homo sapiens
gatgaacacatttaataacaattcagaactgaactgaaacgtggcacaaacatgacaactatccaggcatgccttcaagcatctccctcaggagggattcgctacaccctagacttcattgtggggaggattacaagttctttggaagaattcctagttcacactttcttgaaattttacagaagaattttagggccgaaacatactgggttcattactcttcacttccagggacaaatctgatgctttcctcaaaccacattaagctt

SEQ ID NO: 492153 - DNA, 478 bp, Homo sapiens
gagttctggccaagtctggagctttcttcacactcggctctcagagctctgggttcagaaaaaactgagcatggtgagagaagacagtgtcagaccgaggccccctggaggacctttggaacctctgatagtctgtcataccagagcatgattttctctaatgttcagacctggcttcactgaggaatagttcaggggatcagggcctagagacaagactcccaactgccttatttccctcctgttttcctggcaaccccactacttcctccaaaggtttctgtatgcgaagttgctagcctgctggctgagctccggagcattaatgaggctacggtacaatccagacatcaggcctgctccatgatccctgtcaggaattcagtgaggatgctactcctcccagtcactgacaccctgatacactgagtggaaatctgccaaagatggcggtcaagggagcccagtggttcatgag

SEQ ID NO: 492154 - DNA, 573 bp, Homo sapiens
ggagacgggtgtctcacgcaaaggggaggaaggaggcgacagtctcttccctgaatactgagggaaaggctgtagatggtcacgaaatctctcctgagctcgcgctgtcctctcgggtggccacagcctgatacaggctggaaaggtccaggagtggggtccgagcccaggaccgggtgagggccgcagagccaacctagccctctggtccctggagggggggggacgagggcagcaacaattacatcctcggttgacgggcaaggcagaaggcacgcagcccaggcgggtcctgaatctgcagtgagacagggcagccggtggcagcgggatacatgtggaaggtgaagaggccagggggggagggtttccaactcggtctcagacaaccagttgggatgcatccccaagcaccccgtgggaggccatgaacggcagcaatcgggtgtgctgcatgccaggatatctcttccctctcattctagtttcacgtagggaattgttttgaaaacaaggggctcagtttacataaggagcagtgttccaacaaaactaaggcagggccccattatt

SEQ ID NO: 492155 - DNA, 747 bp, Homo sapiens
acccacgcgtcgtatggttctatgtatagttgaaaactctatgatcagcatacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaagtgaactttacatctggggttttctaaacaagaccagaacttagccgaagtcctaattctcttactcaatgcacaatcacacgcctctctctcgaatacttgcctctacttggcaccgcattttacgctgaccaaaaactaatcggcataaacaccttgccttaagcataacattaactatatttagaatggcattcttcagtgctagtatttgaccacttggacattcagtacattgtgcattcttaagtagtctttatccctagaatcaattctctcagcatcaccaaaactgaatcggtcgaaatagtgctacgattctcgggcacaggacgattacctgactatgctccttgcttcccgggtggcccggccttggcttgcattaggcccg

SEQ ID NO: 492156 - DNA, 713 bp, Homo sapiens
tgaaattaaagtttaagagacctaaaaaaatgtactcccaataaagaatcaatactgcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaacaatataaacacaaaaaacattaaaaatgcgccccaatttcaagcaaattggcccaataaaccctatgggaacccaaataaaaatcaattgcccaaattttaacaacatcaaaattggaaaaacctgggagtacccaaattaaaccgccttgaaaaaaatccccatttgtcaaacttgcctaaaaaacaaaaagcccctaacagttggcaaatccaaaaaatagcccagctaaaagggcaaatgtaattgtaaaggtgaaaaatttggcaaaaatccccataaaatcttggtaaaacaatgtaattttttaaccaaaagtccaaaaatgaaaaaatcgctaacaataaaaaaaattgaccacaataggtttagacggttatcccactttaaaaccaaaatccccctttataggcaccttccctcaaaacgtaaaacttctccaaacaccggtttcttaagaggattggaccacttacttaacacaataaccctaataaattttttctggtcccgaagtaccccgcaaaaacaa

SEQ ID NO: 492157 - DNA, 975 bp, Homo sapiens
gtggccagtccctgactgcaccgcgtgatgcccagtgcaagacagggctgatctggaagtacaactacttccattaagatcatccaactattggatgattatcctgaaatgtttcatttgtggtgagcagacaatgtgggctccaagcagatgcatgcagatcctgcatgtcccttcgctggtgaatgtgctgtgtgatgctagatgtggcaagaacaccatgatgctgcaatgtgccatcctgatgggcacctggtaaaacaacccagctctggagaaacttggttggcctccatatatcgggggagatagtgtggggaatgtgtgcaccaccggctggtgcgcatacatcttgcatgactcaatcgagggcgacgatgtctaggatgagaaccaatatgtgcgttgccatagcttggcttgccgccggatgttggcgttgcgcactctgtctgctcattggtgaaatgtgcagacttggtgcaccatgaaccagtagccacttgtgttctccggaggacccagaactaaggaaacttaccttaaaaccaagggtttaaagagatatacaccaacttaaaaaatctcccaggtgtgcacccctatgcagaagtccctgaagttgattgtgccaagctgattcaagaactgcgcgcacaactatgtgtgagcccaagccggaaagccaaccgcgttgctggaaacatttgctcaacaattctccccccgttatctccttattggggcctggtccatccaagcaggatgtttcgagaaagtggaggaatctacaacaccatgacagttgtattgtattaccacgaaggaacctctggttactcgacataccatggagagtgtccgaattgatgcacagttcatgactgcaaattggtaaccagtgtgggactcatacccatactatacacacgtgcaacagattcgacagtatggaagagacactaccatgtaaag

SEQ ID NO: 492158 - DNA, 257 bp, Homo sapiens
gtgtggctacgctggacgacacgcagttcgtgaggttcgacagcgacgccagtagtcgagagaggagcgcgggcgcatggatagagcaggaggggcggagtattgggaccgggcagacacacgatctccaagaccaacacacagactataccgagagaacctgcgcaccgcgctccgttactacaaccagagcgaggccggtctcacatcatccagaggatgtaccgttttcgacgtggggccggaggggcgcctcc

SEQ ID NO: 492159 - DNA, 804 bp, Homo sapiens
ttagaaagagggattaaaaggagttttctttgccccgcgaaattgtaggggcaataattgggccctgatagcgataattgtcacacttcctttttgtccccaattgtgcacacccgccttttttggaaagaacaatctaaatggggggaaagagagcctgtggagacctcggcggccgccccaacaggtgggagatgcggcttcacaacttccccagaaagaaagttttatttttggcacagaagaacctctgggagagattctcacccaggcgaggctttggagcctctccacacacgtggtgggcttttcttaaatattggggggaataaaccactctccctctccatatgagatgtaccccagtttcacgagtattttaaaagataggccctcttggccacgaggtgaatataggagagtggattaacccccaatatcccgtgggcctcttccaccccagccccgggagatgaggagagtaacaagaaccatattggtgcaagataaagagaactcgtggcctctcacctataaggccaagagaccacgcacagctgtccaaaactgcacccgaggaccgcggggagagcaaaccgtctcccccaacacggagaaatttgggtggcacaaatggggcccccgagaaccgccgggtttgagagagagtgtgtgaaagaatggcccacagttttttatatcccccaccccttaaaaggcccaggccttgaagccccagattttgggaaaattttgtttttaaaaacaagaggaaattcccaactgcaggttttttaaaaacca

SEQ ID NO: 492160 - DNA, 231 bp, Homo sapiens
acaacagttcatcaaacaactgcagtaactatgcacacaaattacttcacacagtcaccataaagagaaaatgcacagatgtatggaggcaaacactgtatctaacactgaacctactacaggactccatcaatgagtccaacttttagtgataaaaaactactgtactgggcaacacttggccgacataaacccacatctactcaaacaagtcagaaaggtgcatacgta

SEQ ID NO: 492161 - DNA, 357 bp, Homo sapiens
ggggggttttttttttgtgggccaaaactccccccccttttccaaaattgggggggggggggcccccgggggggtttttttaagggggggtttttttttgggcggtttttttcccggggggcccctttcccccttttttttttcccttgaaagccccccgggcggtttttcccccccgtttttaccccgggggggggggggggtttcttttttttcccggggccgggggggggcttttgttttttcccagaaaatttttttttccctttttttttggggggcccccttttgggggcccctttttttgggggcccccccggggggggcggaattttcggggttacccccggggtcgga

SEQ ID NO: 492162 - DNA, 881 bp, Homo sapiens
cttccgcgggggcgcggatctttttaggggacatggttcttccgcccttctggcctctccggttgttcctctcttaatgttggccagcgggaccattgtaaccttgctccttgtgggccattgggggcgcctttcgcctttggtgcggcgaagggcttttcccgagtttagattgaattgttgcgcgcaccttgtgcggggaaccccccttcccccccagagggtgactcccactctgtcgccccgcccccggtgggtttatccggaattctttccccagagatcctttgggtatagcccccggagtagtcccccaagagcccccttctggggcgccccccctgccagaaggcctcccttggccagagtccccttataggaagggacccccctgtgagaaccttgtagagatctcatgtttgtagaacgctgctacacccatagtgtcccaaggacccaatgtcggccccgggaccaccccctattttttctgcccggccccgggatctcaccagactcccggtgggataaagcgcagctggctgcaagcacggcggcagcgatcaagccccattcaggatgagcaggcgcgcggtttcacggccagaagcccgtggtaaggtaatagaaaaaggagaagaaggctgctgttggggttaaagaaagcaacgcgagaagcctctgggggggaaaaaggcaccacgctatcccacggaaaccacccccccggaaagaagacctccccgagaagaaaccttctacacgaggggaagaaacctctgcattaaatttttaaattggttattccctataagggccaatccttttgggcaggtttttttggaataagacccggttatacaggccgtgaggaacctgga

SEQ ID NO: 492163 - DNA, 895 bp, Homo sapiens
ctcccgttatagtatctattgcaactcttgttaaaacgattttcgaccccctgaaacacatacttttttaagcagaggtatttttcaacaccccttggggctaaatcaacgtagtctcaccaaagtccattgtgagattaaccgcaattaccccctttatagaacgcccccgctgtttgttaatattcaacaccccaactcctaattgttctccccggaaaacccaactttggggagttccaaaccacaaagtttcccaacttttgcccccctataatttccgcgttccacggaacaccctatgtttttcgagacctttcttgccccagaattcttcttggtcttttgggaactccttttgcccaaccccctaaattgttcccactcccttccccaaatcgccccccctttgtgggtcaacaattaaatctaaaaaaaggttctatcaaaatcttaaaattttagaaagctcatttttttcccacaagaatataactggttttaaaaggtagtgaaacccagattaatataatacagtgacctaaatagatatggctatctctaaaagaagaaactctcctctctattgtgttaattaccccccgtccaacaatactactgagataaatactcaaaatggtcacaaaaatttgaaactttcacacagacctgtaccacacaaaggagatataaaaaagatttttgaaaattttggtggccccccacctcctttaaattaaacaaattccaggggcccccccatacgcctccccctacgaagaagtatttttcctcccctcccaaaagatgcttttatcacagcgtgtaattaacaacagcctttattttgggcttacacccgaaacaaaaaaatttcttgaaagaaaaaaaaaca

SEQ ID NO: 492164 - DNA, 463 bp, Homo sapiens
  misc_feature (61)..(61): n is a, c, g, or t
  misc_feature (281)..(281): n is a, c, g, or t
  misc_feature (402)..(402): n is a, c, g, or t
  misc_feature (454)..(454): n is a, c, g, or t
tggtctgagcccaataaagactgttaattcctcaaaaaaaaaaaaaaaaaaaaaaaaaaangatcagtggttgagatattctgcagaccctgcacttgatggatcagctggcaccacccagatcaataaactggctcatctgatcttgtggcccccacccagaactgactctgaaagaagacggctccgacttcctacgatttcatctttaaccaatcagcactcctggctcactggcttcccctcatctgccaaattatccttaaaaattctgctccccnaaatgctcagggaggctgatttggagtaagaataaaactccagtctccctggcacagctgggctctgtggttgatttaactctttctcctattgcaattttccctggtcttgaatgaattnggtctgtctatgtaagcggggcaagggtggaacccccttgaagtgggttacnggtaaccgg

SEQ ID NO: 492165 - DNA, 450 bp, Homo sapiens
  misc_feature (8)..(8): n is a, c, g, or t
  misc_feature (22)..(22): n is a, c, g, or t
  misc_feature (55)..(55): n is a, c, g, or t
  misc_feature (62)..(62): n is a, c, g, or t
cccccctnaaagtgaatttttnccgggtgccttaatttccaaaacattttaaagnccccagnaaaaccccctacattgcctttaatccactgccattaatacccatgatgtgttccagggttttttgtttttgccttttgtttaaagatgccccagaatggggcggggcatggtggctcatgccctgtgatccccagcactttgggaggccgaggcaggtggatcacttgaggtgaggggtttgagaccagccctggccaacatggcaaaaccccgtttctgccaaaaaatataaaaattgtctgggtgtggtgacatgcacctgtagtcccagctactagggaggctgaggcaggagaattacttgaacctaggaggtggaggttgcagtgagcaaagactgcaccactgtactacagcctcagcaacagagtgagaccctgtctctta

SEQ ID NO: 492166 - DNA, 306 bp, Homo sapiens
gcatggatgacagagggaaaccctgtctcaaaaaaaaaaaaaaaaattggaggtggaaaaataccggtcccccagacttatttccggattagaaaataggctgaaaataggaggaaaccttagtttcatgaggggggggggatcatcagcccccaggaagtgggggtaggcaaacaagccacatttccttggaagaacctccttggacacgtggggggctaagttcccattcacaaccaacttcaaaaaaaggggctcaccttttcaaaaaaacacagggctcagggaccccagcttaggggcaag

SEQ ID NO: 492167 - DNA, 160 bp, Homo sapiens
cccccccccccggtttccccggtttgggcccttcccggggggaaataaatggggtttggccccgggggggtttttttttttaaaaaaaaatttttcccctttttacccccattttccccctttttgggccccgggaaaaccttttttattttttttttta

SEQ ID NO: 492168 - DNA, 292 bp, Homo sapiens
  misc_feature (40)..(40): n is a, c, g, or t
cggtaccacatgattgtcaccgctcacaaagaaaggcgcncgtggtctctgaactgggaggactccatccctcagtcctcagactctccctcccagaccatgctgggtggggaaagggctgggctgctgcaggatagggtcggctcctcagcatgccgctgagctgcagctaccctagttcaggctcctcccttagggggtctcagagggcgggtggtgttgggttttttgtttgtttgtttgttcattttgagacagggtctcactccggttgcccaggctggagcggtgg

SEQ ID NO: 492169 - DNA, 103 bp, Homo sapiens
ggactaacggataaatagtttgtactgtacgtctggctatgaacggggagggaggatcccttggtatcacctgtattttttccatcatgatgaggataccagg

SEQ ID NO: 492170 - DNA, 680 bp, Homo sapiens
agtcaaatcaatgccacacatgccccccaatgccgaagaaagagtcgggctccagcatgtgcttcggaacgagtgaagacacgaaaccgaaggcctaccaatgcgcaaacgaaaatgggtcctctgcagtgggctctgacagttactgattgccctgcattccccatcccacccccgtgctgcactagccctactacctatacttggtgatatcaaaggttaatagaggctgaggagatattgcagggtgaaacaccctatgctgcataccccaagctcccccggtggcaacgagcgagctttctacctactggctagagtttgagaagctgccatgcagcccctagccccttccctcctcctggggcctccagcccctcacactgctgttcccagtgactatttgggatctgactgaatgccagaggctctgtaaaatcagaccatagtgcaagtcctcagccccctagccccttaccgcaatctcctcccccattctcgcaaatatccatttcaacatgagaagtggacaattcaccacgtgggcccgctggcccggagtgagctcaggatgagagcaaagactcagctgtagagggtttcccttccttctccccttcggccttggtctgtctgagcgggcgtcacgagcactatccaatccgtttgacttgctcttg

SEQ ID NO: 492171 - DNA, 412 bp, Homo sapiens
tgctgtgatctagaggatccaattctgcaccacagcgcaggcgggacagtgggatccagggggaggcagtgcccccacctgtcactctggctgctgcaaaaaaagcaagtctgagactgtgctgacctgtgccacagggtgtgccactgtgtgtggctagagtgccccatccctgatgcccccgttgtcaccaacgtgaccgtgaaggcacgagtgtggaacagcaccttcatcgaggattacagagatttggaccgagtcggggtaaatggctgggttaaccctaattcctccgaaccagaatccccagcatcaacatggagaacaagaaccacgtggttctctgtggacattgactcgggagctggtggaggagctgccggccgaaatcgagctgtggatggtgctggtg

SEQ ID NO: 492172 - DNA, 278 bp, Homo sapiens
cccccctggggcattggcatcttcgggggcagacccagtggatttggcatcttttggtgaattcttgtcctgcattattgttggctgtgatgactcgtcgatggaggcttctcaactcatcatttcttcagcatttgccactcggccttctctttatttcatgtcagtgtggcttctaggggttagagttcatgactgttaccatttattttgatgttcacttggcccagatatggccagaaagactccctccaggctggcttctgggtcctcttgcc

SEQ ID NO: 492173 - DNA, 301 bp, Homo sapiens
ggtaatcttctcatctgtgaggatatggaaccccaacctcttcctggacacgtgatgatctgcttgtgatgggctcagagtcttgaaacacagaactatgagctcatctcatatcccaatccagcagcatggaaacctcagactgcaaggcccaagactggcacttgttctctacccaactcttttcttactctcacaccttacttttaacccgaaaatgatgcttgctaccagcccagatttaaacaattgccttttaggcacaaacatcctgaacatgtaaaatcaactaattaaaagc

SEQ ID NO: 492174 - DNA, 229 bp, Homo sapiens
tcccccccccccgaaaatggggttaagggggcctttttccttttttattccatagccaaccttgggtaaggaaatttttaaaaattgattagggggatcggttaaaaagggaatttttccaaacccggggggggcttttggaaataaaaatattttttttggggaaggattccttgggaaacaaaccaaaaaaacaattttttaaacctttggctttttccccccttta

SEQ ID NO: 492175 - DNA, 417 bp, Homo sapiens
gtcacttctggctgtgctcagtgctgagtatgatcgtttttctgaattcactggtaattggagctttaaagccacctttcctgagcaaggagttctattgtctggatctgatcccagctcttgtaccttagcaaacttcaggtaaatatctggctgtgcgtgtgacacctttctcattaagtgaattcgattcgaatcctcagtggtacccctaccgcgaaccgcgaatatgcaacgagagatgcagagttccaaatgcggctgtgctcacctcgcagtccaggttatcactggcatcctcaaagttagtaaggcagggaatacagatccaaaacagtttacgccgctcctctcgggtcaggcggggaaatcggctgtccttaagtgcactggttaacgtttattccctgcatactg

SEQ ID NO: 492176 - DNA, 602 bp, Homo sapiens
  misc_feature (123)..(123): n is a, c, g, or t
tcgagatctcacatgtacactctcctcgcttttctttctttttttttcccttttctttcttctaatttttaaaaagcagcctctggagccagccatgtttggcactgaatcttcatgtaagtnaatggatcccacttctctgctatttagaaatctgcttgctgtcatggtttcattggcttagagttcatatcactttgccttaggtcattaacaacctttgtattttggctctgattacaaaggaattggtctcagggaaggaactccccttaactgggttattcatccttaaggctagggatgtcaatgtgtcataaccaggcctgtaagagggaggtaggaaaatcagaatccatacagccaccctagaatgtgttaattgatgggatcaggcctgtcactgatctattgttgtaggctccgtaatggtgcttagaccttaaaatagatactgggaggatctgagatgatagtgtttattagaaaggaaagaaaggcttacattttttcatctaaagagataaatagttatcattatatactcttccatattttcacaaaaacatagacattataggtagatctcgagaattcctgca

SEQ ID NO: 492177 - DNA, 233 bp, Homo sapiens
aaattagttaggattggtggcatgcacctgtagtctcagctacttgggaggctgaggcgggaggatcacttatgcgcccaggacggcagagttgcagtgagatgaaatcgtgctattgcactccagcctgggtgacagtgagaccctgtctcgaacaaaacaaaaactaatcttgacatctcatatttttagtacgtcataagcagacgtagagataaaaaccagcctaggag

SEQ ID NO: 492178 - DNA, 661 bp, Homo sapiens
  misc_feature (321)..(321): n is a, c, g, or t
  misc_feature (338)..(338): n is a, c, g, or t
attttgctctgctttatatatctctctctctttctatcttccacttaataataaattgaggacttcatgtccctttgtctaaatattttccaagatcaagggctttgttttatataatcacagtgcaattatcaaactcaggaaatttagcattagtacagtactatgatctaatctgtaatccatgttcaaattttgtcaattgtcccaataatgccatttatatgtatttcttaaaaatccatgttcaggataattcaatgcatttgattgtaatggctctttagtcttctttaatctgaaacagttctttaggctttntcttgaccttgacattntaaaaattaactctattgagatatacttttcatgcaataaaatgcactcactttaagtcatgaggaatatgggtttttacatatatacacacacacacacacaccttatatatatatcttcccccggttgaaacagatattgagatttttaatatctcttaaagattcctttgtgcctttgccacacttttgcccagcaaacccggttgcgtctatatgcgaaatagttacctcaccttaaaataaagcgaaaggctccttttggatggctaattttaaccacagtttttgattatagggttgggatctcccgcttttcctac

SEQ ID NO: 492179 - DNA, 978 bp, Homo sapiens
gagtgtgaaatcttcagcagaagaatgtctcttataagttctttgcgagaaggtagagataaatgacagcttatttcaaaaatggtccgatggttatcagaattcctcgaagcaggcctggttcattggaaaatcgaagacgcaggaatatgttacatagaagctgtgaagtcatccaagaggtggtcccgggatcaggcggtgagccccttatcctacccttcatatccatcctcggatgtcgctgccttgctatgaaaggccatgaaatggttaaaggtgtggatgaagcaagcgatcaggttgacattctaatctagtcgataacacttgcataggtccacacatgatcaaagaactagaatatctctcgaggaagaatccgaggaaatgctccctggagtgaaaacactgaagatagtcccttagccgggtcacctggaggacggtgtatcgggtctgttaggaaaactccacgcgcaatggtggatggctgatgaacttcgtgcggtcgtgaggggccctggatcggatgtaagcgattttctctatatttggacgatatgccatcatgaactagtcaaagataatcgtagaacatggacatggatctaactgagaggaacctgctgagagattctggctccaagagtttgattcgtcatgcacgcatctgggagcatttccccgggatcgctctgcttgagcgtcttgctaaagtggtgagccgactctagacagactattggtgtgcattgaacactttggcttgcttggcacatgccccgggccttgtctgcacgcaggacacacggagcatcgggcgaagacgacgtaaaaccgtggttcaataccatccctaacaccagaaaggttcttccaaacttcgcgggcggggttccagaaaatacacccagtacggaagctggcctttgaccacagttccgcgcctcggttttggcggtgccttgcgatttc

SEQ ID NO: 492180 - DNA, 408 bp, Homo sapiens
  misc_feature (3)..(3): n is a, c, g, or t
  misc_feature (82)..(82): n is a, c, g, or t
  misc_feature (130)..(130): n is a, c, g, or t
  misc_feature (138)..(138): n is a, c, g, or t
  misc_feature (176)..(176): n is a, c, g, or t
  misc_feature (202)..(202): n is a, c, g, or t
  misc_feature (216)..(216): n is a, c, g, or t
  misc_feature (241)..(241): n is a, c, g, or t
ganacagaaggagagtggaaggtaggaggcagtgatggagaaggagccattgggcttagccgtgatcccaagagccggaacnatgatcaatgaccggattggttataaaccccaacccaagccccataancgttctcncaattggaagtcttgaaagagatggattatcttgcatnccagagccgctgggaatgggataaantgatgggcagagtncaaaccagatagagaattgagtgcntgcagtcaagccagaatgtacctcctgcagagacaaatcttctgcatgagattactgatgcttcacttgcactctaagctggaatccaaactctggtttgtctcttgaaaatttgactctataaaactgatctgattttctgtttttaaaaataaatatatttttac

SEQ ID NO: 492181 - DNA, 256 bp, Homo sapiens
caccttgcacttgtcgctgggtcagtgctggaaagcgcctctcactccggcgctgacaagggcccttctctactgtcggggggtggttccgggctgggggggctgccatcctttgcagctgatggtgaaggtgtctctttcatccatggttaagtcataaaaagcttatcggtttgggttttgactcacctgaaagttgttgcggtttaaaagaagaataggcggggcacggtggctcatgcctgtaatcccagca

SEQ ID NO: 492182 - DNA, 714 bp, Homo sapiens
tctcagggccaacatttatttcttttaagaaggaaattatcacccccttgggggaaaaaatcgtggatacccgggttccagaatttcctatatgtgtgtgttccacaggtgggcataaaacagttcccccatacgtgggggcaatgtgcccttccgtggcaggccaaagggcgtgctgtggggccccaaagggggggtccaggttgtgaaaccctgtgagaaatggcgcaacacagaaaagagggctgtgacccagagtggggggacatattcttcacaactctccgtgagatgtgcccacaaaactcttccagagttcctaacagaatttataaacaacggtggttctctcttgtgacggctccacaaggtgggggagaacagagggccgtggcaaagaggcgaagtgctcagctcccacctttatagtgcgggccagaacaccgttggcaagggctaaccggcttaacacaatataacctcggtgcgcctggccccaacccgaggttgccgcggggcggccatcaacaaccacacaacactctatcacaaagaagtgccgggagaaaatactctcaaagagacccgtgatggggcgcccaaagaacacgtgggcgacaacgcgacaaagcgcgggggaggagacaacaaccggggaatcaccgagctagccgtgcgcgtgcgcacaaacccgggacataacccttgaagggg

SEQ ID NO: 492183 - DNA, 807 bp, Homo sapiens
ataaatattggaaattagaaattacaccaggtgccacatagaatataaatagatcatacaattcagaactttatctaaagactgttctcacaaattaagatattctaaagtatgattatggaatctcaaaatcaaatcttatcctgtctttgagaatgcattatttcatttgatttgttcagttaatttcttgctttagtccatttcagcacattcttgtgggcttcaagttgcaagtttgttaataataatagctattccttaaaagtttcaagagctgaatactgggatgctccatttgtgaaatactatgattaaacatttccaagtaattttgcaaaaaaaaaagcacccaaagtttagaggacttatgtataaaaagttattttcaatagtaagtatgagaaatgccaagaaaatatgccgatggctatgttaaagtatttcattttttaattcaatatcagtttgtctccaaaatctgtaataaagtgattctaattataaaaatatttataaatctggtcacctttatcttctattcgatccgtagaatatcgcattaattgggaccccaatgtgcattattttggcgccacaacaaattcagagtccattctactccatacattctatgggatagactacggtcaggtattaggtccgacaattggtgttccctgaaaatagtacctattcaggtaccttcacaacggtcccttcccattgcggttaatcggaaagaccgatcttggcgggcaacacctgaataactggataagaaccccaaaaaatcggcacaaaggg

SEQ ID NO: 492184 - DNA, 467 bp, Homo sapiens
ggggggttttccaaaaccttgcccggggaaaaaccggatttggggttttcccaaaaaaaccccaagggggggggaagggcccgggggttccccccggggttggaaaagggggggttcccccgctggtttttgggaaaaaaaccccccccgggggtcccccccccctggtggtttccctggggtccccttggggaaggccggctcttgggggggtttccctttccccgggaaccttaaagcgggtttggttggaaaaaaaattagggaaaaaagggggtttcttaaaccggtttggggtccggtcaaaatattaaggtcctgggggggcccaaattttgttttttaaaaaaggggccttttttcggttttaaaaaaaaaaaagaagggggttccccccttggttttttttccccccccccccaaaattggttttaaggaaaaagaaaaaaaaaggaggttttccccca

SEQ ID NO: 492185 - DNA, 100 bp, Homo sapiens
atccctaaccaggattgacactggacgtacggcaaggagacgaagtttccgtgcattatgaccccatgactgcgacgctggtcgtgtgggcagcagatcg

SEQ ID NO: 492186 - DNA, 479 bp, Homo sapiens
gctctgggttagtcgggtcctaagctgaggccgataggcgtaggcgatggataacaggttgatattcctgtaccaccataattcgttttaagcgatggggggacgcagtaggataggcgaagcgtacgattggattgtacgtccaagcagtaagactgagtgttaggtaaatccggcactcttaaggtcaagctgtgatggggagaggaaattgtttcctcgagtcgttgatttcacactgccgagaaaagcctctagctagatttatggtgcccgtaccgcaaaccgacacaggtagtcaagatgagaattctaaggtgagcgagcgaattctcgttaaggaactcggcaaaatgaccccgtaacttcgggagaaggggtgctctttagggttaacgcccaggagagccgcagtgaataggcccaagcgactgtttatcaaaaacacaggtctctgctaaaccgtaggtgatgtatag

SEQ ID NO: 492187 - DNA, 455 bp, Homo sapiens
ccagagtgaccctaatcagatcatggggccctcttttccaaaatcttttcagtgttttcccaaatcactcaggagcttacaagaccctaccaagactggctcccctgttctccgctagtctcatcttctctgattctctctcttctatctcgggtactaacacactggcagcctttctgagctggatgctcccttacatcccttggatactccaagcacgccctgccttgggccttctgcacttgctattggctgcctgcaatgtcgttggccagtcagccacatgacccagtccctcacttcctttgggtctttgctcaagctcacattctcagtgaggccttttctgacctccagtgtttaaaatctcaccccttatcacagacaaccccaacccctttgaccttcatctgatggacatttttatacagaaaacaataaagatttccctctca

SEQ ID NO: 492188 - DNA, 330 bp, Homo sapiens
aatcagctcggtacccacgatatggggcctcaaataaaagctgtctcaggagatgctgatagtcttgcactgagagctaaacccatctagtgatttacctcggcattaagaggtttgcgtatccctgaatgcctgaaccaaatgtacagatgcctacttttgagataaacgaatatttggacttatcgagtgtgaacctcctagagtcgatctgaatgcctaaggtgttgtaacggtcctgcgttcttcaagtcttttcaacgatcctagagtatggtctcattctacaaagtgacctcatggtctgtgacagctgcgtttcacttccga

SEQ ID NO: 492189 - DNA, 312 bp, Homo sapiens
tgtgtcatgcactagctgcctagtaagctagaaattagtaggatattgagccgggcacagtggcttacgcctgtaatcccagcgctttgggaggccgaggtgggcggatcatgaggtcaggagatcgagacgatcctggctaatacggtgaaaccctgtctctactaaaactacaaaaaattaaccaggcggaatggcacgtgcctgtagtcccagctactcgggaggctgaggcaggagaatggcgtgaacccgggaggcggagcttgtggtgagccgagatcacgccactgcactccagcctgggcgata

SEQ ID NO: 492190 - DNA, 1847 bp, Homo sapiens
gcgtacggcaacctttccaaggagagtggtatgtagtgatcgccatcttagggaaaagatgtactacgtccgtaggagcaccatggcgcgggcagaacccctatcaacacgccacatctagcagctaggtgcacagatggatctcggggaccatccgacagcagacatcccacagggacccacagggaccagcccacggccgaccctacgacacacctaggacagcacgaccgaccgatggtacagcagtacaagtatgtagcaattataggaataccggacagacagtattttatagacatctagtagatagggctatatagcgatagggagtacttaaagtatagtaggatcatgaccaacaccacgtagcacaatgtggatttccacccatgcgactataaagatgacaagtgcccagaaatagccaaagcgtaggaaccaccacaagaaccagttaaaaaaagagggccatacataataaaacgagagaatttctatccacgatataccacacttaataaacacagaagaggcaattgggataggtttaccggtaaggagaatatatacgggcgttaaataagagacttgagggcaatactccagaagcatatatatcgcagtatagtggacttaccgtacacaaaataggcaagagggaggaaaatacatatggacatacagaatataaagagcgataataatgaaaaatatagagaacagggatacatagtgtacaaaataggaattcctataggcaattaactataactagcaagaccttacaatgagacataatggagaaatggaacagggacacgacacacataacacgattaaaagttacacttcaactatggaaggcaagggccaacacgaatgttcgaaccaagtaactataaaattgaatgcagcggagcagatggaggacgccgatatctacgattgagtacgaccacagcaagtcaggacacatgagcacagaagatgtcagacatatatatgagccagatagcagagaagcataatgaggacacacatctggtgcagatcacaataataatttgggcaaaccaggacctgggacatatccacacagaggattctaagacacaaaattataccaacgacagcacacaagaacccaaaacgagattagaataggcaccaaagaacaccatagtcggacagcacgcgcacgaatgcaagaagatacaccacaagagaaagatgtatacgttaaacgaaggcaacagagaatcaggagtccatacacacacgaccgaaccgatattaactcaagcgaagaacgaaggctggaaaggcagaacacacgaaaatagctaggacctattaagaccacggacatcgctcagcatataacgcacagctgcagtcaaggaagtgaatacagacgaagaagattagcacaacgagcataacatgacaagacagaaaaaaaatgtatccaccaacgataacgtggggagaaccgaaaaacgcgaaccacggcacaatgaaatctatcacacgagaaccacatacaaacaacatagctatgtcgatcaacacaatatatatctcaacatgagatacctaatcaaactcaacaacttaacatagacaatagataatacaccacataatacactacaatataatctcatcgtaacaaacacacaaacaaacaacataacttggtcaagcagacaccaatatcagaactccactacaagcattaaccatatactcaacatgactcaactacaatcaactgcaactccacacacacatacaagacaccaaaccacataacatatctgagacgattactccctaagtac

SEQ ID NO: 492191 - DNA, 1135 bp, Homo sapiens
  misc_feature (723)..(723): n is a, c, g, or t
  misc_feature (750)..(750): n is a, c, g, or t
  misc_feature (753)..(753): n is a, c, g, or t
  misc_feature (776)..(776): n is a, c, g, or t
  misc_feature (784)..(784): n is a, c, g, or t
  misc_feature (807)..(807): n is a, c, g, or t
  misc_feature (811)..(811): n is a, c, g, or t
  misc_feature (818)..(818): n is a, c, g, or t
  misc_feature (823)..(823): n is a, c, g, or t
  misc_feature (827)..(827): n is a, c, g, or t
  misc_feature (830)..(830): n is a, c, g, or t
  misc_feature (915)..(915): n is a, c, g, or t
  misc_feature (929)..(929): n is a, c, g, or t
  misc_feature (944)..(944): n is a, c, g, or t
  misc_feature (1089)..(1089): n is a, c, g, or t
tggatctggagaacctggtcacagaattcaaaccgcagcattgccacgctggcatcaccaccctcccggacgcgtgggctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagtttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgacaggacatgnacacacacctggaagatttccctgggngcncacggactccttgaacaccctcntggcactncaccatctctaccaatacacgcngaanttctatnacganatcntcnatgccttggaggaggatcctgccgcccagaagatgcagctggccttccgcctgcagcagaatgccgctgcactggagaacaaggncactgacctctganctacaatctccagtnctgccttgggacataggtacctgaggtactgagagccctcaggggaggaggccgagtggctgtggctgaggccccacctccctggaacgcgcccaagccggagtgggtgcagcggaacccgcccagcgtctagactgtagatctnctctgagcataccgcgggcacgcacagcacagcccagcccagcgcc

SEQ ID NO: 492192 - DNA, 711 bp, Homo sapiens
gtcggttctcctgtcgttcgggccatgtattccagttcatccggttgttcatgggcgtacaattcatggagaccactgagttagttgcaggccatttgtgaagtcggcagttgacaatatattcgatgcgcgcacgtaatcgagggacgtcgtgtatgtcgaaggggttgctccacttgttgagtcgtcacccacggtgtggaagttgtcaacaagtgagggctgtgacaaccgattgtgcagatgcgtgcagaaaagggtgcagtgtgacaatacaatgtgcgacatcctagaaaatatatatttgaaatcagcgcagtatcacgtcatcaggtacaatgtgtcaatacatgcatgtcaggcccaccatcattctgtgtaatcaggtgtataagttagatatatgtatgaaaatgtgagcattagaatatgtagaagtgcaagaggcatctaatgaatatatgggagagtaaggagatagacacgcatagatggtgaccacacatatgtacccacacaggtgtgtgtagaagtagtacagattttcatagagaggcaatgaggagtagacaatgatgatagtatatattatagtggagtagttgtagaagagtagtgtcgatggtcacgcggaggtgttatagttgtagtaggatgtgacaaagaataggaaaaatacagtaaaagcagtatacgatcataacgcagaaa

SEQ ID NO: 492193 - DNA, 765 bp, Homo sapiens
taaaaaaaaggtctcactaatttgcccaggttggtctcaaactcctgagctacaagagttttcccacctgtggcccccaaaggtgtggaatttttagcgatgaacccatggtacgggtctctttgtggtccaagtccctaatcaacctctaaaactatcctcgcaccaagaacgaggcacacaggtgttcttgtctattggaaatcttttattacaagatatttatacaagcagaagtcttctgtacacaaaattaatacactattcgggtgtttgtgctttaaaacctcccagatgtaaatgtctgagagaaaacattcttctaaataataagcgccccctgttgaaagtgtaaccaaaaaaaaaaaaacaaaagcacaacaaaacaaaaacagaaacaaacaaaacacaaaacaacacagaggggcggggccgcacaggagaaagaataagacctccacgggcggaggcgagcaccccacaacgtatatggactgcacacacacccaacggaagtagtcaagggatggaacagaacgaggggagcgcccagcaaaacgagtgaggcggctacataaaatacagagaagggactaagcgagcagcgcgggacgcggcgtaacaaaaaaacaaacaggcgagagacacggggggaacaaaaacgagaagtaacagagcagggaaggaacacagtaggcgggagcagacgcccccaacaaacaagaggggaggaaggaaaaaaaaaagaagggcgcaaacaccagc

SEQ ID NO: 492194 - DNA, 438 bp, Homo sapiens
actcgaatcgagtttgtcgtacaggaactcgatcggctcgctcgggcgcaggtcctggaagtgcacatcaccgctcgccagcttgatgcgctcgatacgcagtgggaacggcttggcgtcgggatcggcaggggtcggttcgctggcggggatcttgaacagccccagcagattgagtttgccttccttgtcaaacaggatctcggtcttgggtttatccagttcgatatccgccagatgcagcgcgcgggtccacaggctgtccagttgcaggttcagatagaggcgttcgaagcctacctgctctttacctggcgcaccgatattcagcccccagagcgtgagctccaggctgtacggattgaattcgatacgttggatatgggccggggtggtggcgtagttggcgagttgctgattggccacccgcaaggcaat

SEQ ID NO: 492195 - DNA, 5314 bp, Homo sapiens
  misc_feature (425)..(425): n is a, c, g, or t
  misc_feature (4902)..(4902): n is a, c, g, or t
  misc_feature (4929)..(4929): n is a, c, g, or t
  misc_feature (4932)..(4932): n is a, c, g, or t
  misc_feature (4955)..(4955): n is a, c, g, or t
  misc_feature (4963)..(4963): n is a, c, g, or t
  misc_feature (4986)..(4986): n is a, c, g, or t
  misc_feature (4990)..(4990): n is a, c, g, or t
  misc_feature (4997)..(4997): n is a, c, g, or t
  misc_feature (5002)..(5002): n is a, c, g, or t
  misc_feature (5006)..(5006): n is a, c, g, or t
  misc_feature (5009)..(5009): n is a, c, g, or t
  misc_feature (5094)..(5094): n is a, c, g, or t
  misc_feature (5108)..(5108): n is a, c, g, or t
  misc_feature (5123)..(5123): n is a, c, g, or t
  misc_feature (5268)..(5268): n is a, c, g, or t
gccgtcgcgaattagcgggaaagttttcgtggccagcatgatagtgcgtgccacagtggtggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgccttnggcacctgcctggccgcctccgtggctgcgcctggctctggcagggtgctatatgctgtcttcagcagagacagccggagcagtggggggcccggtgcgggcctctgcctgttcccgctggacgaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgagggctcagaggcacagccgtgctgcaggtggaggcctgaacctcacggccgtgacggtcgccgccgagaacaaccacactgttgcttttctgggcacctctgatggcggatcctcaaggtgtacctcacccagatggacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccccgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagtttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgacaggacatgnacacacacctggaagatttccctgggngcncacggactccttgaacaccctcntggcactncaccatctctaccaatacacgcngaanttctatnacganatcntcnatgccttggaggaggatcctgccgcccagaagatgcagctggccttccgcctgcagcagaatgccgctgcactggagaacaaggncactgacctctganctacaatctccagtnctgccttgggacataggtacctgaggtactgagagccctcaggggaggaggccgagtggctgtggctgaggccccacctccctggaacgcgcccaagccggagtgggtgcagcggaacccgcccagcgtctagactgtagatctnctctgagcataccgcgggcacgcacagcacagcccagcccagcgcc

SEQ ID NO: 492196 - DNA, 4016 bp, Homo sapiens
  misc_feature (3604)..(3604): n is a, c, g, or t
  misc_feature (3631)..(3631): n is a, c, g, or t
  misc_feature (3634)..(3634): n is a, c, g, or t
  misc_feature (3657)..(3657): n is a, c, g, or t
  misc_feature (3665)..(3665): n is a, c, g, or t
  misc_feature (3688)..(3688): n is a, c, g, or t
  misc_feature (3692)..(3692): n is a, c, g, or t
  misc_feature (3699)..(3699): n is a, c, g, or t
  misc_feature (3704)..(3704): n is a, c, g, or t
  misc_feature (3708)..(3708): n is a, c, g, or t
  misc_feature (3711)..(3711): n is a, c, g, or t
  misc_feature (3796)..(3796): n is a, c, g, or t
  misc_feature (3810)..(3810): n is a, c, g, or t
  misc_feature (3825)..(3825): n is a, c, g, or t
  misc_feature (3970)..(3970): n is a, c, g, or t
gtggtgcaatggcactgcagctctgggccctgaccctgctgggcctgctgggcgcaggtgccagcctgaggccccgcaagctggacttcttccgcagcgagaaatgagctgaaccacctggctgtggatgaggcctcaggcgtggtgtacctgggggcggtgaatgccctctaccagctggatgcgaagctgcagctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccccgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagtttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgacaggacatgnacacacacctggaagatttccctgggngcncacggactccttgaacaccctcntggcactncaccatctctaccaatacacgcngaanttctatnacganatcntcnatgccttggaggaggatcctgccgcccagaagatgcagctggccttccgcctgcagcagaatgccgctgcactggagaacaaggncactgacctctganctacaatctccagtnctgccttgggacataggtacctgaggtactgagagccctcaggggaggaggccgagtggctgtggctgaggccccacctccctggaacgcgcccaagccggagtgggtgcagcggaacccgcccagcgtctagactgtagatctnctctgagcataccgcgggcacgcacagcacagcccagcccagcgcc

SEQ ID NO: 492197 - DNA, 648 bp, Homo sapiens
ctgtgttccaagagagaggccaaaagagggtccgcatgttaaagccctgtctttacagcatggtgacctggcactcactcttcgaggttactgtgagaccgtatcacagcctatctttctcaggagaacatttggtctggtcgtaagataacacagtgtggtccctgagaatgagaacacagtctgcccacagagagtagcccatgagggtccaagtgcacatcatgtccacaagcgctttcaggtcacacagaaaggccatcaaagatagggggagaagaaaagaccggtgaagtaagcggcccagagaggaaattccacacagttactaccgttcaagtcaggcacatgtgactgccatttcgttttagtcccaagtataagtcacccagagtgtagaaaatatatctctcacagttaataagatgttctttaggtcatataacctgttgataggacttcaaaaaccctcagctctctggcacctatccaaggcgcattctacttggatcactataaaaaatatttggcctgacaaagagtgaaacctttacatgacagaacactgtcattgatatttcaaaagaaacacagtgatagaaaatagtggctagctccttttttaaacccacaaaaacacattcaccc

SEQ ID NO: 492198 - DNA, 5425 bp, Homo sapiens
  misc_feature (425)..(425): n is a, c, g, or t
  misc_feature (5013)..(5013): n is a, c, g, or t
  misc_feature (5040)..(5040): n is a, c, g, or t
  misc_feature (5043)..(5043): n is a, c, g, or t
  misc_feature (5066)..(5066): n is a, c, g, or t
  misc_feature (5074)..(5074): n is a, c, g, or t
  misc_feature (5097)..(5097): n is a, c, g, or t
  misc_feature (5101)..(5101): n is a, c, g, or t
  misc_feature (5108)..(5108): n is a, c, g, or t
  misc_feature (5113)..(5113): n is a, c, g, or t
  misc_feature (5117)..(5117): n is a, c, g, or t
  misc_feature (5120)..(5120): n is a, c, g, or t
  misc_feature (5205)..(5205): n is a, c, g, or t
  misc_feature (5219)..(5219): n is a, c, g, or t
  misc_feature (5234)..(5234): n is a, c, g, or t
  misc_feature (5379)..(5379): n is a, c, g, or t
gccgtcgcgaattagcgggaaagttttcgtggccagcatgatagtgcgtgccacagtggtggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgccttnggcacctgcctggccgcctccgtggctgcgcctggctctggcagggtgctatatgctgtcttcagcagagacagccggagcagtggggggcccggtgcgggcctctgcctgttcccgctggacgaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgagggctcagaggcacagccgtgctgcaggtggaggcctgaacctcacggccgtgacggtcgccgccgagaacaaccacactgttgcttttctgggcacctctgatggcggatcctcaaggtgtacctcacccagatggacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccgggtgaggacggtgcagccccgggtgtctgggtcctgctcgggtctgggctgagagctggtccacctgtccctggttccctcctcctcaccccgaccactgccgcctccccagggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccccgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagtttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgacaggacatgnacacacacctggaagatttccctgggngcncacggactccttgaacaccctcntggcactncaccatctctaccaatacacgcngaanttctatnacganatcntcnatgccttggaggaggatcctgccgcccagaagatgcagctggccttccgcctgcagcagaatgccgctgcactggagaacaaggncactgacctctganctacaatctccagtnctgccttgggacataggtacctgaggtactgagagccctcaggggaggaggccgagtggctgtggctgaggccccacctccctggaacgcgcccaagccggagtgggtgcagcggaacccgcccagcgtctagactgtagatctnctctgagcataccgcgggcacgcacagcacagcccagcccagcgcc

SEQ ID NO: 492199 - DNA, 1561 bp, Homo sapiens
taccttttactcctattcctcccttgccacctacaggtgacaaatctgaactcagatgtctagcttacttccattttcatcgtctctcatcccctcttcccccattatccatatgacattattttcacttcaaatgcacagacatcaatcttacaacaagatcatcacattaaaactaaagagagtattatttcaaagaacagcctgaataagttccatattcccctggtcaactatagcacacacagccagtcacagagttgctcatcatagcatcatatgtaggctcctattcaaacatgcttatgtagtcatcgtgtgagtgtattaaacaacaaacacaacatctacaccaaggttaaaacattatgacagccgctcctacaggtcaaggaacgtggtacactaacatacacacgatagtacaccagataggacaaaaaaaaataaccacaaacaaataagtgtagcggcactataccctcaaatacacaaggacataccaacaccaggggccgagacacaggagccaaacaaccagcgcagcagtggctaatatcaacacctacacaaagtcgataaggacaatacagatggcccatgacggcgcgactctaagacaaagagaggatgggagagtgccaatcacacacatacacaacacggacagtagaaatccaaggaacaagacacagggaaccccaaatttaaccatcaacatatcccacacgacagaaaacaacaagaacatacacaagaccaaaacaactgaggaaaccaaaacatatcacccaggaacgttgaaacagaggcacttggtgcataaataacgaacgacatctacaagagggcaccacacaagcgtgggggacatacgagagaaagacaaacggaccagacgaatacccagtgataaccagacataacagacaagcagtaaaacaagacaggggacactatattaccaacggataacgtgcaacacgacagggacgtccgcccagaataattaaaagagaccagataaaaaaagagggaagcaatcgggccaacaccacggcatggcacgccaccgacggagcaccagaactacatccacaaacacagcaatgacacactaaccacgagacatgacaacgaatcaactaccgagaacaccacagagacaacggaacaaccaaatcaccaagagtgaacaaacactgagagatagaatgaacaaataaaagaacatatactgggcagcaaaacaaaacaaagaaagagacagctaaccgagtagtagtaccaaacagacagtgaagacacaaggtgatagaaataacatcataacaaaagtagaaacgtacggataacagtgacaaagggtgaaatgaagataagagggaatacagaaaaagaacataacaagagaggagagtagatatagacacaaatacagagatccgaggcaaggcacacaagaaaatcgaaacagaaaacacatgaactactatctcaccagaagaagaaacaacaaaatatgaatgagacagaagaaaagaagatgtacgatatactg

SEQ ID NO: 492200 - DNA, 667 bp, Homo sapiens
gaaccaccagagcagtgccttctcgtcgaagcgggctccgatgcagggcgagcatcccccatgtgaggatccgggtctgcctcctcctgctgaagacagacatgcagcagcgggcccgggccactcacgtgccatacctagggcctgagtttggggatgggatgctctgcctgctgcatgtggccctgcacatggcagccgttgaccgttccattgcggttgaacgtggccttttcccacagtgcttccttctcactgcgcagcagagttcgtcccctgtggcatgatagatgtggttgggccatcgtgggttccctgagcccagccagccgtgggagctcccaaagtgggtggcttaccaggaccacccgttaaatgactttcatcttggtttcctcgtttcaccaaaatatacgtcgtataattatagtttcttccagtgtggctggctatagttccaaggaaaaagcagttttacacttatttcatttgtatttgtttaacatttatatattccctcattggacatcagaacttttatataaagacccaaacacgtgatgtttacacgagaatttcatattcgtgcaaaagggatttctgatccagtcatgacgtgtagtcttccaggcttgacaaaattagatgtagacaacgattacttaca

SEQ ID NO: 492201 - DNA, 2958 bp, Homo sapiens
  misc_feature (425)..(425): n is a, c, g, or t
  misc_feature (2849)..(2849): n is a, c, g, or t
  misc_feature (2896)..(2896): n is a, c, g, or t
gccgtcgcgaattagcgggaaagttttcgtggccagcatgatagtgcgtgccacagtggtggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgccttnggcacctgcctggccgcctccgtggctgcgcctggctctggcagggtgctatatgctgtcttcagcagagacagccggagcagtggggggcccggtgcgggcctctgcctgttcccgctggacgaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgagggctcagaggcacagccgtgctgcaggtggaggcctgaacctcacggccgtgacggtcgccgccgagaacaaccacactgttgcttttctgggcacctctgatggcggatcctcaaggtgtacctcacccagatggacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgtggggaatacattacggtcctttcttcaaaaggtttgatcggtctttccttttccattctcggctattaactataacttcattctcagttccacggctgcctagctttcggtgccctgntagattcatcattattcatccaagaaacttaaaaggaaaaaattggnctggcgcggtggctcaagcctgtaatcccagaactttgggagggcgaggggggcggatcatg

SEQ ID NO: 492202 - DNA, 731 bp, Homo sapiens
tgattctgtgaggaaacaccaatctgttttccacgccctcctctgtgtggagtctctcgctggacctggaactcagggattctaggcaggtcagctggcagggaagacaggcctctccacaccaagcctgaggttcaccgcgaaagagagggcgccgctctgcccccagcccggcccaacctgcacatccagcagagccctgtgttattcctggctgaggagtggttccagcaaagcgggctcttccacgtccttcagctcccccagtggcgccggatctaggaaaggttgtgccttttgctgaaactctggggttgacaggagctcatctaacagactggaggtgagtgcagatgagcacgccggctcctggagcggttgggaggtacctggatggctggcatctgtgcttgacgcggaggcttccggggtcacgagctccggaggtggaggtgccccgtctccgggttcccacgccgccctggcgacctggggctccagccccaccacggactccggtgggacgtgggtggcgcaagcccaccttgcccctgtgactcagcttgagggggcccaagctgtcccactgagcacgcgcccagcaggccgtcgcgctgcgcgttctggttttcctgtcatttgtggggtgcagaggtcaccaggagtctgaggatgggagagccccagttccagaggagccaggtcagcgaacacaaagccccgatgcccgg

SEQ ID NO: 492203 - DNA, 369 bp, Homo sapiens
  misc_feature (104)..(104): n is a, c, g, or t
  misc_feature (361)..(361): n is a, c, g, or t
tggcttcttttaaagtaagctaaaaaacccatgtcgatacagttgtgatgtgattttgattattacccttcaagagatagttaagtgggcccaggtgcaagttncacgcctgtaatccccagcactttgggaggccgaggcggtcggatcacgaggtcaagagatcgagaccatcctggccaacatggtgaaaccctgtctctactaaaaatacaaaaaaattagctggacgtggtggcgcgtgcctgtgatcccagctactcgggaggctgaggcaggagaatcacttgaaccctggaggcagagattacagtgagcagagatcaggccactgcactccagcctgggtgcggagccatantccgtctc

SEQ ID NO: 492204 - DNA, 1317 bp, Homo sapiens
tcctaattactacctttaattctaatgtgacccagggccctgaaagctgataacaagctggtgctgaccaagagggaactaggggtcggcaagaaaggattatggggtgggaacaacattgggctcttccttgtgggagtggatcgctgggggaaaggggaaaaagagtgggctacagcctgcagtgtaaatagggctaaaaaacgccaaggccaaaggctgagagggagagaggacagctcagaatgttccagcctgggggctctggggtgatagggtatactcccttttccctggtgccttcccatcttcgtccatgagccataggtctgggaagccctgtgtggtggggaggcgtgcggtgtgaatgttcaggaaacggggaactcgtggctagcctttgggccacattccgtgggcacctcaaggccccttgttggcacaaatggagaaaatgggcgcacaccagggcgccttgtgccggccatgagggaaaaccgagcgggaacccagaacctggggaggccgtgggcccaaaggggggcaccgaaagaagccaagggcacccaggggcccccagtggggcatgagaggcacaccagagggagggggcgacaaactgtgcgcgacacggggacccatgcggcgggcctagcaacgcgagcccgccacagaaaaaagcccatgaaacccctgatgatgagcgcccacgggacaaagacaatgcttgtgcacaaaacccgcaccaccaacagggagcccctcacccaattgtggagaacactggggggccccaagagaccacgtaggcgagagacacacaccccaaggcgcaaaaaaaagcacggggctcatccccagaggacccaggggagacacccatatccgagagggagagaaccccaccaccaagcggacaattagggcccccaaaggaggagtgtagcgcgcgcgacaagttatccaaaacaagcgaggagccaagggggggaacaccaccggcgaccaaaagaaaaagcgcctacagagaaaatagaccacccaaaagaagggacacacaaaggagggggccacaaaggccactcccctcaggagagaaaccccccccacaagaagggagggggggacacacccccaacggaggaggccagccacaggtaacgacagcgagccacaaagataacacgcctaggaagagccgacaaaacaggagcactaccagatcccgccacgaacaggccaccagcaagcccgcacgcaacacacacgagggagacgccaccacaaccaaagacgagcagagcatcaatgaacgac

SEQ ID NO: 492205 - DNA, 296 bp, Homo sapiens
taattgcattaacccaggaggcataggttgcagtgagctgatgttgctgcagtgcactctagtcctgggtgacggatcatgactccatctcaatatctatcaaatcaaaaaacaaatctaagtgccggggttttataggcatgagccaccattgccaggcctttatttttaatggtggttaaatacattttacaaaatatgttccatcttcagcctgttaagttcagtagtacattcatacgttcatattattgtgcaatccagtctctagatctttttcatcctgcaaatattgg

SEQ ID NO: 492206 - DNA, 222 bp, Homo sapiens
  misc_feature (219)..(219): n is a, c, g, or t
gtggcgaagtgattctcctgcctcagcctgctgagcagctgagattgcaggcgcctgccaccactgccagctaatcattgtatgtttagtagagacggatttttgccatgtcggacagactgctctcaaactcgcaatctcatgatctgcccaccgcggcctcccaaagtgctgggactacacgatgagacgatgcgagccaccgtgcctggccctttnttt

SEQ ID NO: 492207 - DNA, 317 bp, Homo sapiens
tgtgttgccaactgtggggggtacaagttaaccccccccccacataattcaagctacctataagataccagtgaatgcagacaggaagagatacgcacagttggttctcacgagtgaactgacactagcaaaccactgcctctgacacacatacacacatcaatgttataaccataacagggtatccatgattttataaatacaatagcactctcaagccagtctgcttttgcttatgttgttactactgccaagaatacccacccacatgtgtactggcaaacttttactttacctccaaggctcagaaaaaaaaa

SEQ ID NO: 492208 - DNA, 503 bp, Homo sapiens
ctccactctaatgacctaatcacctctcaaaggcccctaccaccctaatatcatcccacatttggggagtaggattttcaacatatgaattttttagggggacacaaaacatttccatctataacaagtactcttttctaaaaatgtaaaatctgattgttttactccttagacatattttgtaacgggttttccattacctagagcagggttcccaaactcaaatgtaactgattaaaggtaattaaatggtgatttttttttacatacccttttttttttttcgcatattggagtaaaagagaatattttttattcccatgaggatggctttctcttattttccttaaagtatgtctttctttttgtcttccatttggtcacttggaataaaaaggacagcttagaaatacattcctctgctatacaagacagcggcaaaacatgatgaatggcatctaacactggacatcattctgggtacaggggggaatcctggggct

SEQ ID NO: 492209 - DNA, 591 bp, Homo sapiens
ctgtacccgccgccacacacacacggggtgtcccctcggagccaacgcgaggggagttgcctcttaataattttgtgaataattctcgttttgttaaaagaaccccccattgtggtaaatatcttataactcgttttagaaattggtacataggcttctattacctattaggtggaaattttaataatgtaaaatgtgttagccctgatagtcccttttcccaagttttaattggggaaattaaatagtgtgaatgtttggattgatatcgtgaaatcctccgccgagaaattgggctggagttgtgctttggttaatacatctttccctataagaagatataacacccaaatcccttccacggtagctcggcaccccactatagagaaaaaagcaccaagttctcagagctctcgaggaaaagtggttgtccccgtacccccacatgcacctgtaaatatccctcccctctctccctggtcccctcccccatccccccccctgatatcatggggagtaataggacccgagcggtatttctggcaccaaccctagggactatcaggttattaaagctttgacttcctgaga

SEQ ID NO: 492210 - DNA, 661 bp, Homo sapiens
gcgtcatgtgatgcctggtaataatatggaatagtactatctctcaaggcttagagaattgcttgtagatggtggcgctagatattctgggtcgtccagtctgcgtgtggtggtgagacagaagtctctgactctcatcagatactgagacgctaacagttattgctgcgaagctttctgggcaggtagagcgtccgatacttctagttctttttcaaactcgtaggttagtcttcctcaacaaaatctctcaaatccggtggtaatgtttctataccaacaaggggctgcccagtttctttattaaactcctcttgtattaggaactgtgccttatcatttatgtacattaaacagtatgcactggcatttctataaccaccaaaagagtccctcactagctcttcccatgatgatttagtcacagcaatatcattgtacttcatccatctgctttcacgatgatcaaaaatatatgcccagtagtgcccagcattagcttggacttcgtgaactaaaacggcatgtaatcgataaggaacttgtatcatagatccgtcagagtacattaattcaatggttcgatggattctggatatgcttacctgcgaatctctggtgtcatttctatttctgtccccagcgatctgattattccggg

SEQ ID NO: 492211 - DNA, 585 bp, Homo sapiens
agggcggcgggtgaacgtgaacgtgggcgtgctgggccacatcgacagcggcaagacggcgctggcgcggtgcgctaagcaccacatgctccacctgcctgcctttgacaatgcatgcctgcagatgcctgctgagctgctggcatcactgctcgatctggggcttctcgtgcttctctggtgcctgctgccctgctgcgcctgctggtctgtcttttgccctgagttccagtgcatgctgccctgaggccagatgccctgagccctgtgtgagccacatgcttcagtgtcacgctgtgtctgactgccccgtgagcacgccatccctcatcctggacccatcatcaggacgtgggcccaagatcatttgatctgatgattgcttggtcatctgatgttgaccaacggggattgcagacccaagtcacgctggaattgccttgttcgatctggccacgatttgccttgccacgaatgcttggctcgttgtgttgcttgaaacaacaattacgacacttctctacccatcgaatgggacaaccgacggaccacgtgccacggcaagtttgactcacacaaattgac

SEQ ID NO: 492212 - DNA, 414 bp, Homo sapiens
  misc_feature (41)..(41): n is a, c, g, or t
ggaaaaacccctccaattttcccaaatgcaatcagggtaantagggggggggttttggcattaaaataaatgtttcaggctttggggtcctgatcaaggtcctcattaaaaaatgggggttccccctaggggtttttcccctttgggaggggcaaaaaacaaaaacttttgaaagaaacttggggattttttttttaggggcgggcggattttaatcttttcagggggcacaggattcctttaagggggcatccttttttgaaaaaaaaaacctttttttcaaaatgaccggtttaacccaaataagaacggggtttttaaaccctcatggtttccaaatcattttattttatttccgggagggagggggcggtttccccctccccccacacaaaataaaaacggtttttgcca

SEQ ID NO: 492213 - DNA, 633 bp, Homo sapiens
  misc_feature (609)..(609): n is a, c, g, or t
ggcgcgcctcccggcgcggtggccgaggcgtagcgctggacccccgacccctgcgaacatggcgctgcagagtggtgcggagcgtgtgcgggccctgctctgcaccctgcggcgcggtccctgttaccctgcctgcgccctgcccgcccgaggccctggcagctggggtgtgggcgccgtccgtacgctgccgcactgggacccgctctgcctctcggtgcgtaaattcacagagaaaccccgagtgggtaaacaaccagaaagtggcattggaacagtgggaatcagcaatttggcacagggaaggcgtgggagatgtggttaatgggtaggtctcccctgaaagtttgggacaaaaattgaacaagacaagatgagttttggggcttggcgcacagtgttgaaagctggctaggtgaactctattctccttttaatcagggagaagtacctgaaaatttaagtgacgctctttgcagaaaatccaggacttgtacaccaaaatctgtgttatgacagatggtggggctgatcaagattgacacttgagtaaccccttcagaacctagattgacctttatgagtgaagaaggcttttgagaaataccntaaaatctattggaggagttgaac

SEQ ID NO: 492214 - DNA, 218 bp, Homo sapiens
  misc_feature (7)..(7): n is a, c, g, or t
caccatngtgcaattctttcgtttgggtttcaaaagatggcttatacacatatgaaggtacagggagggccccggggtacctcggtgtacctttccatgtgaataagccatctttgaaaaccaaaacgaaagaatatgcacaataaatttggatccacattaaactagttcattcaaaaatggaaccccatcaaggccagcacaagtggtggcgggta

SEQ ID NO: 492215 - DNA, 242 bp, Homo sapiens
ggggtacatagtgatgttcaaatatgtataatgtgtaatgatctgatcagggtaattagcatatccataatctcaaacatttatcatttctttgtgtttggaatcttttttttttaatttaaaagtaaactttagcacaccaacatggcacatgtatacatatgtaacaaaaccgtacattgtgcacatgtaccctaaaacttaaagtataataataagaaaaataaatgtgaacataaact

SEQ ID NO: 492216 - DNA, 357 bp, Homo sapiens
  misc_feature (156)..(156): n is a, c, g, or t
  misc_feature (271)..(271): n is a, c, g, or t
  misc_feature (278)..(278): n is a, c, g, or t
  misc_feature (288)..(288): n is a, c, g, or t
  misc_feature (309)..(309): n is a, c, g, or t
  misc_feature (317)..(317): n is a, c, g, or t
  misc_feature (348)..(348): n is a, c, g, or t
ggctcgcgagcagataccaggattctcctgtctcagtctcccaagtagctgggattataggcgtgcaccaccacacccagttgatttttgtatttttagtagcagacggggtttcacacatgttggcccaggctggtctcaaactcctagacctcngtgatctgcccaccttcggcctcacaaagtgctggagatttacaggcgtgagccactgcaccacaaccagagtcactgtgtttttctttgtgtgttttgttctacagtttctccnatcacangtgtaagctncctttgggaatgtggactctngtccacanttgctagtcatttgtgtctgcaggtttctangagcagcac

SEQ ID NO: 492217 - DNA, 341 bp, Homo sapiens
ccccctccccgggtacttttcatttgtctctgtgtcatgacttgacctgtggtcagtccttctccctccatggcaggcctgaccaaggacttctgtccaccctgtgcaggcccttagtcgcccccgccgtaggggcgggggactagatggaatgacctactgagcctcggctgtctgtctgtctggctcgctggttgtctgtttgtctgtctcctggctgctggcctcctcagtctaggttgctgtcggtccagatttgcccttgggatatctggatttcttctcctcggggctgaagctcgggaatcacagagttgcaacccagaggcaggatgcagacc

SEQ ID NO: 492218 - DNA, 939 bp, Homo sapiens
  misc_feature (165)..(165): n is a, c, g, or t
  misc_feature (385)..(388): n is a, c, g, or t
  misc_feature (394)..(396): n is a, c, g, or t
  misc_feature (398)..(400): n is a, c, g, or t
  misc_feature (402)..(404): n is a, c, g, or t
  misc_feature (409)..(409): n is a, c, g, or t
  misc_feature (411)..(411): n is a, c, g, or t
  misc_feature (426)..(427): n is a, c, g, or t
  misc_feature (429)..(431): n is a, c, g, or t
  misc_feature (433)..(433): n is a, c, g, or t
  misc_feature (447)..(447): n is a, c, g, or t
  misc_feature (450)..(452): n is a, c, g, or t
  misc_feature (459)..(459): n is a, c, g, or t
  misc_feature (472)..(472): n is a, c, g, or t
  misc_feature (480)..(480): n is a, c, g, or t
  misc_feature (482)..(482): n is a, c, g, or t
  misc_feature (489)..(489): n is a, c, g, or t
  misc_feature (493)..(493): n is a, c, g, or t
  misc_feature (495)..(495): n is a, c, g, or t
  misc_feature (515)..(516): n is a, c, g, or t
  misc_feature (522)..(522): n is a, c, g, or t
  misc_feature (527)..(527): n is a, c, g, or t
  misc_feature (535)..(535): n is a, c, g, or t
  misc_feature (541)..(541): n is a, c, g, or t
  misc_feature (546)..(546): n is a, c, g, or t
  misc_feature (553)..(553): n is a, c, g, or t
  misc_feature (555)..(555): n is a, c, g, or t
  misc_feature (850)..(850): n is a, c, g, or t
  misc_feature (936)..(936): n is a, c, g, or t
aggggtacgatcaggcctgcgagcttctcccagcggagcctgggcgagccgaggttggccgccgccgccgccgagcccgctgccgccctcccgctcctgccccacccgcgccttgcccgggggcttctgccggggtggggtccgagccgggcgaccgcccgctgncgccgccgtcggggccgtaacccggccctgccgtccctcccgccccagccagcctctggccgccggagcccgcggggcgtggagcgcgaggagccccgcggccccgatcgagcgtccggggcggcccccggcagccagctgcgacgttccaaaatcgaacctcagtggcggcgctcggaagcggaactctgccggggccgcgccggctacattgtttttnnnnttagannntnnntnnnttccntntttcgcttttttttnntnnncnacccgggccgttcnttnnnccccctncctcttcctggcngtccctcntnccctctncttncncccatacctctttgtaccgnncccccnggggncccctgcncccctnccctnccccctnancgcatggaccgtcccgcaggccgctgatgccgcccgcgggagggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgcgagcaggacctgcccttctgcaaaggagacgtgctcaccattgtggccgtcaccaaggaccccaactggtacaaagccaaaaacaangtggggcgtgagggcatcatcccagccaactacgtccagaagcgggagggcgtgaaggcgggtaccaaactcagcctcatgccttngtt

SEQ ID NO: 492219 - DNA, 489 bp, Homo sapiens
  misc_feature (18)..(18): n is a, c, g, or t
  misc_feature (50)..(50): n is a, c, g, or t
  misc_feature (252)..(252): n is a, c, g, or t
  misc_feature (392)..(392): n is a, c, g, or t
  misc_feature (438)..(438): n is a, c, g, or t
gtggtttctctatctggnggcagaggcttcttgcctttccaaagcccctncctggcagtggaccttgagtagagaggagttctgctctactccagcacacaccctgggggttccaggtaaacagagacccagacctgtcctcacttagtccagagccctggggtcttctagctgaggctgtctggggcccatgggacctggagccaggcccggcctaatcccctccaggggtaggggtggtgagtgattcanccgagctttgttttgcctgtgggactcccctctttaattggcatcccaaagggcattacctgtttgtcaactgctttacccacagcagacagaagttgggggttgctttaagtctcaggaacagaatataaagaaagagncagataatagaaagtgatgtttttatgtttactatctgaactcaanaagtggggattttaagaagatatctagatgagtccaggatcttttttcttt

SEQ ID NO: 492220 - DNA, 250 bp, Homo sapiens
ttcaggagtcattatgattaatgcactatgcctggttcttcaatattgcagagttcagagtatatttgttggttgagaaaagcatggtacatgtcttggaaggcttatatttgtatagaaaactatagctgaagggtgactacttttttttttttttggaaacagggtctcatgttatatggcccagccgggaagcacggggcccgggcggggaataccgaccccaaatccgaaatcagtggccatagcg

SEQ ID NO: 492221 - DNA, 355 bp, Homo sapiens
tgctagtagaactctacgtcgacaggaccttatacccgcactcactgcacattgtaggggcggtccgcgtgtggatgtgatctgatgctagaatgaggtgtgagctctggctgaagcccttaccacattcagacacgaggaagtagtggatttattccccagtatgaactgttgctggatagtgtgagaatcgatagatgtctagaagatgccggatgtgaagggaccttatacgcacactggttacactctgcatggcgggcctatcaccgatagtatgaagtcctcgtgactgctgaatgaggagttgagcgtctggacgtgaagggttgattcacatttccactaccactgg

SEQ ID NO: 492222 - DNA, 161 bp, Homo sapiens
gtctagacgatccctgttatagcacgctggacgtgcgctcacaacgcttagctagcacaccccagggaaacagcagtgattacctttagcaataacgaaagtttaactaagctatactaaccccaggataggtcaatttcgtgccagccaacgcggtcaca

SEQ ID NO: 492223 - DNA, 498 bp, Homo sapiens
cagctgacctagcaccatccacagccctgagctccctttggtgggaggtggggtgagagtgtggagcaggcacagctccagacacccaggccagaggaacccccacctctgcaagggctggtgctggatgggcgacgttccaggagggtcccaggcctacagcttctgcccagaagagtccatggggcaaaggggtagaaccctgggccaccccagggcatgactggctttactggaaatggctggagaggttgggcttgtgttccttgaacccccagagcccggtgatcccacagcccggaggccatcactcccctccagctgccttttaggattagacaggcatgcggctaaaacatggccaggccatacccattttccacgtgacaagaggctgtggccgtgtttgcccacaccacctgtgtttctgctttgttgtcgtacagcagttgtgggtgattaggaataaaggctgactcattgcaacacggtctctca

SEQ ID NO: 492224 - DNA, 402 bp, Homo sapiens
  misc_feature (375)..(375): n is a, c, g, or t
  misc_feature (382)..(382): n is a, c, g, or t
agctccgacccctcataatgtgtgcccatggcacctagcacataggaagcgctcaatagtagacgaaggtaggtgaggtgatggcgaagattccttctagagctagacttctgtaacacactactcagcctggtcagagtctcgagatcttaaagttgggtgcatcggtccttacagaattattttcctagcctcttggagctgagaaaggaatttcttttgggccacagagccaggccccttgtggttcactctggccctgggccctggaggtaaaggtgaagtatctcagccaccagctctggattccatctgcccccatgtgtggacctttctcacaagcccaaacagttcccagctgaaggcctgcgcccncagcggngaggttgggcacacattatg

SEQ ID NO: 492225 - DNA, 333 bp, Homo sapiens
  misc_feature (163)..(163): n is a, c, g, or t
  misc_feature (172)..(172): n is a, c, g, or t
gggacggagtttcgctcttgttgctcaggctggagtgcaatggcaggatctcagctcactgcaacctccacctcctggattcaagcgattctcctgcctcagcctcccgggtagctgggattacgggtgtccaccagtatgcctggctgatttttgtattttnagtgggganggggtttcatcatcttggccaggctggtcaaaaaatcctgacctcagttgatccacccgccttggcctcccaaagtgctgggattgcaggcatgagccaccacacccggcccacttacaggatttttctcccccttctgtcgtcttctcccccccgtatag

SEQ ID NO: 492226 - DNA, 1077 bp, Homo sapiens
gtactggtcggactcccggtgtattggaggcggagccgcgctctacccgattgcggggctgcgtgggccgcaggtcgacgaggacctgctcggggtcccggacgggcccgaggccccgtggacgagctggttggcgcgtaccccaactacaacgcaggaggaggaggagcgccgctactacctgcgcaagcgcctgggcgtgctcaagaactgtgcttggctttgccagcgccgggggcaatgctcacctacggcgtctaccgtgggcctcctgcagatgcaggctgatcctgcagctacgacgaggaccctacctgcggaggttgaacgtattgggcaacattgggggcttgccccgaacaatccgaccagcaagaattgcttgatggcgcatcaacgtgactcccatcgccgccctgctctacacacctgtgctcatcaggtttttttggaacgaagtggattgatgttcctcgctgtgggcatctacgccctactttgtcatccaccaagtactgggagcgctactacaccgcttgttgccctcggcttgttggcccttgggcattggccatcgtgcctcttttgggcttccattgggcaactacatcaccaggatggcgccagaagtaccatgagtactcccactacaaggagcaggatggcagggggatgaaccagcggcctccgacggggctcccagcgctgcgctatctccgtggtctaccaaggccatcttctacagcttcttccatctgaggcataggcttgcggccagttgcccatgaattactttcctgaaccattagctgtatttccgtgaaccaagacgctgaccactgttcaagcttcgggaacccaaccaggcagcggggaatcctcagagcggtttcaacaagagcggttctgcggacgctccccagcgggtcgggagaaccccatggttgcggaagagcgtgtcccactggagtggcctctttggacaactgtgagtgagccggtataagtcagcgccgattcgtgccccacgagggaggactatatcgcggccgagcggtgtgggagcagatattcagt

SEQ ID NO: 492227 - DNA, 535 bp, Homo sapiens
ttaaacagctcatcacctttacttataccaaggcgtgcccagattcttttctgagcaggaaatatcaggtagtccacaacatactttatcttttttttgacaaaatatgtaatcgactgacatagcagaaagcctgcattaattgttttttgtttgtcgttttacagcgctacgacttgttccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaggaaaactttaaaaatagctttcagcctgtcaattccttgagggaagaagaaaggagagaatctgctgcagcagacgctggctttgctctctttgagaagaagggagcctagctgaaaggcagcagctcatcccagaattggtgcgaaatggagatga

SEQ ID NO: 492228 - DNA, 467 bp, Homo sapiens
  misc_feature (1)..(1): n is a, c, g, or t
  misc_feature (211)..(211): n is a, c, g, or t
ncacctgtgctgtggtgactctagattatccctccttgttatccaagcagtcgttacttgcactgatctggccggtgctctgcacacgcagttcatccataggccctcccagatgtctgcgaggtgaccatgttgctgccgatggcaggcgtcactgcgctacattgggcagcgcgcagtacagcatgacgtgcagccagcccaggacggncagcgcgatgcccattacctgtagccccatggaggccattgttcagcgtccgcggggagcttgaggacctggaaaggctgagggggatcgggctgtgggggccgaaaggatcccaagcgctggggacggcacttacacgttcgcagagtgcacttttgcaccgtgagtcaaggagaataagccagtcctgatgcgcaagccagcaagtgtgtcagacccagttctttcaagcgactgcttggattacaggggggta

SEQ ID NO: 492229 - DNA, 1352 bp, Homo sapiens
tggtaaaaaaaaatattttattggaaacagtttctcatttaacaagggaccaaagtccaattggactcaaccctgtgtctccaaccagcatctcaacagcttactgtgaaaaaatttcaaacattacagaaaaaggtgtgggggtgtggggtgtgagggggtgggcccctttaggtctcccattcttctgtgccatgtgtgtggcaaaaaaaaaaacaaaagggaaacaacacaaaagtagtgtgctgtgtgcaccacgcgccgcgggtgtccatatctctgtgtgttttgggacgctgtgaaggcagaccaccccccttgaacctcgctggcttacattaattccttaaaatatccggcaaagcgggccgcgttctaagagaaattatctcccctgagagggggcggccacaaaggttttaaacgcgtttatcaccccaggtctcttctctgttatctccacacagggggggggggccccctatatataggggagagcgcgtcgggatatattaatataaacgctatagggcgcactgggggcgcgcggcgagatattatacacacaaacgggcgtcggagagaaagtggggggaaaacaaaccggtggcgcaaagctcgtgggagaagacactcccctgtgtggggcagacacgagagaacaacaccctaataatctctcggggggggagcggggggggccccccatacatgtggggggcacaccaaatctctacaccctctagcgacaaaagaatttttaaaaaaggaccctccaaaagggggcacaacctatctcttacacacactttttcaaacggggggtgtctctaaacgggggtggcgtattcacacccctaaaggcgctgggccatttaagctgcctcctgcgcccgggcatattaacaacaaagcttttcgcgcccacaaccggggcaacatcgtcacaatttcgcgggcacacaccgtcttttttttttccgcagggaggacacgttctatgtttatctaatataccataccggctaacgacagtataaccagatcatatcacgactctcaccgcacaaatacagaacaccacaccacaagatactggcagcgctggatgcaggtcgcatatactacaagttgtaacacagaagaaaaaaagtgtcaggctgttttcaaatacagtagaacagagcacaacggtagtcgcagctacacctcaagcaaccgcatcaatcaacaactgcccccaccagcaagacgcacgcagcacccacaacaactcgagaacacacacacgaccaccacgcacgcgaggcaaaaatgaccacaacgcaaaccacgacaaaacacaaaatcca

SEQ ID NO: 492230 - DNA, 760 bp, Homo sapiens
gctcgcactctgttcttccgccgctccgccgtcgcgtttctcatgccgtgtcgcaaatggaacgaagacgatcgccgcgctggtcacttgacaatggctccggacatgtgcaaagctggattttgcttggggaacgaacgcatccccgaagaccaggtgtattccgttccatacgatacgggcggcacccagcacacccagggacgtccatcggatgtggccattgggggaccagaaacggacctcacataaccggttggcgcagaacagaagggccccacggaagcaaacgccgttgggcaacttcccttggacgctcccatgaacaacgttaccccacacaacatgggacggccacttggggcccacttccgatacaaacccaaacccctggtgcagaaccgaacccacttggcgaacggcacacggagatttctgttgggaccacaacaccaaacgcaaccgccggatagtaccgttaagcaaaaaacgaggcacggtccgattggccagacaccggaattgggggaaccgcacccagtgagcaaacgggagaacgaccagaacacccccaacgcgaggaggaccaatggccccgttagagacacccccccggcaaacgctgagcccacagacacccccaccaatagcccaacaaaccccaccccccaaacacacgggggaaccaccgaaagccctcaacggcaacacgaccagcacaagaacgggcacaccttgcgacaccccataccgaacagca

SEQ ID NO: 492231 - DNA, 208 bp, Homo sapiens
tggcaatgctagcaagatctcaatgtgaggcaaatatttttaaagttgtgaacaaggatgtgtcaaaaaaaaaaaaaaaaaagaaattccccaaacctcgcacacaagggttggggggcaggtagggttaaaactgggtttaacagggaaccctggaaaaagtctcctaaagagtttttggtggacccgtaaattatattattctgga

SEQ ID NO: 492232 - DNA, 229 bp, Homo sapiens
aattcgacagttgtgcataatgttcctggaatactaagatggtgctgtgtctacagagccctgggaggtgacggtgaggatggtcccaacaggcgcagattagggtcactggccccggtcctggtgcctcttgcctttgccttttcttcttcttgtcctctggccgtggctccagggcgcacacacaggtggagccgccagcgatggccttgggcaggtcgacgccccg

SEQ ID NO: 492233 - DNA, 405 bp, Homo sapiens
  misc_feature (31)..(31): n is a, c, g, or t
caatgggctatagcgtttgggcggggtgggnggggggggctatttttggttcccaacatatttccccctttatttttagaaccgggggccttgggattccttggggttgacaatggggtggtattcccgattgaggccccctttggtataatatttccttcccaagggttttgggatttttggggggtccccccattgggtttaaaaacagagggatttccggggggtttaaaccaacccctttttccgggtaacggggcggggggtaacacgggggaatggttttgaattttggggggcaacccccggttttaggcccttggtcttagatttttttcccctaaaattttttgaaatgggggcggtttttcccctatggccccccctttcccccttttagggcca

SEQ ID NO: 492234 - DNA, 260 bp, Homo sapiens
ctggttgatgcatttatgtattaagagctcataactcgaagtaaaagaaaactgtaaaagattgttactttaaaaaaacatttaaattcccttagctttaatttcacatttataaatttgaaattatgattctatttacagggtctattctcattgcgtctattagcattatcacttatttattgttatttagaggtggtggtggtagacatagataaacaagtagaaaaagcaaatttgatagttgcccattgtgataa

SEQ ID NO: 492235 - DNA, 1059 bp, Homo sapiens
taaaaaaaaccaacaacaacaaaaaaaaacaatgaaaaaaaaaccgccttgtgattgaaaaaattgccccggccgggggcctgggaaaatctatgtctcgtaagctgagagggggtggggtgcccctcctggttctgggggcattgggcccccatcagcagggatctccgccagtcctgatccccaggactctgagacttaagtgtggttatttgcgccccgacaaaaaaaaaaaacaaaaaaaaaacaaaacaaaaaaacacaaatccaaaaaaaaaaaaaaaaaaaaacaaaaaaaaaaaaacacaaaaaaaaacaaaaaaacacaccaacaccacaaccaaccacacacacacaacacaagggcggcgggcgcagcagcacccacccccccaggggcgcgccacctacacaccccacccatccactcacaccgaacgggaccagacccaccgaacgtagaggcaggaaccgacacaacgccacaccgccgccgcgcggccgagacaacaccccccgccgaggagaacaaacacccaccacaccacgtcaacccaacacgacgaacgcacacacagggaggcgagacaccacacacgacgcacccaccccccgcacgaaaacacaccgcccaccagcgaccaaaactaactactcggcccctaggctgccgtcctccatccactggccgcacgctccacgccgcgagagaactataaatcaaggagcacacagccgcacacctcacccagaccgaagtacaacacagcgcaacgggcggactgcaaccacgcccaccgccgtgaccccgcgccccaaacacccgcccctcccgcccccaccgctcgagctgagcaccaacctctccgcagctcccatcgtagcaccgcccgctctccaattaccaggacaccgcgcccccccgcagcatcccgccagtataacaagaaacacaacagcgagcgggacctcggacccaaatcgtcgataccaggcttcgacgcacccccacccgctccccgtccccaacgagcacgcagccacgcgccccccccccct

SEQ ID NO: 492236 - DNA, 198 bp, Homo sapiens
ttcgccattatatgggggtatgtctctgaggctctccatacacctagtaataacagggacggcatatgtttcatccagtcacgggagtcaagtaaatggtattccccgcaagaacacgattcttgaagatctgacaatacacgcaagtgtcaaaaccggcaaacaagtgtgtcggacatgagcacggcatcagggcag

SEQ ID NO: 492237 - DNA, 159 bp, Homo sapiens
gcttttgcccccccctttttactatttgcccaaccccttttttaggaatgggcttttttttgggcccctttttatcccttttcccttttaaacccgggtaagttgtatatttctgttttttatggccaagggccccccattaatcctatgggaatttta

SEQ ID NO: 492238 - DNA, 316 bp, Homo sapiens
taatgtcatgtctgtgtgtcatgattgcggcctccatttatacagacaggcgtgaagacattcacgacaaaaacgcgaaattgtatcccgtgtccagagaaggcagttacggatattcttacatcctggcgtgggtggcattggcttgcaccgtcttcagcggcatgatgtacctgatactgaggaagcgcaaatagagttccggaggtgggttgtttctggtgcagaacagaatccactttcagatatccattttgtatgtaatcagtattttttgaggtttttgtagcaaacatattgtttcctttcaaagcca

SEQ ID NO: 492239 - DNA, 456 bp, Homo sapiens
aatggataaccgttcagatccaccaagcacacctatgccattacgcccatgaaacgcccaatggaggaggacggggaggagaagtcgcccagcaaaaagaagaagaagattcagaagaaaggtacaggccgggcgcggtggctcacacctgtaatcccggcactttggaaggccgaggtggacggatcacctgaggtcaggagttctggtgagagatcaagccagctggacttcctgggtcgagtgaagacttggagaacttttctgtctaggtaaaggattgtaaatgcaccaatcagcactctgtaaaaacgcaccaatcagtactctgtgtctagctaaaggattgtaaatgcaccaatcagcactgtgtaaaaatgcaccaatcagtgctttgtgtctagctaaaggattgtagacacaccaatcagccctctgtaaaagcgcaccaatcag

SEQ ID NO: 492240 - DNA, 113 bp, Homo sapiens
gcacaagaagcacaagtcggacacacacctctacgaggagtatgtagagaagcccttgaagcttgttctcaaagtaggagggaacgaagtcacccaacttttcaggggcaact

SEQ ID NO: 492241 - DNA, 962 bp, Homo sapiens
agtaaatacattagctacacactgaaaaatataagtagacatgctttgttgcaaccaaaagatgtactctgctttttaatgacagaattattatagctcgagctgacatcactagcgtttctctatcactcatgtatactcgcaagaacagtgtatacccgagaaagacaacatacttatctatgaaggaatttatgttgtccatgaacgtttgctaatattaggagaaattcctcccagctgcatggtcaggtatccttcgtggaatgtaaaccggatctgaatgaccaaagccaccttagaccttcgttgtctcagtgatcccttatacaggcctgccttatcattaattctcaggcttattctatgaagcacttctcagtcttcagatagaaatttgtgaaaatctaagcgtggtttggaagtgtctttgatattctgttagttacattgcccaatatggaaacatgtctcatagcatggtcccccgtatccagtacatttttatggagtttcatgttgtccaactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatattacattgctttagaaaggttagttgtcgagatgctaagcacggatcaataaacttcagattttcaacaaattgttcccctgtaaacagttcagccacatgacacaggcacactttaccaaaactacctaagaagtaatctagaaaggggcggaaaaacccacaaacacacacattaccaacgaaaaccacaggacgcccagggtgtcccagtcctcctgttacagcaatgaaaacatgtcaactcattgataatctggcgccacctccacacctaggaccat

SEQ ID NO: 492242 - DNA, 711 bp, Homo sapiens
  misc_feature (543)..(543): n is a, c, g, or t
  misc_feature (647)..(647): n is a, c, g, or t
  misc_feature (686)..(686): n is a, c, g, or t
gtggggggaagaaaaaattttttccccccccccccccccaccaaaggttttttccccgggtggcccccccacaaaaaaatttttttgtgggggggggggtttttcttctttgtgggggggaaattttgttctctaacaacccggtgggggtatttaaaacaaaaccccccctaaaaaaaaaggcccctcccttttttataaaaaaacgggggccccctggtgggggggggggggggttgtctccccgccccggcggtaaaaacaaatattccgcccggcggctttttttgttttttttataaaaaaaaaaaaaaccccccccccccccacataaaaaaccccaaaacccccccccggccccaaaagggtttatgggagtgtttctcggggggcgcaacccccccttttttccccccttggggtaaaaaaaaaaaaggaattttttttaaaaaagggcctagcgcccacataaaaaaaaccctttcccacccctttaaagggtgggaaaatataaaaaaggaggggcctttccatggggttccnaagccaagttccctaagggaaccccctaccccattaaaatcaggattttttccccaaaaaatatgagatagtatatcttttttaagtatcaatgaggatatacnttacttttcatagtcctgataaaataccaacaaaaactntgctatgtgcataagattatatagg

SEQ ID NO: 492243 - DNA, 152 bp, Homo sapiens
tagattatagataaaaggagatactacgactcactgtggatcctgaaattagacagaaggtcagaaactgctagggcactctttaccaatatatgtgcagatcccaactggctaaatttagcagcgcattatatatggtggtatagctggcg

SEQ ID NO: 492244 - DNA, 624 bp, Homo sapiens
aagtgcactaatgtatgtgtttgtcgcgcgtggacagaagacttactgatagtgtgcaataaatatatcctcttaggtaatgcagaagtcatggtgcagtatgagtatcgatacatataagagagggatataatgatagctgagacagttgattgatgggagtatggatagctcataagggttggttccaggccatgtgcaagtgggtcaagcttgatatccgccacagccaatggtggggagtattgcttggaaaccagtgatgttcaatgaccatgcctaaggcaacgaaacgtacagacaacacgattctccagcaagaaactttcaaacacattggctgggcgtacctgcgggccattgttgcccctgtgcgttgcgacgttcacttccagacaccgggcggcgaggcctcgagtcgcacgacgtgtggcacgcgctgcatcttgcagcctttcgaaatggacacccacttgttatctcccaatgcctggatgttagacaagagaacgagaacccgtgtcctcttttaacgacacaaacacaggtttgactctccaggtgctctggtacgcaaatcagcattaacacgaggcagtggggaatcattgcagcgggcaaaat

SEQ ID NO: 492245 - DNA, 954 bp, Homo sapiens
ggttgaacggctgtgggcgtcttgctgcctatggagtagggggttacacatcgctaacttgagaggaacgtctctgtgcgaagagataatgagtgatagctctggacaagttgagtcttgtagtggacaagaacaaagaggaaaaagagaatagaactgtctgaggaacagaaacaatgaaattgaaagatgcttttgaactatttgatacagtcaaagatacaatgactactatgatttatttgatgaattaaaggtggcaatgagaggcttggggttggatgtaaaaaaagctgaatgtatctgagatgattcttaaggagattatgacagagaagccgcagggtaaaatcacctctgaatgattttacatgaagttgtgatcaagatctggatatttggagagagagatccccatgaagatgatactcaaggtatttaaactatttgatgatgatgattcgggtagaataagctggatggaattggcgacgggttgctggagaatgggtgaaaacatgagtggtgaagaacttcgatgctgtgatagaagaattgactaaagatggtgatggaggaatttgatcagaggtgttcactttgctcattactgacctgggtgaacattttccaaggaatgcccccgattaggtcactaagcaattgtcgcagtgtggcagctaagattgtaattagtgcctgggtagccgggtgatagaaccgactgtaggtgctttagctacaggacccggaagtaagggatctcatagatctgggtcgactaggcaggtctcgttgactgggtggtgggaacaagaatgtaacgggttttacaaccctgattaggtacaacggggggaccgtctgaagcgcggcaataccctccggcgtccgcccaacttttaatacaacaaaaacggcgcaacaatgggcgacacaaccggccaccgcgca

SEQ ID NO: 492246 - DNA, 826 bp, Homo sapiens
  misc_feature (124)..(124): n is a, c, g, or t
  misc_feature (133)..(133): n is a, c, g, or t
  misc_feature (161)..(162): n is a, c, g, or t
  misc_feature (171)..(171): n is a, c, g, or t
  misc_feature (185)..(186): n is a, c, g, or t
  misc_feature (226)..(226): n is a, c, g, or t
  misc_feature (231)..(231): n is a, c, g, or t
  misc_feature (238)..(238): n is a, c, g, or t
agcgggagcgtctcgcaggccgtaggaggaagatggcggtggagtcgcgcgttacccaggaggaaattaagaaggagccagagaaaccgatcgaccgcgagaagacatgcccactgttgctacngggtcttcnaccaccaataacggccgccaccaccganntggacgagnttctcccggggaanntgtaccgtccagcgagttgcagatctacacttggatggangcacnttgaaanactgacagcttagtaaagagtctacccagaagctagatggaagggctctcacttcaagttttgcaatcgttttatacagactgttaaacagtacctggctatcgagttaaaggagattggcagcaccatgtctggcagtaagaggggacgtgactgattccatgaccctgcaggtcgcagaagttccagataggagattacttggacattagcaattacctcctccaaatcgggcaccacctccttcagggcgcatgagacctatattaaattcgtattgtactatttgttgaagtttattgtttccgtcagttgatgtcctaataaacatactcttcttcctcccctgattattgccattaaagcctttacgattctaaacaaattataagtgcatcagtctatttaggagttagatttggatgtgctattgtatgattacgaatagtctgtatgttgccaagcccttgctgtaaactatgaacgaaaagtgcgtcttaagcattctggtgttaaaactgtacctgttcacactactattgtggtgctactcgcaacatgaaggaaaaaaagattctcccagggctg

SEQ ID NO: 492247 - DNA, 198 bp, Homo sapiens
agaggtgtattatgcaccacagcattctgcacgcttagcattctgcaccacagtgcgatgctgcaggcgtaccaccaagtcttccctcttgtcattatctcttccaagaaacagtcatgttcctcctcttgagaaaatcaatgtccctggaggagatgatgcccaccaagcggttccccatccggctccggcgctcgg

SEQ ID NO: 492248 - DNA, 129 bp, Homo sapiens
gaggcacaccctatatacatatatacatatatacatatatacatatatatatatatatataagaaaatatatatgcgtacatatatatacccacatacaccaacaccaagacacaggtacgtttgttat

SEQ ID NO: 492249 - DNA, 377 bp, Homo sapiens
tctacaggatcttcaaacacgcaatctcaaccctctgctggtgatagggaaccagaatgatggccctcagcagtgaccaccccaacacaggaggcacgcagcaacaaggtccaccacctcctcaggcaaagcacaaggaccaccccaacagtgagggcatcccccatcctcctcaaggaaggccacaaggaccaccccatacaggtaggccatccccgtactcctcgagcaaggccacaaggaccaccccaacatggaggccatcagcaaggtcctccctcatctcctcctggaaaggcccagtgaccacctccccaaggggccgaccacaaggacctccacagaggcagtctcctcagtaatctaggattcaatga

SEQ ID NO: 492250 - DNA, 352 bp, Homo sapiens
  misc_feature (12)..(12): n is a, c, g, or t
  misc_feature (92)..(92): n is a, c, g, or t
  misc_feature (271)..(271): n is a, c, g, or t
  misc_feature (275)..(275): n is a, c, g, or t
  misc_feature (306)..(306): n is a, c, g, or t
acacagagccanagaagaatttccccaccacgccccagacagagagaaagccaaaacccagcccccgccacccgcccagccccccaaccccnaaaaccccccaacgcccccagcccaaaaaacgaccaaaagcacaaaaccaaaaaacaaagccaccaaaagcacacaaaagaaaagcacaagcaaacaaaacaacccccagcaaaaggaaacaagagggaacccccaccagaaccaaaaccccagcccccacccccccaaacgcaacccncccnagcaaccccaccccccagacaccaagaacanaaaacaaaacaaagcccacccacccgcccgccaaccaaaccagaca

SEQ ID NO: 492251 - DNA, 785 bp, Homo sapiens
ggtcatctgtaatccagaatcttcgagctgttggcagccctattgcttctgtgcctggatccactaatacgggtactgttccgggatcagagaaagacagtgactcgatggaaacagaagaaaagacaagcagtgcatttgtatggaaagacaccagaagccagtccagagcctagaggaccagacttctgaagaatgattaacatattttaagtggtgaaatgggtattgaggttacactctgctagttcttaatgacgaaacatataagtacgagacctcagtgatatctaaagaagacacacaatggatgctaggtacggaattctcgtatgtcgatactgcgaaccgttgataggcgaaacgtctttgtatgcacgtgtgaggacaaccatgtgacaccacgttctctctcacgagataagtttggatatggattagagcagcagccgataacgtgggcaaagatttactgcgtacagccagatttgggtgtaattcataacgggtcatgaacacacagaaagcattacagcttaatgggaacataccttcccaaggatacttctctcaggatcaggctatcaggaacggtggcggtctcgtatgcactagggtcttattcatgccaagtcatggatggtgatctaattgagtatctgcttaactcagggttaagaacgccaggaatgatatcgtcagagactggtggtagatctgggccttggtttggacaccccatgggaactgcacgtgacgatgtgatgatagtgtgaaaacaaact

SEQ ID NO: 492252 - DNA, 400 bp, Homo sapiens
agaacggtgccggcgtttatcaaagtttagggaaacctccaggaaacggttataatggcaaaaaagcccaggttcaattacttaaaggcacggggcaaaagggagtcaacccgggggttccgggttgaagttgaagtaaagtttgaggggaaattattaaaatctgcaaaaaatttggccaggttaaaaaaggagggttatttgaggttccagcaggggccaagggttgaaattgagggaataaacttgttgcaaaccaaagccattttaaattacattgccagcaaatccaacctttatgggaaagccttaaaggaaagagccctgatggatatgattttagaaggtttagcaaatttgggggaaaggatcctccttttgcccgaatgtccacctgagg

SEQ ID NO: 492253 - DNA, 379 bp, Homo sapiens
agtatttctgggacagacccagtttcactattggacaccagttattagaaaggaatcctttggttcaataactcagaagttttaagtttgttaagccatctgtcggaagagtcattttcagtattactgattcctgtgctattgtgttaagatttgcctgtgctttcaacatacatattacatgatttcctttggaatgtatttgattaataaggaagttaaagcaatgttttcacctcaatgtagaaatacagtggttttgatttttttcttcttagtgctgccaaaataaaatactcatttttgcataaaattccctaatcattttgcagaatcttctatttgtatcaataaaggcattctaggagttttgagaaaa

SEQ ID NO: 492254 - DNA, 643 bp, Homo sapiens
tccaccatggccagacgcccccggaacagcagtggcctggcacttcgtcctgagtgcatgccctgccgagacgcagatgcccggtgcctgtggctctagcagtgctccactaactggtgtgctacagactcatgattgggcatgcacatgcgactctggactccgacccctgagtactccacgctgccgccatccatccccatgtgctggtgccctgtgacctggctgagtccttctgtgacttgtgcttggtgcatgagctgatggcctccttctgtagcagcctgcactctggcccaccggggcagtgtgactgcctgcttgcgtgagcatgaagactgagtatttctgactgggtctgggatgacttaaataagtcatcacgccaccctgctgatgctgtgacaaccgtaaggtcatgcttccacatggatgtacatgctgctgtgcacatgctggccatcctggttgcaccaagtgagctggtgggatgggccagcacttctgtggagatcaagatgacctctcccgtctacgtgcaccgacatgatggtgggcatcgggacgtcggatgtggacctggacaaatacctgccacacgttctgcagcctgctgtgcagggatgaggacagctggggcctc

SEQ ID NO: 492255 - DNA, 127 bp, Homo sapiens
aggtaacaaacgcatatcgccgccgattcgacttggtagaaatcatcggctaatttcgttccaaacaaagcggatctacaacagatggaatccaatatttttccattgctggctctttgtaatgggt

SEQ ID NO: 492256 - DNA, 133 bp, Homo sapiens
  misc_feature (4)..(4): n is a, c, g, or t
ccgntggatactaatgatcatgtaaacacaagacagttcaagtataaaataggggatggcacaatggtacccaaaatggggtagagaaaaaagttataatttagtggttgctatggaaacttctaaaactagg

SEQ ID NO: 492257 - DNA, 111 bp, Homo sapiens
gatacttgctatctctcctgtaatctcttccagatcaggatatttgcctgtcaccattccaccaaaatcctttagctcactgttgtcgaaactacagatcaactcttaatc

SEQ ID NO: 492258 - DNA, 905 bp, Homo sapiens
cttttccagtgtacctggagctagtttgtaagcaggtttgtattgacttctgctccgtgtcaacagctaggcgaggtctcgaaacgtcggcacagaaacaatgccctctgattcagtgacctctgctatagctagtaacatgtataatcatgaagctacctggacattctatcctgaaccaagactttacaatatggtggccagtatgctttcgcttcatcctagaagtattatctcaatgcatcttcaaagatacgtgaagtacgtctttgcccagatgggacataaagcaaccagcagaacagatatacttttctctcaagatgtcgtcgtccagcaaaacttttacccagtgtccaaggccttgggctatcctcattcagtttccagacgatatatgagtcaagaacgacaggtgcgtagtcagtagcagtcgcccactgcaggctgttagacacattgacagcgtgacatgccaagacacttctaggcccagagccctacaaagcaagccatccactatagccttaacttgacagccccacaagaacagggcattcatggtgtagactctgggcaggaagtaattcaccgtatagatggcatccaccagctgttcatgctgatgacaacaacgcttatagtggcccttatttaggctcttactcagattgggcttcatggacgacaagatacctagtcgttacctaggggatgggggatccaagaatggggggctaagtgagccacaaccgcagaactggtctagtcccgacgaagcccaagagcatagtcttacaatgaagcatcagccagtatgcaagtaccaagtataggcatttacactggtatggccttccttatttctgaaacacgtagagagaaagccgagttacaggtatatt

SEQ ID NO: 492259 - DNA, 134 bp, Homo sapiens
atccaaacagatcccttggcttacgaattgggaacatttccagaacttaatccatgagcatgggatatggaaaagaaaacctgaaacaaaaccagacccagccctacacttgggttggtcatggtgtcagcgca

SEQ ID NO: 492260 - DNA, 325 bp, Homo sapiens
ccatgtggttcatgcctgtatccaagcactgtgggaggcaaggcgggcagatcacctgaggtcaggcgttcgagaccagcctggccaacatggtgaacacccatctctactaaaaatgcaaaaattagctgggcgtggtggcttgtgcctgtaacccaaactactcaggaggctgaggcaggggaatcgcttgaaccagggaggcagaggttgcagtgagccaagatcatgtcactgcactccagccttaaccaaaatcacccagcagtgccccaaaataatatgaagctattctaaactgaagccttcacagacaatttcctgg

SEQ ID NO: 492261 - DNA, 749 bp, Homo sapiens
  misc_feature (391)..(391): n is a, c, g, or t
ttctgtctccttgttcatctgtcattcctgccactccccaaaagccagagccatggacgtctctcaggttatgactcatgtctttgccttactgtctctttagcctggcagagacatttatgcccccagtaccagattacgagctccagttatgagcctcagccccttgatgcgtacacacgggattcttcgccgtctcgaggcccccctgtctccatgtgttgagtcgattgcgtccgcccagggacgttccaaggagacactcacgtcgtgcaaggttgagcgaagcggagcacatgtattgccgcctcccgtgtggtgaacatcgttcctaggcccgtcgcttggcgtgcaggcgtcagtgcgtacgcatgtggtgcctctattcgcntccaaaggcgtattgttgcgtgtgaagggcgcagacatcgtgtggcgcgaggtaaccaagagttgtcgctttaacattggctagtaggacaatgcggcaggagcttgctgcgtatgcatacgccacgaaccgtctggcattgtgacatcgcgtgacacagttgttggacttgtgatgtccacttgaggcgacctagtcgcttcatgcgcgacatggccattgcagacacggagcatgctttgaccccctcctgggccttttgcatcgcctgcttcttgttattcagccacggccttacatggacaccctgtccggaacctgacgacagaatggaaggaggatacgggcagctggcccc

SEQ ID NO: 492262 - DNA, 713 bp, Homo sapiens
  misc_feature (208)..(208): n is a, c, g, or t
  misc_feature (632)..(632): n is a, c, g, or t
gtgggtggggcagcctgggcattttataccggctcccccaccttggggggggggtgaaggccccgggtcaaacccaaacccgggccggatcctttttgtgaggctggggccattacggcatcatcatggcaatggtctttacaacatgggtgagcctttcagtgccacagacccaaaggccatcggccatcggaacttccatgcaggntactccatggttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagataatatgtgtgggtggggccgtgcctcacttttatttattgctggttttcctgggacagctggaactgtgtcccttagcctttcaaaggcttggtgttcagggccctccctgccctcccctcttgttgggtgttgatttggaggccctgcagtccaggccgagtccccagtgcggggagcaggctgctgctgctgactctgggcagntgggcccctgggtccccccccccccccccccacccctcttcctagggtttgtgaaataaacttgggatttgtctggggcca

SEQ ID NO: 492263 - DNA, 306 bp, Homo sapiens
aaaacccccccccttttttttaaggagaatgggcccgtccttttcccaggccccccagggggggggatagccttgcttttgggttaaatatgtaaagcaaaattttttttatttttgccctaaaaccttttttttttggttttttttgaaagaagggcctttggggcccccccttccccttttttgttcccccactttagatggattaagggttttgggttccccgggggggggggggggcagccaggggtttcctggtcccttactttgggcccgtttaattaaaggggccccctttaaaattga

SEQ ID NO: 492264 - DNA, 799 bp, Homo sapiens
ggcatgatgatggcttgtgtccacgaggcgatggttgcatagagccaagattgtgccattgcatctccaaacctgggtcgactgagcgagattccgtttcaaacaaaaaacaaaaaaaaagattcacttaatctatgtatgaagtatatcagtaaccgctgagtatgtgagaggtgggtgaacttacagtgtgtaaaatgcaggtgggggtcagggcaagtagccaattaggggtattttctcgtctgtccactccagtgaaataaagttctgtatttcagttgcatcggccgaggattaagtgctatctaattacatgtgattgtttcttgacacattggtcattgcaggggagtgtcttcaacatgtggcgtgatatgggctgtaaagattcgggcgtcaggttagaagagtaaaatgtcgttagtgctgcaacttttctaccctgtaggttatacatttatagtagtctcctctttagaaacattgtgatatgtctaaataggcatgtgaaagggtgactaatcaggctggcaatacatatccgaggtatctaatcatggccgggtgggcgacctccaactatgtggatcataactctatgaatactgtttgtcattcaccttacatgattaagcagggtcttgtcttcaaaagagtgacaagaattctggatcacagatgtcatattctttgggaaagtttctcccctcatactaaggtggagtgtgcgtgtgtgaacgcggttcacaacggtggcattttaaatgaccgttgcaatataggtagtaactacggg

SEQ ID NO: 492265 - DNA, 1238 bp, Homo sapiens
gagaagcacccagaatatgctgagcagaacatcagaaaaagcacgacgaagaaaaggcgacatccaagacaggcaccaggtctcagcatgcaacagcagcagggtacagacttaaacgggcacatgagaaggatggtacgctgcacggaacaagtggcgcttggggccattgcaatcacgcggagtagccaagacctaagtcaagtccctccaggaacagggcaagacacacaacgacagaggtggcaccactgaacgaggagaagactgggggtcttgcgaggacaggacggacaaacggcaacggaggctgcaggcacacgtcaggacaagaggaggctagacgacgcagggcctatgctgacccatgacagcccgaacgaaagacagagcgcagacaaccaggagcgaggaggacttgacacctagaacgatagaggtgaggaacaccgtcacaggtggatggaaccagggaagcagcagagccacagcatgcacgccgcaaggcaagacgcacggaaacagccacagcacgccacaacaacgacgcaatcaaagcacgacggcggaacatcataggacgccacgcacgcacacggcacaccgcggccacagcacagcacacgaagcacacagcacaaaactgagatccaagacagcaaaggtaagaacgaacaggcacaaacaccgcacaagaacgcacgcagccagaagtcaacaagaccaccacaaggccaacaagaaaccgaagacgaagaaataaaagaacaaggacaacaggagagaaaaacaaccgacaggaactacaggaagcatgaagaccaaaaagaaccggaggaaggaaacgaaagaaacgaccatacgaaaacaacataaagaaagcacaccctaccatcacggaaacctgacctccgacaatatagacagaaacaaggaacagacgagacacaaaaagcaataaacagcaggggagagaccgcatacgcaccaaagacaggacaggaagaggggcgtaaacagcaccagacggcaacgagccgacccaaaaacacaaacaaacaaaaacatccaacaaacataaccacaacacaccaaatacaaaacaaaaatacaaaacacacaccccacaacaccccacaacatcaccaacctgtcaacaccaaaaacaaacctatacaccctccaaacaactcccaacaccccaccacaacaccaaaacacaacaaaaccaacacaca

SEQ ID NO: 492266 - DNA, 590 bp, Homo sapiens
atttaatttttacgtggttagatatggggagtagtgtgattgaggtggagtagattaggcgtaggtagaagtagaggttaaggagggtgatgggggctatgatggtggggatgatgaggctatggtttttggtgaattcttcgataatggcccattggggcaaaaagccggtatagcgggggcaggccctcctagggagaaggaggggttggatggaattaaggggtgtatagttcagtgttagctgtgtttcagggtgcgagaatagtagtagggctcggtgggtgcatgagagttaaagttgagtagtaggaatgcggtagtagttaggataatataaatgtgttcaattaagaagggtcatgtcagggttgtacggtagaacttgctattattcatcctatgggggtaattgaggacgtatcgcctaagaatttgcataacgagggtaggaaaatccacctcaaagggcctggctatgagggacaagcattgcacaacttggcgaaaagctacgcgaagggaggaaaacacggaacacatgcaaagggggcacttggcccttgaaaaacagccgatcaaaggcccga

SEQ ID NO: 492267 - DNA, 552 bp, Homo sapiens
  misc_feature (1)..(1): n is a, c, g, or t
  misc_feature (79)..(79): n is a, c, g, or t
  misc_feature (131)..(131): n is a, c, g, or t
  misc_feature (137)..(137): n is a, c, g, or t
  misc_feature (191)..(191): n is a, c, g, or t
  misc_feature (195)..(195): n is a, c, g, or t
  misc_feature (201)..(201): n is a, c, g, or t
  misc_feature (240)..(240): n is a, c, g, or t
  misc_feature (279)..(279): n is a, c, g, or t
  misc_feature (309)..(309): n is a, c, g, or t
  misc_feature (407)..(407): n is a, c, g, or t
  misc_feature (433)..(433): n is a, c, g, or t
  misc_feature (502)..(502): n is a, c, g, or t
  misc_feature (539)..(539): n is a, c, g, or t
natgtagttgatcttctatggccaggagaggcactggggaggggtcacaggatgctacttgggcacctagaagccacanctgctctccacagatctggcacttcaccatgcgcaggaatgtattgaccttnttcatnttcttcctgaagcagtagatcagctcgtagttcttgagcagttcgtaatggttnttcnattttnttttaaacttgctgtaggtcttctttatgatcttcccanttcggcggctgctgttttccagcctggatttctgttgcnttttctccatgttggagggtgttggaatanagttttataagcagaaggaggtctgggagttatgcaggaattaatacttcttgtcctttgggatataggtttcttcaaactcctggtaggtgttaatngccagctggtgcgcgctatgggcttngagcatagcgtggtcaaaaagcctggataacggaacggtttggacggcaccagcctcttgaagccaggncaggcagagcagggcaaaagccaggagcagggacgtncgggagcctggag

SEQ ID NO: 492268 - DNA, 426 bp, Homo sapiens
  misc_feature (4)..(4): n is a, c, g, or t
gcgngcttccggagctctttgaaacaagcaaaaaacttctggaggacgtggaagtagcaactgaacccaccggctcccgaacaatccaggataaggtgtccaaaggactagaactccttgagaaggctgctggaatgttatcgcagcttgatttgttcagccgaaatgaagatctggaagagattgcttccaccgacctgaagtacctgatggtgccagcgttgcaaggagccctcaccatgaaacaagtcaaccccagcaaagcgtctagatcatttgcagcgggctcgagaacacttccgtacatttcttaactcagtgtcattgctatcatgttggcagagtttcagctaccccaaaccaagactaacttcagcttgaaaataatacttgctagctcctccatgggcctatcccaaatctcgg

SEQ ID NO: 492269 - DNA, 304 bp, Homo sapiens
ccttgtcttagaaccacgctggagaagaaaggtggcaaggagtatagtggaagctagtcctggcaactccgcgcacaaagaacgggcccttggaagtagctggaggtgaggtgggaacgccaccgtgcttatctggttgtgacacatgccgtattaggaacagccattttgtgagagggcttagaattcagcaggtgtgtggcagcacagccgcatcttcaacatggaggccacggacagccctgtagctttcacatctatagagtatcaccaccatgcaggtagtctgggaaaatcacctttg

SEQ ID NO: 492270 - DNA, 198 bp, Homo sapiens
  misc_feature (130)..(130): n is a, c, g, or t
  misc_feature (168)..(169): n is a, c, g, or t
tgaggaattgcatacaactggcattacaaagttaatatggtaattatggtctgtggtaaaattgagtttcagaataaaattaggaacagtaaaatcctaagaactatgtaacacaaaaaagctttggttnttgcttacaagagtatatttacaggattattcgtgctnngaagattcagtttctctatctcttgggag

SEQ ID NO: 492271 - DNA, 1047 bp, Homo sapiens
gggcgaaatgagactgtacgtgagtgatgagcgtcccgggttgcttgtctgtgttgctaggctgcggcggagagagcccggggtgagagcaggagtggtgctcatcaggcactgtaggcccggaagatgtgtggtccacgttcctgagccgggctaaggtccctgtcttgcagttggataggcggcaagctacctcttctccactagtgcgaattctagccagagtattattttatattccgtgtatcatggctggcgagcaaaatgactcgtcactacaccagtggctggaatcggagaaagcgacagcaagctgaagccccaacattatgtcttagctagccctgtacatatattgagttggtccaaggccataaaggcggccgaagcatctacttggttccgtgcaggtcgagcccgtgattcactcttagatcaaagacttggaggtctgatcaagagaatgtccattgtccgtggttgggggagactccgaattcgtctaggcctgacgatggtttgtagggggagcgcctatacccgatgactggaaagatccctgcctacctccctgagagagcgagagtgccctgacaacagctggttccatgacaagcatgaggtacccgaggaatgcatgtcacgtgagcttgagagattgtctttgaaaacagtaacggtgtgctggttctcccgtggctttacctccaagaatgaggccgcagccaaggcgcggctgagtgaagtgggttggtaaccgaaatgagccttgaagatggaagagacgtgtgtaccttaatctgggggaggggaattgcaatgagctggcacagctgggaagaaacgggcctaacaagttggggccccgatgtgggccaagagacaaccgcgtttcctagttgctgacacaggagttctcaacacaggggctctcttgtttcaaagtgccgcccttgacctcccgccggttcctctcacttatacgagactgccgcatgaaccccattggtgcatagctcccacgcctctgcatccacctaatcactc

SEQ ID NO: 492272 - DNA, 143 bp, Homo sapiens
tgaggatcccactgcggggcgacagcctgatcagccaatgccgcgtgtgtgcaagcaaggcttcgggttgtaaagccattttgtccggaaagaaatggctctggttaatacctggggtcgatgacggtaccggaagaatcagg

SEQ ID NO: 492273 - DNA, 1162 bp, Homo sapiens
ggaacagaaagatagcgaatgagacaaagacagaagagaaaagcaaagaaaatgtagtagatgtataggcctaggcgatggctggctcatgcctataatccgtagcactttgtggagggccaaggccaggcggtctcccgttggagctcaggagcttgcgagaccagcccgggcaacatgcgcaaaaccagtgtctcaaataaaagaagatagaaatgacccgccagcgaacttgggtcggttgctcgacaagcagaagggataggagtacaaggtgccctggtggtgcagatctgagtctccatcgtgacctgagccccatccccggggcacccccacggggactcaattgcacgtcgcgttcccccgcccttgatgaccctcgtcttccaagggtccgacgtgcccgctgcaccccactcggttgccccgctgccagttaagtccagaatccccggtagaccgggcccaagacgtcacaccaagggtttacaaacggcgcaatcggcgatacggcttattcggggagaacttaccgaactgggcccacagctcggagtcactgcggccgtttcacaaggtggcttccaactggaagaggttggcggcaaccccggacaactcaccgattgcatgcgccgacttccaatcatccctggggtccaaaaacttccatcccaattcagataccgccgttgctcgacacgaagggcccaacatcggggcgcgaaccccacagactccgggaacgccccccaaatcgtggtccccattaggcaacgggtggaacacgagcgcgactggcaaccactctagtcgccctggcccacggccctgcaatcccgctgaccagccccaagacaaacaacctggcgcattcgtcctcccggccacacttggtcgccctacctaaacgctcagcctacacttcaatgaggccgcaatctccaaccagaccctgcctaacactcgtccatgccccgagaggtccgcatctcggacaacgtccctgatggccaagcttccggccaacaagggccaacactttgtgactggcccatctagctaaaggacccttacaagcctacgcccgtaaccccccggaaccctgcgtcggaacggagcaacgtggaatcgcccccaaggacgttccccacatcga

SEQ ID NO: 492274 - DNA, 444 bp, Homo sapiens
  misc_feature (237)..(237): n is a, c, g, or t
  misc_feature (320)..(320): n is a, c, g, or t
  misc_feature (323)..(323): n is a, c, g, or t
ggcgcgtctggtattacagctggacacggtggctgatgctataatctcagcactttcggaggctgaggcaggcagatcacctgaggtcaggagtttaagaccagcctggccaacatggcaagaccctgtctctactaaaaatacaaaaattagccgggcatggtggtgggcacctgtaatcccagctccttgggaggctgaggtaggagaatcgcttgaacccgggaggtggaggtngtggtgagctgaggtcgtgccactgcactccagactgggtgacagagtgagactctgtctcaaaaaaaaagaaaaattaaatnctngtctaggtaaggcattcgctgcttcggattggaaagataacaaagcatgtacagtgaaaagtctccttcatatcccttccaccagacagttctcccgctcagtagaccgctgtgaaacttt

SEQ ID NO: 492275 - DNA, 1264 bp, Homo sapiens
ggttccggccgagaggagatctgtttcatactggggaccttcggacctggccagggcacgaggaccgagcctgtatttgacgagcgtggagcgcgtgcagtgctgtcagcctagcaggaagccaggtgtccccgatgcctggagtgtgaaagtcacgctcagggcaggattactttgtagcacaggaggtcgcaaccacgagtgaactctgggacgtcgtggcgtatggcgagctctcttggcgctagtcgtggtgttacatgcagtggtcagccccgacgtggccctgcgtgtgattgcagcatgcatgtgacatagttaacaccaaggacaacgacattccggacacgggacaggtggatccgtctttctcgacgcgagacgttcagaactcaacaaacacttggtatggcttcgttagagaagcgacatccgccatcaccctcggcagggaccgtggtcgacgaaaaaactacggtcgtcagtcgtgggagcgtaaccatggtggacagggcaggggtacgtagggacttgctcccctggatttatctttgggcggcggccctctggaacgcgaaacttaccacaggaggtccagtacggttgtggcccatctctaactcattgccccccatgacactaaaacaaggtcagttatggaagccttgcgaaaagcgcgtcgaaggccctggacctcagaatccattctctaccagggccacacaaactggcgagaatcgagctgccctttggacccccttcgtgtgagtagttgtatccacaggcaaacgagaggtggagccttcgtatgaggacacccatggttgcctaagaggtaatcaaaaaggttgcttcccgtatcctggggcagaacgtggacacggggggttgggtcccagcgctggaatagaggcgggctagggttccatgtgcgcccccagtgtctagccctacggcaatagtcgatgggagcgaccatgcctttgtttggaatcttgtgaagctgaaaggaagagatcctgaccgttgggatgatggaggccaggccaatgagacgggccccatggggaaaggccatgggagccatggtgcccgacacggccctcaggcgatgtcgccaaagaaacaacaagggccccgcaggacagcaaccgggggcccaataattgcatccgtggcagggcccaagaacgccactcaatgagagggtggccaatgaatagacgggacatcacaccacggcggtgggcataaataggccccg

SEQ ID NO: 492276 - DNA, 257 bp, Homo sapiens
ctactcaacgtatgcctgggaccacaagtgctgccctgcacaacttacccagctaattctttatattttgggtacagacagtgtttcaccatcttgggcaggctgatctcgaactctctgacctagagtgatctgcttgcctcagcttcccaaagtgctgggattacagccgttagccacctcgcctggcttttttgcataatttgtagtgcatatactctgcaattagagatttattctggggctccgggctcgtc

SEQ ID NO: 492277 - DNA, 261 bp, Homo sapiens
atctgggttccccacgtgtcctcatagacccaaaataggaagaggcgagtgagctacccacacagatgccatctgctcaactggtctttctgtgtatgacgaagccgctctcattctcatagtgacagctcagaggagatagtagtcatgttctgtaatttgtgaatcctgtgagacaccattttcctagctacagatgaggaaactgaggcccatagaggttaagaaatttgctggaagtcacataccgtgatccaaggt

SEQ ID NO: 492278 - DNA, 924 bp, Homo sapiens
  misc_feature (419)..(419): n is a, c, g, or t
ggtgcagtgggggggccgggggccctggtggccctgggatggggaatcgaggtggcttccgcggcatggtttcaggctagctggcatccggtgggccgggagttcagcgagtgcgtgagacggcggccggggccgagagtcgacggagcttcgcggaggtacatgccgaggtattaaggaggtggtatgcccgatacaccaagatgtgggcctcggcttggtcctgaggaccatgaagaaatgcaacgcatcctctggtgagtgaagatctagttcgtacttgctaccgctgactgcagtgtacgagaatgcatgagattcgatgtgactgttgcattcctggtgggggccatctactgctaaggtagtggagagctctaagcagattactgtgagtgcccgagtgcgaatagaatcangacgcccgttgtcgcgggctcgaacgacaaggcgagggtatcgaatggaccaatatttggtgttgccatatacgtgcggtacgtacaacatgcgaccaacgctccggctcctcgggatgttcaacgagtgctacgcactggcagggtagggccggagccgtgctattccgtgggggtgcatctatctcgtggcgctaatgcgtcttcccattctggttcgcccagtggctggccagaggcgctaacatggcgtgagacactacaagatgcggctagaggcctcccaacacatgatcgcactttgatcaaggattgagcgaggccggcttgcggtctcttgatgcgtacgggacagcgctcaatccccctgacaacccgagggtgccaaattggggtaatttgatcttcagtctagccttgatgacgctaatagaaagccttgctgcatttgatggcttggcttattctgaattgacgttgctagaaccatttagaacctgtgggc

SEQ ID NO: 492279 - DNA, 378 bp, Homo sapiens
  misc_feature (16)..(16): n is a, c, g, or t
  misc_feature (20)..(20): n is a, c, g, or t
  misc_feature (22)..(22): n is a, c, g, or t
  misc_feature (33)..(34): n is a, c, g, or t
  misc_feature (41)..(41): n is a, c, g, or t
  misc_feature (44)..(44): n is a, c, g, or t
  misc_feature (80)..(80): n is a, c, g, or t
  misc_feature (100)..(100): n is a, c, g, or t
  misc_feature (107)..(107): n is a, c, g, or t
  misc_feature (165)..(165): n is a, c, g, or t
gaggaagatgtcacgnggantntccttgtgctnnctggctnganatctttatggtggtcactagcgttccatcagttgtntcaaccaaggaggtcttggnaggaacngaaatagagcttgcccatgtttctggagaactctttcttctggctgtgggttctgtgngagaagagacaggtaacaaggatgttggggtctcagatggtgtgaaggttaacgtctgtgtttcagctgttgttccctcttcttctgcaatggtctggcttgaggttaactcaggaggctcctcctgggacatatttagagtggatgttggagaaagtgtcagagctgaagtctgaagatgcaccaatatgttgggctgccttgccatggaag

SEQ ID NO: 492280 - DNA, 1216 bp, Homo sapiens
cgagttacaggctcgtgctaagctagcgcagtacgtcgatactacccttcagtcgccatcatgattatctaccgggaacctcatcagaacacgatgagatgttctccgacatctacaagatccgggagcatcgctggacgaggttgtgcctggaggtggatggggacgatggtcagtagagacagaagcgtaccattagatgactcagcttcattggtgcgacatgcctccgctgaaggacccgatcggcgaaatgtatccgagtagcacacgtaaatcactgtgtgctcacatatacgtccatgaaccaatcacctgcaggcaccacctgttctcaccactacacgatagccttccaagcacgctacattctacgacgactatacacttgacaaactcaactccacacggtcaacaccttctgcacaccaccacgcacgacgaacccacgcaacacgaccgctaaccaaccgtacatactagacacagagggagacctgacaaacaacacaatccaaggcaccacatccctacgccctacctattacagacacacgactaaccccacgttcatacacactcagggatcgacacacgagatgacattcccaacgactgcgaccactcggaatcggcctcccactatcggtaccctacacggagcaaacactgagattagctgcaccgccagataatttttactctcctacccatataagcgggcactgtgctactctagcaaaccactggcacaccccgactgtaacaaccacaacctgaatggcccacctcgcattacacggacgtaatcgatatgcaaccttgtttgaatccataatcctcgagccctcctaggcttccgattctcagccaagaacccaacacctcaatggtcgttacaccaaccacagctgtgaaaccggatgctgactcactgggagcgctcttcaacatacaaattcaggagcagtgtcataaaaactaggaccgtgatacccatctgttccagcgacaagtccacatacgcggaacgaagttatcacaattaacacggcgcggcacatatatcgcatcagtagcagctatctcgtcctatcaaacacacattagaatcatatagcagtcgaaaactagttaaccgtcgaaaagacaaagatagataaactctcatctaacatatacacaacaagacataaccagccatacctgtcccgct

SEQ ID NO: 492281 - DNA, 1005 bp, Homo sapiens
tcgcagacaaggtatgtagattggctctcaatgtaatcaatgtaggatgaatgtgtttggatcagtataccatgttaccggttactccagtggggtgtgtgggagataatcaaggcgcatactggcaattccaatcgctacgggaacgaagtgtcggcggtcagtgagtctggaagcgtcatataacaccgtctggggaatgcccattcgcaacgtgtatatctgcacacaagatggtggccgcatgacacgtcccggagtgtgatgccactgttacagatatctcatcgatatatctcccaggagagcagttgactgaaacatagcaattcttgcacgatacttgtaagtatctgctgtggagtattgccaaatctgagtcactaggcgagatatgatcaaaggaatggtcgttagcatgtctatttgaatagtcgcgggtaagtacaattatgcaggtttcactgaatacctgttaacctgggccgaagcatccctcacagtggtggtgtgggcagatcgttggcgtatttttgatagggagtcgagacgaaagagcggggtattatcactccagttcctggaggtgtaaggtccctatgacagtggcaagtgctaaatgaagggaattaccattaatgtgctggcgaaatactaggtgcttgaggggttgcaatgagcgaggacagtgcttgacgcgtctaaagaggcttggggtaggcagtaccttaagtgactcgtgtccttcttgtgtgcacgatacgggcaggtctaggtccaggctcccgggaagcgtcagccggccctttttggaattggcctatttttggttctttgctactggcatggttcaaaatgggggcgcggttgttggaaggcctcactggtggggggtgccggccctaaccttttgggtcctccacccggggctccacgttctacagggctgtggttatccgggccgcctcctcattgtctttggggccccccccgggcgggcgctct

SEQ ID NO: 492282 - DNA, 312 bp, Homo sapiens
agataaagatgatcatccccaatgagacaaaaactccaggtgccatggagcatgagcttgtcctccaccagctagaggtgtaacggtgtgctgaaaggcatccgcatctgtaaggaaaggattccaagcagaatcctttatgccgacttcaaacagagatacaaggtattaaatgcaagtgcaatccctgaagggcaatacatagataagcaagaaggcctactgagaagctccttgcatccatcgacattgaacacacccagtataaatttgggcacaccaaggtcttttacacagctaggtcttctgggg

SEQ ID NO: 492283 - DNA, 894 bp, Homo sapiens
ggacgcgtgggggggctccaggctgttgagagcccgcctgcatgtcaggaccagatttttcccagccatccagcatgctgctgcggcagaaggtggtcagcaggctcacctccctcctggggcctttgtttgtgatcctggggatggtgagaatggaggttctagcaaggggtaagtgcagataccagggatccagttagtcggctctcagctggagcttctctataccttctgggctccctttgctgacctacactagtccaagggagcctacgacgcaggagggggctgggctgcgtgtcccttctctttcccagtgagctcctgcctaggggggctgtgggcctacaaggcttcctggggatgcaatccaggcctgttggaaaccagataggatggggaatgtggctcctaggggggctgacgtcttccttcctctctccgtcccctagtaccatcacttattgctttctctccttctatctccagtggccccacaatctgttttacttgtttattatcctatgggggcctgagccagggattgagggagcccaggggacggggcatggagtccccagtcaccaatcggttcgggtacgtgtgcttgtgtgtgtgtggagatcctcctgggggatgtggatggggccaggctcaggcgtacgtaggccgtctcttgttgctgaggccccgagggttcccggctcctttacccactctcttccctgtggcgtggtctggttgctcattggtaaaccccactccgtggttttgtttccctggcttttggttgccggcagtttgggtacccggtcaacttgtcgcttgtgtcacagatctgtctggctgccaacaagaggagggggggcgaaattccctgggggccgttgtttc

SEQ ID NO: 492284 - DNA, 318 bp, Homo sapiens
gggccaaggagtcatgatggcaggagtatcaaaggtgtcttgtgtaagtgataagggtgagaggaactcagaagaaggcttaacaccatatattatattcacaagtttatttatgtaattttgagtccaacagaaagagtcacagggggtaaacactttagcaacgcccgtacgattttaggtctgtatgtcgtaggcagatagagctatgttataattatgcctcatagggctagtccaaggaaggggtaggctatgtgtatagtcagggggttgagaatgagtgtgaggcgtataatcccatcgccgcctagtttt

SEQ ID NO: 492285 - DNA, 281 bp, Homo sapiens
ggggttttcccattttattattttattttggtttttttcccaatacgggaaattcccaatttggggccttttgatccgtttttgggaaaccccgggtttttcgcctgaaaattccccttttttctttttgttttttagctaaaaaagggggcggtttaatccaatggttgatcccctgcccaaattttttcctgaatggtttttggaaaaggatttttgaattttccattgggatttttttttgaaaatgccccgggtggaataaaaagggggccccccta

SEQ ID NO: 492286 - DNA, 888 bp, Homo sapiens
gctggcgcgacatgtggcgcctcccgtgagtcctgggccgaagctcttccccgtacacctgggacctatgcctctgtgctgggtgatcatcctaatgtccatcatgcccagagtggggctcagactaggctacctccactattggctggtacctgctgcctaaacctctgacaggtcagggtcccctatggccgcaggcacgatgtcggtggtccctgggtcccatgagatgtgaaaggatgcctatccaattggatgtcgttcccgtgtcgtccccgaatcacccgtatggagatgccataatcttgtggtgcactactagggcgtgctgaccctgcagctggcaaggcagatccactatccaggcatccctgccagcaggacctcagcgggtagaacatgctcctggcacagtcccctgaaccgtttcttctcatctcccttgtaggcacccatgacacctcactgcctgacaaacgacagtcctccccagaccctgatggcccagctcccaggcacacttggcctcagggaaacccagtgcttggcacggaaaggaagcctcagctcagcaccccggaactacgacacagcaactctttgagaggagcacgtcctcaggacccctcttgaaggaagtgtccccggtgaatacaggcttccttgaattgccacggtagtacgacataacgaagtcccgaggcaaaaacagacacaaggccacaagccactggttgaagaagtcacacagataaattcccaaaaatcttacctttgaggaaggttggcattcatacaaccacgtcgtccagatcagagttccatcacacttcaaatccaggaacaaaaaacataataatagggaacaccagagcatttacttccgaa

SEQ ID NO: 492287 - DNA, 168 bp, Homo sapiens
tagcagaccagatctgatactggggaaggagagaggtcagtgacctcgagatgagtgatagaatggaacagactctgtgaggcctactcaggcactgtatggtgagcagcacccccctctgtgtgccccagcccccacagtagccgggactacagctatgcacaacca

SEQ ID NO: 492288 - DNA, 676 bp, Homo sapiens
  misc_feature (495)..(495): n is a, c, g, or t
  misc_feature (505)..(505): n is a, c, g, or t
aaatttatgaaagtagctacactggtcaggcatggttgctcacgcctgtaagttcagcactttgggaggctgaggcgggtggatcacctgaggtcaggagttcgagaacagcctggctaacatggtgaaacccaatctctactaaaaatacaaaattagctgggtgtggtggcgcaggcctgtaatcccagctattcaggaggctgaggcaggagaatggcttaccaaggagacagaagttgcagtgaacggggattgtgccattgcactccagcctgtgcaacaagagtgaaactccatctcaaaaaaataaaaataagaaaaaagaaagcagccaaaccaaacaacagattttcaataaagacaacatagacttctattgtaagaagatataatctaggactttcatagctatagagaagtcagtcaatgcctggcttcaaagcttaaaaggacaggctgattctcttgttagggactaatgcagacaatgantttaagaganaagccaatgtctttaccattccaaaaatcctagggcccttaagaaatatattaagtctatttagcctctctatgaatagaaaaaagcctagatgacagcacatctgttgaaagtatgggttacggaatattttgcccattgttgggacttactgtagaccctttctattcg

SEQ ID NO: 492289 - DNA, 880 bp, Homo sapiens
gggggtcacaggtgctcagtgggggagcttttccagccagcatgagccaagagaaggaatttcacaagataatgtcatcagttaaggcaggaacaggccattttcacttcttttgtgattcttcacttgcttcaggccatctgggcgtatatacgtgcaggtcacaggggatacggtggcttagcttgggctcagaggcctgacaaccacccctcccatcccaaagaccaccactccggacttctgtggtgaacacattcttgctttttgtcaggatttcaacacccacgtgtgggttaaaccaaacctaatcgagtgttggctaaacccaaacacgatgagttagagcttccaacatctaagttcttggacgtctgctgattagggttttctatggaggcctcattatgtagggacgattgcttaaatcattcccctaaggactgactcaatccagtccctctcccctccccacaggctgagggtggggccggcagttccagccctcaaatcgcctggcaaccagagcccctttccaaaggcctctcacagcgtaaacgcaggtgtggttgagaggagctctatctttactcctcatcgcctcggaatcacaaggatgttaggggctctgcagaaccgggaacgaaggccaagccggtttttcttactgtatcaccgtatccatttcccattccttgaaaaaatcttcaagtttacctttggtttccaaaagcatagcgagcaccgctgctttatggtctgggaattccagcacccggagttttgctgcctgtggctccgcttgtccctcgcctcactgtcttctctctccacggtgcctggtcatgcttcattgttcggacacggaagcgacttccag

SEQ ID NO: 492290 - DNA, 407 bp, Homo sapiens
tccgacttagaggatcccccgctacctggcatttcaagataaatgaatcccatgtaaggaccattttaaaaaaaaaataaaatgaaatttatgaagcgtttgttgcagctacaccagcaggtgtgaaaatcttgcacttttttgtgaaacacctttcatttcatattgaagatgcagcttttatgtgggtacaggattactataagaaaggcatccccatagactcgaatatgactgtctatgggaaaagtgaagttgttatatgacaacttaaagcaaaaggaaggtggaaggatataaagctggagaatgtattgccaaccaaggatggtttgataattttagaaagagatttggctttaaaatgtgaagacaaaatgtgaaggggaagctgtttctgccaacta

SEQ ID NO: 492291 - DNA, 155 bp, Homo sapiens
ggtgacagatctactgggtgcatgcattgtggctgaaagcaataagtggggttctgaggtttaacaccggggaggggagaatgcggtctatttggtagggtatgccaatttccaaaaaaaaagggggggggggggggaggaataaggggaggaaa

SEQ ID NO: 492292 - DNA, 339 bp, Homo sapiens
gttagtccttgctatattatgaattaactagaaataactttgcaggagagccaagctaagaacccccgaaaccagacgagctacctaggaccagctaaaaggagaacacccgtctatgaggcaaaatagtgggagatttataggtggaggcgcaaacctacgagcctggtgatagctggttgtcaaggtagaatcttagttcaactttaaatttgccacagaaccctctaaatcccttgtaatttaactgttagtcaaggggacagctctttggcactaggaaaatccttgtgggggggtaaaaatttacaccatggtaggctaaagaagcaccattag

SEQ ID NO: 492293 - DNA, 478 bp, Homo sapiens
  misc_feature (72)..(72): n is a, c, g, or t
  misc_feature (354)..(354): n is a, c, g, or t
cgcctacgacggcaaggattacatcggtttgaatgaggacctgcgctcctggaccgccgcggacaaggcggntcagatcacccagcgcaagtgggaggcggcccgtgaggcggagaagcgggagagcctacctggagggcacgtgcgtggagtggctccgcagatacctggagaacgggaagaagacgctgcagcggcggaacacccaaagacacacgtgacccaccatcccgtctctgaccatgaggccaccctgaggtgctgggccctgggtttctaccctgcggagatcacactgacctggcaagcgggatggcgaggaccaaactaagacaccgagcttgtggagaccangccagcaggagatggaccttcagaagtggcagctggtggtggtgccttctggagaagagagaaatacacgtgccatgtgcagcacgaggggctgccagagcccctaaccctgagatgggggcat

SEQ ID NO: 492294 - DNA, 473 bp, Homo sapiens
ggcagccttggggaagcagggccccatttgtccctcggtccccgggtggccaaagtggggccgttgtcccccccccttgggctcgctccacccctttggcagggtgtttggggcccccccaacaggaggggggtcaaaccgggcaggggggccccctaaacccccagccccttgggggccccccccctttgggggggatggagctttttctccccccgcccgcaaggggccgatttgccctcgaaaaagaccccccctcctttttttttttggtttttgataaaccccgaagccggggcgggttaatttttcttggggaaaccccaaaactggtctttttgggggcgggggcccccttcccgccttccaaacccgattaggaatcccctggtttggaaacctgttttccgttttcctttcgcccacccagcccggggattatagcttttagaataaaatttttttccttttta

SEQ ID NO: 492295 - DNA, 172 bp, Homo sapiens
  misc_feature (20)..(20): n is a, c, g, or t
acagtgatgcgggtgcctanaggatcccgtgatgttatccccaacaccagagaaaaggaaaggcactcatattttcctctgggaaccaattatgatgatgccaacattccctttgttcaagcattaggatctgtcaatcaggttgtgaagtttgtgttgggcgataacatca

SEQ ID NO: 492296 - DNA, 278 bp, Homo sapiens
gcttatgttgctggcgaccggaagactaccacatgtacgatccccaggacagagaactccgaacacaccacaagacagtacagcgagccctcggccctgccaaaaggaagacgactagacgacaggacctgactagagcttcccagatggaacagccttactatgaggctgagacagacccctttcctctagtccctatctttctctgtaccttccttccagccacactccagggcggagttggatgaggcccgtccggagggagccatctcattgct

SEQ ID NO: 492297 - DNA, 969 bp, Homo sapiens
gtacccacgccttcttcaaagccatactatttatgtgctccgggtcgcatcatccacaaccttaagcaattgaacaagatatgcgaaaaataggaggactactcaaaagcatacctctcacttcaacctccctcaccatggcaggctagcattagcaggaataccttgcctcacaggtgtctacggtccaaagaccacatcatcgaaaccggaaacatagtcatacagaaacggcgctgaggccctatcgtattactctcagtcggcgtagcctccctaacaagacggcctatagcactcgaactaattctgtcgtcaccctaacaggtcaacctcgcttccctaggccttagattaagcattaacgagaagatagaccccaccctactaagaccccgatggaagacggcctggacagtcgcgggaagcctattcggcaggagttgctcagttactgaagcgagacatttcccccgcatccccgcttccataacaacagatccccctctagtaagaatcgcggcctcgcggtcactttcctaggacttcgtagacagccctagacgtcaatagctaaacagaaaacttggaataagaatccccactatgcacattttatttctccaaatagtgcggattctaacctagcatcgcacaaccggacaatcccctatgtaggctgcttaggagccagaactggcccgtattcttctagaactaaactgatagaaagagtgttacgtaaacaatttgagagggacgaatcacagtcattatacttaaccaaaaggatattaagtttagttcgtcttgttttccattatctaactatgtaataatagtatcccggagttagtatataccaagaatgtcccggaaatatattaagcaatatagaggaaaggtcgaaaggttttaaataaggtaagaaggcgcaatataggggttatagcaaaaaagggaggggct

SEQ ID NO: 492298 - DNA, 440 bp, Homo sapiens
ttcctctcctcccacctcccaggttcaggcgattctcctgcctcagcctcccaagtggcttggatagcgggcacccgccaccacgcttggctggtgtttgcgttattagtggagacggggtttcaccgtgttggccaggctggtctcagactcctgacttcaggtgatctgcccaccttggcctcacaaaaagctgggattacgggcatgagccactgctcccaccctcctactagttttattatatcattttaggttattataaaatcacagccatagtaacttcctgtgaggaaacggtttaaaaatatgagagcaggccacatggccacctaaggaaatttatacattttgagaagcgtgaaatcttattctatttccctgagaaaaggtattgatatcacaatgcagaggtgggaggagaggaagggtaccgagct

SEQ ID NO: 492299 - DNA, 694 bp, Homo sapiens
  misc_feature (694)..(694): n is a, c, g, or t
gttggataaattccctgaaaactccttggtatgtgttctaaaacagggaacatgtgactggcaagcaggcacccgatgatttggaagcagtgggaggggctggggagccccagcacaatgatattggtggtgggtcttccctcctggtggaatcgagggggaaattattcttcccaataactggatttgattttcagtttcataagcttcttcctctgaatcttattgagggactatgggaccaagcagggaggaatggtcaactggtggaacaggtcttggtctggcttctaaggttcatcccagaaatccaggctctttctggagaacccaaagctggagggagatgggctttcctctggggctctctcctaatttggcatccacactggtcctggctaaacccagcaataaccaacaaatggtaggaagccccatctattggtttttctcaattatgactggatagtttgtggaaaccaagatcttggagaagatgagggaaggccttccctcttcatagttcccatctcttcttctttggtacctgtcccagaagtcagggtttaaacagaccaaatattaagtattgggtaagtgggtcatatggcggattccattgggtggaagcaccaggttatagtgtggccgcacactttgcttccgggggcccttccgagggtctttatccctn

SEQ ID NO: 492300 - DNA, 727 bp, Homo sapiens
  misc_feature (36)..(36): n is a, c, g, or t
  misc_feature (66)..(67): n is a, c, g, or t
  misc_feature (81)..(81): n is a, c, g, or t
  misc_feature (108)..(108): n is a, c, g, or t
  misc_feature (171)..(171): n is a, c, g, or t
  misc_feature (190)..(191): n is a, c, g, or t
  misc_feature (194)..(195): n is a, c, g, or t
  misc_feature (197)..(197): n is a, c, g, or t
  misc_feature (199)..(200): n is a, c, g, or t
  misc_feature (220)..(220): n is a, c, g, or t
  misc_feature (239)..(239): n is a, c, g, or t
  misc_feature (241)..(243): n is a, c, g, or t
  misc_feature (247)..(249): n is a, c, g, or t
  misc_feature (251)..(251): n is a, c, g, or t
  misc_feature (257)..(257): n is a, c, g, or t
  misc_feature (260)..(260): n is a, c, g, or t
  misc_feature (262)..(262): n is a, c, g, or t
  misc_feature (266)..(266): n is a, c, g, or t
  misc_feature (296)..(296): n is a, c, g, or t
  misc_feature (305)..(305): n is a, c, g, or t
  misc_feature (310)..(311): n is a, c, g, or t
  misc_feature (317)..(317): n is a, c, g, or t
  misc_feature (327)..(328): n is a, c, g, or t
  misc_feature (333)..(334): n is a, c, g, or t
  misc_feature (346)..(346): n is a, c, g, or t
  misc_feature (348)..(349): n is a, c, g, or t
  misc_feature (359)..(359): n is a, c, g, or t
  misc_feature (368)..(368): n is a, c, g, or t
  misc_feature (390)..(390): n is a, c, g, or t
  misc_feature (399)..(400): n is a, c, g, or t
  misc_feature (407)..(407): n is a, c, g, or t
  misc_feature (417)..(417): n is a, c, g, or t
  misc_feature (500)..(500): n is a, c, g, or t
  misc_feature (541)..(541): n is a, c, g, or t
  misc_feature (568)..(568): n is a, c, g, or t
  misc_feature (585)..(585): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (599)..(599): n is a, c, g, or t
  misc_feature (607)..(608): n is a, c, g, or t
  misc_feature (613)..(613): n is a, c, g, or t
  misc_feature (619)..(619): n is a, c, g, or t
  misc_feature (624)..(624): n is a, c, g, or t
  misc_feature (645)..(645): n is a, c, g, or t
  misc_feature (653)..(653): n is a, c, g, or t
  misc_feature (656)..(656): n is a, c, g, or t
  misc_feature (677)..(677): n is a, c, g, or t
gcgggggccccaccagggctatggagagacagtagnggcaggtctgaaccgtcagccaagattagnngggtgacctggggntggcaaccacaaatccaagtagccagngggggctgccccttccaagtctcaccaatgacccagtgccggttccagggcccaaaggcccanatgtgcaattcccaaatgnnttnntntnngtgccttcggggggctcccngtgatccagcggcgctcantnnnctannntntctttnttntncctncgcttggtggtggtggctggggtgcccagngcttcagtnttctnngagggnttcttgttcnngttgnnctgctcgtcccncnngcctgtgtcnaacacgttntccacctccgtctgtgtgggcntcttgggcnngtgctcntgccggttcntcacctccccgatgttgatgttcttctcgcgtgtttctccccccccttctcccggccggtctgccgctcctgctccgtggccngggctgccgcctgcccttgtccgtcctcgcttcccctgggntgctctcgtctgagaatggccagcganacttcttcttctggtanaantccaangananctgccccnnccccncgcccnccganttgcgccgtgcctccttgcantcccccanaancttgcgccgggcacgatccantacctcagaagagacacgcacataagtgaagtcggtgaagtcacagtcaa

SEQ ID NO: 492301 - DNA, 759 bp, Homo sapiens
gtctgttccagttgagacaccctctggtgagaaatcagttcggtctctcctctcctctctactcgtatgagcatggtgcgcactaaaggcagacagatgtctccatggcacatgtacgagaaaataggtgggtgtggcatgcatcgcagctccgcactagtagatatggatgctatggatttcctgtgcccacgctgcttgtcaccaatcgtaattcggaacactctaggttcctattcagcatgcgaagagctgatgatactataattatgcaaccgaggagtaaccctcgctttgctgttgcagccacaatagctcaccaaggtgtgcacataaggtactgggcatgaaattatcctgttagtagtttgtcctcctatacgtattcttgaacacacacgcatgacactcatagatcccctgaatggtgcatgaagctagatggcgttatgtagatagaagcaaaggagtaataacgcatgtccttttgcaacactgatcacacaacatgagtgaagtaatagaagtagagactttctcatgtcatctttgaataacgtctccttggtttacccgtggtattctacgcaatgtacaactttacataggatgtgttctgttccactctagcttttgtatgaacaggcatttaattaagagcaattcagggtttaaatctagatgttcaaaggtagttgtgacactttgagaatctgtaagactagttatggtaacttagcttagtattcaactatgtgc

SEQ ID NO: 492302 - DNA, 1408 bp, Homo sapiens
ttctacaatgctagatttagactatacattctagcaagtgtgccacacaattggtcaattggatttagatgatgttctctataaatccattctcctctcccgtgtaagcaaggcaaagtactccaggccatggggagtccctgaagactcgatgaactgcaatggccatatcaggagttgcaggttgaccagaactcaccgacacagcaggagagcagcttggaaccttcaacccagccagacccagtgccttggactgggggagaaaacatgcagccattcctctctctctctgctggctagaggggattctggcttttcctgccagagccacccctttccctcctcctaaagttgatggtggttctttaaggaaagggagaagtgcacggtgtgatagggcaggaagagaagaaaacggaggagaggaggggactttcccataagcaggcagaagaaaaggcagctgtggtgtgtgatggacatggatgcagtggtgtccaatgtggggtcagccctagaggagagacagagagagagacagaaaagtgagagagtcctgacccttacgattaacatgggatctgcctgcaaatgctgtttagggccatcgcctcttcctgtactgctatttttgagagtgatgctcctgagccccatgacccagtcaaatttgatgtccccttgagccagattcagtgctgggagtccagtgtgatctgcctggatcttgctgcattgagaacaggccagatcttgacaccaatacagggggctggatatgaacaggcaacagctgggtttctgagtcagaaagacttggttaattgctaattgcttaggcgagtaattcaattttgttcagtcagattcctcagctataaaatgcagatgacagtacttattcctccaggttgtggggaaaatggagattctgagcacgatgtccatttcacagaaaggtaccaatttggtggcttattttcctttctaccttcagaagtggctatccctgccacccaaacagacccttgactctcaagtggatggggtcccatttgcacagggggagagcttacagcctacgttgagtctatacttaccacttagtgagcatggtatccgctcaggggcctctgtgggcatccgtctcctctgcagcatctttcctccccaccgctgggcctgcacatgaccccctccttgggttaggcctctgatcagtgatgaccttggtatggtggtgatggtcagtcttggcaccaaatgagccagtttatatcatcagctattcaataaaacactaatctaggtgtcaccgtgaaagtattttgtgacattgttatgtacatgttgttacaaatgtgcatgatgcatttactacagtatagaattttgcctgggtgcc

SEQ ID NO: 492303 - DNA, 393 bp, Homo sapiens
  misc_feature (72)..(76): n is a, c, g, or t
gttttaaagcacaaagaccagtgaaccctcctttttttaaaaaaaaaaaaaaatatatatatatatatatannnnnggtcttgctatgttgcctaggctggcctcgaactcctgagttcaagttatccttccacattggcctcccaaagtgctaggaagacattgtttttccagtaggaaaaattaacagttgtggagtgctatcattttatctgctcagctaatttataaggttctaagagggcttaaaaaaaaaaaagtcttctcaaagcccgagaatgttctgcacatactaggtacaccttactgaatggaaacagttcctactgatagcaagaaatatggtttactcagtgatctgtaaatagtgacaaaaataccacccttaccagg

SEQ ID NO: 492304 - DNA, 1195 bp, Homo sapiens
  misc_feature (1051)..(1051): n is a, c, g, or t
  misc_feature (1125)..(1125): n is a, c, g, or t
ttctacaatgctagatttagactatacattctagcaagtgtgccacacaattggtcaattggatttagatgatgttctctataaatccattctcctctcccgtgtaagcaaggcaaagtactccaggccatggggagtccctgaagactcgatgaactgcaatggccatatcaggagttgcaggttgaccagaactcaccgacacagcaggagagcagcttggaaccttcaacccagccagacccagtgccttggactgggggagaaaacatgcagccattcctctctctctctgctggctagaggggattctggcttttcctgccagagccacccctttccctcctcctaaagttgatggtggttctttaaggaaagggagaagtgcacggtgtgatagggcaggaagagaagaaaacggaggagaggaggggactttcccataagcaggcagaagaaaaggcagctgtggtgtgtgatggacatggatgcagtggtgtccaatgtggggtcagccctagaggagagacagagagagagacagaaaagtgagagagtcctgacccttacgattaacatgggatctgcctgcaaatgctgtttagggccatcgcctcttcctgtactgctatttttgagagtgatgctcctgagccccatgacccagtcaaatttgatgtccccttgagccagattcagtgctgggagtccagtgtgatctgcctggatcttgctgcattgagaacaggccagatcttgacaccaatacagggggctggatatgaacaggcaacagctgggtttctgagtcagaaagacttggttaattgctaattgcttaggcgagtaattcaattttgttcagtcagattcctcagctataaaatgcagatgacagtacttattcctccaggttgtggggaaaatggagattctgagcacgatgtccatttcacagaaagcagccaagcaagcactggctgtgacagaagcaagattaaaacagttacaactcacccagttcacagatgctgagtaactgatctcctgncccaccaaccttaatgacagctttcactggacaagggactgatttcaataactttctcctgataagagaccatncttcagggactggtctgggcagttttagaggctgtgcctttcagaggctgagtccttctgtcctgttcct

SEQ ID NO: 492305 - DNA, 111 bp, Homo sapiens
gccgagatgacccaatctgcctttgaatcttgaggaaataggcagaaacataatgactctagagcttatactctgtaggccaaatatcatttcagccacttctgcaggatc

SEQ ID NO: 492306 - DNA, 138 bp, Homo sapiens
  misc_feature (6)..(6): n is a, c, g, or t
  misc_feature (15)..(15): n is a, c, g, or t
  misc_feature (74)..(74): n is a, c, g, or t
  misc_feature (93)..(93): n is a, c, g, or t
ctggtnactttgcgncatatcctttgggaacggagacaccagcttcttggaataattgccatactcatgtattnatgtagtgagagatgtccnttgctgttgctgctgtacttggagtccatggttcttaaacaatcc

SEQ ID NO: 492307 - DNA, 403 bp, Homo sapiens
tctaaattataatagtgactataacaaatatgagtgagcatcatggataaagaggcttatactctactggtagacatgtaaattgctattatcattttggagaaaactttggtaatatgtctatgtcctataaaatcacaattccaaatccaattatgtattcaaaggaaactcttgtataagaaaacataaaagaattattattacagtagtatttgtaataacaaagaattgtaaatatgtacccctgaagtaagattatatctaaaatgatatgcaaaattttatcaactattcaaagaagaaataacttttgtataaatgattttaaaatgcaaaaacacataacaagttttctggtttattcttgaagatatcacttttctgtcaccaaaaaaaaaaa

SEQ ID NO: 492308 - DNA, 176 bp, Homo sapiens
ggcaaaaaggcatgggagaagctgcgtctgcaaaatcttcctggatgacttgtcagaaccagtcagtaattcaaactgtccagagtcccttttgaaaaccacagatgccgtggacccactaaggtgaggacgcagtgtttgtcccctccaggagacacagtgttcaaggcgccatc

SEQ ID NO: 492309 - DNA, 288 bp, Homo sapiens
agcaacgggtgattaccgagactacttactttctccagtgtacctagggaaccctcaggtctctagagtgagggtcttgatagaggactgaagtttagagtagatcctaagactttacagtgtaacatcctctctggtccttttctgtgttcctatgttttgtacagacttgtttccagacgtgttcgagtagccagggacaaagataaggggaattgtctatttattctaagacaaattccattttccattgttgttctacctatccttttcctgtggaaacgtcct

SEQ ID NO: 492310 - DNA, 724 bp, Homo sapiens
ggggtacatttggaaaaataaaactttattaaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactttttggcccctttggcccaatcgatttttaaattgggcaagttttttcattgggcccaaatttgggcccaattggccaaattccccttatggggggcgttttaaaattaaagggcccggtttttaaaaccgttggactgggaaaaccctggggttccccaatttaaaccccttggaaaaaaatccctttttcccaagtggggtaaaacccaaagggccccaaccgattgccttttcaaaaagttggcccaccctaatgggaaatggaaatttgaaggcttaaattttgggaaaaaattccgttaaatttttggtaaaacagtcttttttttaaccaaatggcccaaatttggcaaaaccctttataatccaaaaaatttccccgaaatgggttaaaggttttcccattttgaaacaggtccccttttaaaaaaggggcttcaacgtaaagggggaaaaaccctttttaggggaaaggcccatttgggacccttcccctaaaaaatgttttggggccaaggggcccaaaagcctttgggcccttgggcccccccttttttgcggg

SEQ ID NO: 492311 - DNA, 310 bp, Homo sapiens
tgtctatcgatgccaccagagtacttctggtgggtttactccagtgtacttctgggtggtctgtgccccaggctcaccgggggctggatggcccctatggctgcgtcttccttcattctctagggatccgggcttcccatcttcccagccaggatttggatcatcagcccccaggggctgtgttcctctagcttcctcctttggggtgttcctcctccagggactaaagtatgttaacacattaaggaacaacggtgtttcatagtttatgccacccagcataagtggcatcgataaacaccgggtaccg

SEQ ID NO: 492312 - DNA, 1284 bp, Homo sapiens
tcacatgtgggccccctttatatggggtggataatggagcgggtgttcattcctaaagggccgctttctcccgctttgtttggccccaggaaggtttcttgccgacccacgtagtggaggggttgtttgtaaaaaaaggggatatactatcacggtggggagaagtccccccacgaaaagggtgtgtgtcataagggtttttctgttacaccagcggtccccacggaaaattgggaggagggcgttgtacattaagaaaggtcactgttttcgtggtggagatattcctcccgcccccccccccgtcttgtgggttgtctcttttaatataataatattggagtttcttgctaagtcaacaccccataatgttgtcgagaccgggttttgctcgtaaaaaaaagggggggtccccaacaaatccctggagaacatctttcatggcaaatttgccccacagaaattgttcttggggcgttacaattgggggccccacaaaaaatatctgggggggcgtgtgttttctcctcggagagaaagtttgtccccacagggtgttttgggggggcgcccgtcacatcttgtgtgacacacacgcgaaggttgtctgtgggagataaaggagagtggtctggaagtttccttcgaagggataaagcgggaaaatggggggttttctctgggggtgtgtggtgttgcaaacaccccccctctttccgaagagtgttccccacacaaaaggaagcgggaaaactttgggttttatttctcttcgggtttcttccacagcccgcacagcacggcacacgctcataccctcgggcgttctttgggtgcccttgggccctcgccaaggcccaaaggtgtgcttgtttcctatagcctcgaaggcgttttgaagaacacggtgtgggggttttgggcgtctctcttcaaccacaactcccacagtttcccgtgtcccactctcctcgagagggcaaagagattcctcgggcgttcaataaggcacagttccctcttacaactttcctcttgtgtcttgggcttccctcggtaattggtcggaagattgagaatgtgagactaaaaagggccattcttgctggcttaaatgtgtggatcggaagagagagccacgcctcggagagagcacaatgtggcacaaatggggcgcttcacatgccacgtctgtcttaaagccctgtcgagcttggggaggtgatttctttcctggttttataatgtgaagccaaataaaatgttttctaaaattaaaagcca

SEQ ID NO: 492313 - DNA, 599 bp, Homo sapiens
attcttacagtgtctcgcgctctgtatggcatgcttgagggcacagctgtgacgatagttcatggttgtgtcagactctaacactaacgacacactcatgtgtgaccctgccacggtgctccaactataggagtgtgcgagctcactgcgccacatccatcgatgctctggtcaggactgggcctaactatacaggtgagcaacgacggttgcgcagacagcgaagacgatatggcggatatcgacgaggctcaggtccagacttagcgaacttgcactatctaggacactgtgacgtgctgatctggttgcgcctgatacagaaccgaggccttggagatagcaagtagttaccacctggtgcagcaacactttacgggcccggtacgtgcgagacccgatgaggagacactgcaagagagcctgtaccgacttgcacgtcggcagtctgcggagcacatgctgctcgtgaatggctatagacagacaccatatctcccggaagactatctgataacgacccatgcggagctggtggtggagcatgtgcaagatgagtggcatgcctaagcggagcgcactgcaggtttctcagcagg

SEQ ID NO: 492314 - DNA, 236 bp, Homo sapiens
ctaccgccagtaacagtgtataggcggtgtcaatgtgtagttgtgtgtgaggttttgttgtgtgagtggttgtgtgtgttctctgtgtttcttgcttggaaaacccttgggatggtgtgtgtggggttgtgttgtgtgtgtgctctgtgtgatgtgtgtggtgtgtgtgtggtgtatgtgggggagtgtgtggttgtgttgtgtgtggtgtgtgctctgtttgtggaggtagcact

SEQ ID NO: 492315 - DNA, 162 bp, Homo sapiens
accggatagagcggtctggggacacacatgctgaaaagtagtccctgtttatcttgatgctcaggttgaatgagcgccatcacaaccctctgttgaatggacaaccaggactcggaggaaacgtgggttgtgaaagactgaagccctcaaaattccaaagag

SEQ ID NO: 492316 - DNA, 452 bp, Homo sapiens
cctatccgcgtccggggttggtcaaaaaaattaaccagccaggcttggtggctcatacctgtaatcccagcactttgggaggccgaggcaggtggattacctgaggtcaggagttcgagaccagcctggccaacatggggaagccccatctctactaaaagtacaaaagttagctgggtgtggtgccaggcacctgtaatcccagctactcaggaggctgaggcaggagaatggcgtgaacctgggaggcggaacttgcagtgagctgagatcacgcctctgcactccatcccgggtgacagagcgagattccgtctcgaaaaaaaaaaaggaaaaaaagaacattgatttgagaaccagtcaacataatgtattattttaactatggccactttcacatgatttctttagcccagtgctcttgctgtattccccaccaatgtgatctgcac

SEQ ID NO: 492317 - DNA, 159 bp, Homo sapiens
tgttattctccgagcttcgaatgccgcctaaggacgacaagaagaagaaggacgctggattttcggccaagaaagacaaagacccagtgaacagagccgggggcaaggcctaaaagaagaagtggtccaaaggcaaagttcgggacaagctcaataact

SEQ ID NO: 492318 - DNA, 161 bp, Homo sapiens
gctaatactgacttgtaagttgattgtagatattgggctgttaattgtcagtacagtgttcataatctgacgcaggcttatgcggaggagaatgttatcatgttacttatactaacattagttcgtctatagaggtgatagattggtccaatatgggtgtg

SEQ ID NO: 492319 - DNA, 303 bp, Homo sapiens
  misc_feature (31)..(31): n is a, c, g, or t
  misc_feature (79)..(79): n is a, c, g, or t
  misc_feature (149)..(149): n is a, c, g, or t
ggcacgagtgatagggtatgtggcgcctctntactttctgagcctaacaagtgaggttcagagcaaggcaatgtaaatntctgctttgaaagtgaacatggattgggtaactaaaaagagagtgatacgtaggagaaacttccaaaganttgcaatctgtccctctgactaacatgtctacgtggagacttccaaaatggaaaatgagacatagcataacagaaagcaagaaagcctcctaaagataagcttagcccagcagctctgcagagtatgactttaccctccaggggaaccatttgg

SEQ ID NO: 492320 - DNA, 154 bp, Homo sapiens
agtccctaaaatctcaaaagtagggaagccagcgactgcagccgttcagtctgtggtccaaggtctcaagagttcccatagctgatgaacttggatgtctattagtttgaagggcagaattgcacccagccacacggacaaagatgtacggctg

SEQ ID NO: 492321 - DNA, 108 bp, Homo sapiens
cccggccccaaatggggggggggttttccccttttttttttgaaacccccaaccccttttttttgggggggggggttttaaaaccccccttttcccccggggggggga

SEQ ID NO: 492322 - DNA, 398 bp, Homo sapiens
tggagcaggggttctcacctttgttcgcccaggctggagtgcaggggcacgatcttggctcactgcaacctctgctccccgggtttaagcgattctcttgcctcagcctcccgagtgggtgggactgcggttgcccgccaccaggcccgtgtaattttgtgtatttagggtgaagatggggttacaccatgtttgtccaggctggtctcgaactcttgacctcgtaatccacctccctcagcctcccaaggtgctggaataataggcgtgagccaccacacccagccagaaagtggtcctcatgatgcttctcagaccggcaacatcagcatcactggacacttgtaaaaattggacactttgcatccagaggggtcacgagctcaaattcgaaatca

SEQ ID NO: 492323 - DNA, 133 bp, Homo sapiens
ctgttgccagcttggggatagtgacacaagccaggaatgggcctggcattgtggaaggggcattgtgagtgagccctgcccagccagaagctggggcagtatcggtggcaggtgctgagtggctggagccact

SEQ ID NO: 492324 - DNA, 842 bp, Homo sapiens
  misc_feature (399)..(399): n is a, c, g, or t
  misc_feature (738)..(738): n is a, c, g, or t
  misc_feature (756)..(758): n is a, c, g, or t
tgcgccggagtgaactgtgctctttgaggccgatgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggacacaaaatatttaacaattgatcagatgggaagatggtttgttgctggaggggctgctgtnggtcttggagcattgtgctactatggcttgggactgtctaatgagattggagctattgaaaaggctgtaatttggcctcagtatgtcaaggatagaattcattccacctatatgtacttagcagggagtatcggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggccaaagcatcttgctgggttgctacattcctggtgtgatgggtgcagcgggnggctctctgaccaatatnnngggggtcctcttcgtcatcgagctgcatggtacacaggtggacttgtgggaagctctcatgtggccagtgttcgccaggaaagg

SEQ ID NO: 492325 - DNA, 262 bp, Homo sapiens
  misc_feature (75)..(75): n is a, c, g, or t
  misc_feature (86)..(86): n is a, c, g, or t
ggggggctttccccaatttttaaaaattggttatgggttgggccccctaaaaactggggagcaggatgaagtttncccttccacantggggccccttgggtggggttggcaacatttaagcccccggtcccccccccggaaaaaagagggggggcccccccccctaaggggtattgtggggatggaaaacgaaagggggagaaaaaacctccccaggggctggggcaaaggggggggttaataaacccctttttggttgcca

SEQ ID NO: 492326 - DNA, 205 bp, Homo sapiens
attgtttcagtactgggtgtttaaggacaatagctgctagattcaggggtaaatgtaagtgtcagaaacgtcagacatttggggtttaactgatttgttgctcctatcagcctagcacagaactctgtgttacaggccagccttgcaggataggctcgttgtcaatgtattcagttgtttcacacttttgctattataaatggcg

SEQ ID NO: 492327 - DNA, 296 bp, Homo sapiens
  misc_feature (128)..(128): n is a, c, g, or t
ccaggaaaaaaagctaaaatcactcaccgtgtgattgttcagcatgaactgtaccgcactaagcttcactagcttccttacgctactgtagccaatggagaggtcattaagaagctgtagtgtcttgnaggtgattggttcacaacggccccagtacttcaagttggtcacgaggagcacctaaagaaaaaaataagcaggagccccctttaatttactggtatcataaagggctggaagaagaataaagacattcatcgaaagtcgccacacatctgcaccaccaattcacagac

SEQ ID NO: 492328 - DNA, 440 bp, Homo sapiens
  misc_feature (11)..(11): n is a, c, g, or t
  misc_feature (64)..(64): n is a, c, g, or t
  misc_feature (162)..(162): n is a, c, g, or t
  misc_feature (224)..(224): n is a, c, g, or t
  misc_feature (267)..(267): n is a, c, g, or t
  misc_feature (269)..(269): n is a, c, g, or t
  misc_feature (276)..(276): n is a, c, g, or t
  misc_feature (286)..(286): n is a, c, g, or t
  misc_feature (327)..(327): n is a, c, g, or t
  misc_feature (348)..(349): n is a, c, g, or t
  misc_feature (360)..(360): n is a, c, g, or t
  misc_feature (366)..(366): n is a, c, g, or t
  misc_feature (368)..(368): n is a, c, g, or t
  misc_feature (388)..(388): n is a, c, g, or t
  misc_feature (418)..(418): n is a, c, g, or t
  misc_feature (429)..(429): n is a, c, g, or t
cagtctgcagngggttcctgctggctggaggcgagggggctcccccgcgggccgtctgccgctngccgcggccacggctctgggcatccaggcacggccattgacccccgtccgatggctcttctgggtgtggctgctgcgttgcaggaccccaaggcgtgnccgatggtgacactgcgcgctggccgatgtggggcagccgccaaccagggccgcgatggagntcttctactcgaggccgtgtggggcactgtgtgtgacgccctntngggcctnactgatgccngacgtcgtcatgccgaggccctgaggcttgagaaaaacgcntacacaccagcactctgaggnngtgctgccttntgggcnanggagtcgggcgcccctaatnctggccggagtccggtgctcgggtagccgnagcctccctgnccgactgctag

SEQ ID NO: 492329 - DNA, 228 bp, Homo sapiens
ttttgatatctcctcttcactacgtactcccacaatagactcctcgtaaagctacatttccgtgttgtgagtatattatagccattgccctacatgtcccctaccgtcaggtctttacctaattatatttattgtcttgcgtacttgaaaagagattttttggtggtgaagtacagtatgatagaacgttgactatctggagagtcagttggtaaggtatacatatca

SEQ ID NO: 492330 - DNA, 210 bp, Homo sapiens
ctctcgtagctcctgtttatgaaatccattggcacggccaacagaccgatgggtgctggcgaggccctgcggatgagtgctgtatgtgcctggctgtcgggcatcgtgatgccaaatggctcctggcatttatgagcccttgtgatacaagaagccactgatgctattgggcatctagacggtacagcaaccgtggaagatatcacacag

SEQ ID NO: 492331 - DNA, 274 bp, Homo sapiens
tcgggattgtgctacggtgcggccgatgcggaggtgggttaaggtgcccgataaggtatctgtgtataaagataatgcgccggattattagaactagacgggtcctcaggctaatttgttgacgtcctagaagacggctcaggtatctagaactagtgctctcgctttgttgagctcgcagatgcctcagcgggccttgctttggcggccggggattaaccaataggaataatggcttttttggctatatagcctaagaatctcgaacaaagtg

SEQ ID NO: 492332 - DNA, 544 bp, Homo sapiens
ataataataatgcgttgtgaatagccttgtgtttatatcatcttgtatttgcccgtgtatctttggggtagattcctaaatgcagatgaaaaggtaagtacatttgtaattttaccaggtatgtctgtattgcttcttttggggctgtattatttgcattcctcccttatttgtaatatactagtgtatctgtttcactactgtctggccaacattgtgaaacattcagattttttccaatttataggtgagaaagggtttccctttgttaccttaatttttcttttattatgagtaaagtcaggcatatttttatatatttaatttgcatttttcagtaaatcatctgtgggcccatttttaacattaggtctttgctctttttattttgcttctccttactatcttagctttttaggtaagagtcagatgttttatgtgcatctctactgtgcttgctagtggaaagctcctcaagagaaaatgagcctaggatggtgcctgtgttattcctttcaggctgctatagcagaatagcacagag

SEQ ID NO: 492333 - DNA, 449 bp, Homo sapiens
ttacaacaaataagtttatagaatcataccttaaaaaaatatataagaatgtaagaattctctaagaatgtattatatcttcagagaaagttttctatgttttacagaatttaacaacttgagaagttataaaattatgcgattattaataatatgttaaattattatattttgaaatgcaaataagagataccaacccatatttacttattctttctggtgtctgtattatgggcaaaacactactgcatgaaatcagctggttataatgattgtataaaataacttcccaggtactactgtgttaatagtctatgcacgaccttgcataacctttatatatagtgcttgtaccatgataatgtccaaatgatgacttagaggccctccaagcctattaaacatctaccgaattaccaaaataagtgatattcatttgacagttgcag

SEQ ID NO: 492334 - DNA, 312 bp, Homo sapiens
caccacatcggcgcccatgtccttggaacccatcacgcagtacgcgccgccgtaggacttgcgggtgatgacggtgaccttggcgaccgtggcctcgccgtaggcgtagagcagcttggcgccgcgccggatgatgccgttgtactcctggtcggtaccgggcaggaagccggggacgtcgaccaacagcacgatcgggatgttgaagcagtcgcaggtccggatgaaccgggcggccttctccgaggcgttgatgtcgaggcagccggcgaactgggtgggctggttggccacgatgcccaccgggcgccc

SEQ ID NO: 492335 - DNA, 174 bp, Homo sapiens
ctagaggatcccccggcaggttgtacttgtaaagaaaaacacaatgcttcacattcgtgctttttatactaaaaataagtatgatatataagacaatgcaacctaaatgcttcgatttgaggaagggaatgggggaggggaaaatcaggagaaggagggagcgattctgaaagg

SEQ ID NO: 492336 - DNA, 180 bp, Homo sapiens
tagactgttttattaggtgatgacaggatgctgtgacatagatctgagtttaagccctgggctttggcaggaacagagcaggagtcgtatatccttcctctattactccctcccaggatggatgttgcattcaggagagattgatgaaccaagtgatggaaatccagagagccggaattc

SEQ ID NO: 492337 - DNA, 501 bp, Homo sapiens
tccagttgtcaaatgatcctttattgaaatgtgttttccctttgtgtgtgcttaacgtggctgtgggcatttccacacagcaccactgtgtgtgtgattgctcatctcagatgagtgttcatgtgaggatgtggcggccatctcaacatttacagccccacgtgacgtgggcagctccccaggaatctcctcttttaatgtggttctccaagaaagtttcctcgtggctataagggatctcggtgtgccgacattctgtgtgtcgaggacaatgtgtttgaacaatctctctcactacaaaaagtgtgatatattctcccccactgtgtgtgtgttatagagtgtgttattctctgtgtgttctctatctctctgtgtgtctctcctgtgtggggtggtactcccttttgagaggcgcctttgtgaagtgaactcgaggggcacaaaagcgcaagaagaggcgaccaaccttcaatatcttgggcctgtgttcgtgttccg

SEQ ID NO: 492338 - DNA, 131 bp, Homo sapiens
agtcggtgcctggggtgccgcgagcacctttggctccaggagcaccaacattaccaatggggccagggggtccagcgggtccggcagggccagtgggaccagcatcgcctttagcaaccgcatcacccgtt

SEQ ID NO: 492339 - DNA, 545 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttggccggggcactggtggcagcataagggagatgcatgtctttagtggaaaccagagccagcagggagatgtagcacttcctgagttcggaaatgactccaccagttgatatagggcctctcagtgtgttgaaggaaggaagtcctatgttttatgattgagcattagtgtcatactacaatcagccactccccaaatgttgcatcactgaaactccaggtttcacagagaatttcctaaggtattaggtttgagtttcttccttcgtgggatgctatggattctttaaccaaaccaacctaatctttctcctgccacagtaccaccttctcctgccatgcaaaaagaagcagtttgcaaaagtcagtaaaagaaaaaaaaatgccttgttatttctcaaaatgatgggctcacttgtcttctatttatataagagagaccacagtaattattctcaacagtatcagctacaaggtgattttctgtgcctgcgtattctaagaagtagctggcaatttctcttgttaaaagag

SEQ ID NO: 492340 - DNA, 485 bp, Homo sapiens
  misc_feature (56)..(56): n is a, c, g, or t
  misc_feature (173)..(173): n is a, c, g, or t
  misc_feature (312)..(312): n is a, c, g, or t
  misc_feature (321)..(321): n is a, c, g, or t
  misc_feature (421)..(421): n is a, c, g, or t
tcctggtctgcgggtttcaaagaccatgggaaaagtgcagtatctgggccggagtnaccgttcctcaggtacagtccctcatggcttcccttgggtagaggaggtagttccctgaccccttgtgcttcctgggtgaggtgacacccaccctgtttcagctggccctccatggntgcacccactgtccaaccagtcccactgatatgaactgggtacctcagttggaaatgcagaaatcacccgccttctgcgttgatctcactgggagctgcagaccagagctgttcctatttggccatcttgccaagcaantcagaccangaagttttaaatggactacaaaataggtcaaactctatttcacgaactaagaaggctaaggaataatgtccaaactttggttatggaaagtttttttttnttttttggtctgggtaaggataagagggtttttactcatcttaagtttgaattaaacttttgta

SEQ ID NO: 492341 - DNA, 228 bp, Homo sapiens
ccagcggctgtggggatagttagaatactgctatggctggagggagaggcttaggagaagcctattactttgccaggggcccttcaggaagtcgctgggctcagaaggctcttagtcgtgcttgagatgtgatgccttatcgaagagatactcgcccagcccagcctccgggccacccagctctgtgaaggctaggtcacggtggtcacccaatcttcttgactaagc

SEQ ID NO: 492342 - DNA, 804 bp, Homo sapiens
  misc_feature (47)..(47): n is a, c, g, or t
  misc_feature (231)..(231): n is a, c, g, or t
  misc_feature (257)..(257): n is a, c, g, or t
  misc_feature (276)..(276): n is a, c, g, or t
  misc_feature (302)..(302): n is a, c, g, or t
  misc_feature (334)..(334): n is a, c, g, or t
  misc_feature (351)..(351): n is a, c, g, or t
  misc_feature (373)..(373): n is a, c, g, or t
  misc_feature (402)..(402): n is a, c, g, or t
  misc_feature (451)..(451): n is a, c, g, or t
  misc_feature (455)..(455): n is a, c, g, or t
ggtctgcgtcagtggtcacgtggttgttcggagcgggcgagggagtnagcagggctttactgcagagcgcgccgggcactccagcgaccgtggggatcagcgtaggtgagctgtggccttttgcgaggtgctgcagccatagctacgtgcgttcgctacgaggattgagcgtctccacccagtaagtgggcaagaggcggcaggaagtgggtacgcaggggcgcaagggcnaaagctctaagagatcgtttccctcnggccaacctctgaagccgngtctactttgacagctgcagggccgnggcctgtcttctgtgcttcaccatctacatanatgaatcccagtatgangcagaaacaagaagaaatcaangagaactatacgagaatagttctgtcccnaagagagaactctgaagatgattcagccttctgcatctggatctcttgntggnaagagaaaatgagctgtccgcaaggcttgtcccaaaaggaaccatcggaatgaccacttaactatctacaaatttccagccctggggttattgtcccagaatctagtggaacactaacactctgggagggagtcaccccaggagtcatttgatctttatgaattcaccgaaaatccatcctctcagtatgggaaggacgtggcagaaaaacgggagaaagggctgtatgaagcactttaggacatgggaaattcttaggaattggcacacaggcgaagaattgcccgctggaaaaggggaaaagacggcggaagtgcgacatggcggttttgtgggataaaaacgaagg

SEQ ID NO: 492343 - DNA, 677 bp, Homo sapiens
  misc_feature (47)..(47): n is a, c, g, or t
  misc_feature (207)..(207): n is a, c, g, or t
  misc_feature (224)..(224): n is a, c, g, or t
  misc_feature (246)..(246): n is a, c, g, or t
  misc_feature (275)..(275): n is a, c, g, or t
  misc_feature (324)..(324): n is a, c, g, or t
  misc_feature (328)..(328): n is a, c, g, or t
ggtctgcgtcagtggtcacgtggttgttcggagcgggcgagggagtnagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacatanatgaatcccagtatgangcagaaacaagaagaaatcaangagaactatacgagaatagttctgtcccnaagagagaactctgaagatgattcagccttctgcatctggatctcttgntggnaagagaaaatgagctgtccgcaaggcttgtcccaaaaggaaccatcggaatgaccacttaactatctacaaatttccagccctggggttattgtcccagaatctagtggaacactaacactctgggagggagtcaccccaggagtcatttgatctttatgaattcaccgaaaatccatcctctcagtatgggaaggacgtggcagaaaaacgggagaaagggctgtatgaagcactttaggacatgggaaattcttaggaattggcacacaggcgaagaattgcccgctggaaaaggggaaaagacggcggaagtgcgacatggcggttttgtgggataaaaacgaagg

SEQ ID NO: 492344 - DNA, 373 bp, Homo sapiens
ttttccaggggtgggttgggcccagcgtttcggccagggggcctgcaggaggggggccccccaagcctgcattgaggagcagttgtgttacagttgccgggtgaacatgaaggatttgccctcattggaccccctgcccccgtactttttggttgaggcccagctccgcccacaaagggcctggggcttgcaggaaatccgggacttttttatttaggccagtgccacaagggggggccaaagttgagggtgaggacgtgcttcccgggacagcaggcaggggccccctggtacccccccctggagccggaaggcaaggagggggggcgggcctttgattgtccttttgtataaataaaacattttttattta

SEQ ID NO: 492345 - DNA, 90 bp, Homo sapiens
aattcggaacgaggaaatcaaattgcttaaaaaagagttttctttagtatagccacaaatgccttgaactgttgtctgggattgttttgc

SEQ ID NO: 492346 - DNA, 88 bp, Homo sapiens
aattcaagcttctaacgatgtacggggacatggtaattattggaaagtattcaaataaatatggtttgaatatgaaaaaaaaagaaaa

SEQ ID NO: 492347 - DNA, 502 bp, Homo sapiens
gagtagtcctagatcgcgagcggccgcccttattatataaatccaatatatatataatctaaaaaaatcttttaatataaatccccaaaaaaatttacgaatataatatcctgttgtctcccccggcggggagacatatataaatattttttacgtttgcctcttttatacaagagtaacccggtgaagcagccggagaccagaacacagcgcgcgccagagggcccgcagcagctccaagaaggaaccaatgaagaaacacgaggctcttttctctgcttgtccacggatcgcttgatattcccttaacattttacttcttactacagcacagagacacgtgagaaagacaccgagacaaagacaacaaaaaagagaatgtggggaattcctgatctcacccgtttcttagactatgatccgtgtggagtgtaagacatatatccaaatatagcacggggttggaatttataaggtatccatttctagcccgcttagataa

SEQ ID NO: 492348 - DNA, 245 bp, Homo sapiens
ctttttttaaaggggtccccccccaaagggaaaggccccggaaaatatctcccccttcccccccagggggttttggggtccccaaaaattaaaaaaaaaaaaactttttttttttccccccctttctttttttttaaattggggggaaaggcggggggggaaaaaggggtccccccgggggggggttggggggaaccccttttttgccttttttttccgccggggggtacccgggtttcctccca

SEQ ID NO: 492349 - DNA, 135 bp, Homo sapiens
atttgagctcggcccccggtccagctacaagagctggtgtggagcctgctcctatgctggcggatggagcagcccccggacccttacactcagttgctggcacaacccacctgctgggggctgttagcacagtca

SEQ ID NO: 492350 - DNA, 324 bp, Homo sapiens
  misc_feature (76)..(76): n is a, c, g, or t
gatggttagcagagacttaaaagggtaggtagtaggagtttgtgtggggaggtgtggatggtcaatgggtactaanaatgaaaaaaatgaataagactttctatttgatagcacaatagggtgactatagtcaacaataacttaattgtatatgttaaaataacttaaagagtgtaactggattgtttgtaactcaaagaataaatgcttgaggggatggataccccatactctatgatgtgctcattttacattgcatgccctcaccaaaacatctcatatattccataaatacatgcaacaactgtgtacccacaaaaattt

SEQ ID NO: 492351 - DNA, 128 bp, Homo sapiens
gatctagaggatcccgctgctgctactactaccctggtgtctggagagcagtaccaagaactatcagtggccctggattcatgctccgcaataatcatgtcaactcactgaaaacatcaattcactgc

SEQ ID NO: 492352 - DNA, 165 bp, Homo sapiens
  misc_feature (149)..(149): n is a, c, g, or t
agcattgatgtgatcactaatctggtcatatgatggagtatctgctacaatctcagaaggctgtgcagtcaatgagtcgcttggtgaattctcatctggaaacgatcccacgtcttagaaccttcaccacaaggagtttttcttgtagntgattctcaaagtctt

SEQ ID NO: 492353 - DNA, 179 bp, Homo sapiens
ttcagccataacatattaccaataatcctgtcaattatatgtctaaattttccccctaattctagcagagtatgtacattggcagttaacttatgcacgcttaactatcttaacaagcttggagtgctagagattgaagagttcaaatctgaccaagatgttgacatggttgtctcgaa

SEQ ID NO: 492354 - DNA, 1570 bp, Homo sapiens
  misc_feature (393)..(393): n is a, c, g, or t
ggagcccggaagctcggctcgtgaacacacactgacagatataggagcaggcggcggcaccagtccccggtctccctctcgagcggacagtgagtgtgttcccgatcagtgactggagccttgcaatgtgaccgcatataacatgatctatgctgacgagtgatataggcctcatcggcatactgcggatcagtgagctcatagcttacctcatcggcccgagatatcctgagtaatgatgtgacccctggtcaatgcaagagtctggcaatctagatgtgcatgaactccggtcgtaagagatgtgaccagtagcaagcgcagcttgtcctgtccacgctggactgactacactgtacatgtgaacaccgggtgagagggtagactaatccnccaggaacacttacctagaagagtctgcgtgagagctattcacaggactagcattagactaccttgaatcgactagcatgctagaatcatgttcatctgacataggactctctttctatgaaacgaagaaagttccgtcaaaggtggttcgcttggaagtacaacacgtttattttacgggagccttggaaagacatagtccttatactatccgcgaccgaaagtaacatgcctggcagaggcacttgaatgtgtggaataaccggatctttgctcgttggcttggaagtttgcatcttagatgcgacagatgccacgcatgaagtcgaacgcaagttctaagctactgcgtatgcgcgcatccccagacaattggctgtgacttacctgctgttattcaactggaaagccttgacaatggggaccaaactacctatgaactttgatgcagaactcttggtttccccaaactaggcaaaggtgctcagtacacaccaccaattgaagaacattcgcgtttaaaaccgaaatcttctttggggcacccaaaccttggtccactcctagtgatcacgtggatggttacaccctctattggaattccgcaaacctgggcaacaacggggatactccttagctggggtcaccgaattgaacttgttctctggtgtgaaaactcattggggccacacaccgactgactgtggacaccggctttgccagaatagcaacaatacccatgttatgacgaaaggagcaacttggacttgagtctgaacaagtaataccagagcaccatagcgctttgctcaagccctctttaaaagtataccaaccgagtaatacgagagagctggaggaacacgatggaacaaaacagagacgccaagagacatctcacgaacaaccgcagaacagtagcagaacacaaaggagaagaacacaaacgaaacaccacaaagaagcaaaaagcatcaaaacaaacacaccagaggtcacgcagcagcaagaaaaaataaaaaccgaagaacgaaacacacacaaaaaaagacgacagacgaaggcacaccatagcaccacacaaaatataacaaccgcgcaaaacaacgaacaaagcgtagagaagaacagagaccgacaagaagcatgcacggcagaagcgaagcaatccactaca

SEQ ID NO: 492355 - DNA, 411 bp, Homo sapiens
gccggcccggaaacggttgccccaatttgagttttttttgcctccctgggggggctttccccggaagatccatttttggttttggccggggggccccttggggtttgggcccctttgggcccgtgcggggggggggccctttcttccctgggggttgccggcccccttttttggggttaagtccctggtttcctgggcccggctgggaaagttggggggccgcctccttaggtggcccccccggggaaaaaaaaaaaaaaacccggttggggtttccggggggttccggccccccggggctttttttccgttggggccccctttgggcgggggggggggccccctgcccccttttttgttttttggttttttgggttttttttttttaaaggcccctttgttccgtcccca

SEQ ID NO: 492356 - DNA, 215 bp, Homo sapiens
tattacagaagtgttgtattctacgtcgaaaggagggggtgtacgggtacaacctacaagacacaacccgctacaaacagtgttttactaaacatgagaggttttttaacactttccgttggggaaagaaccggtgttccgtctaccttcaaagactccgtgactaggaagaccgtcaactatcgtcgaggaaaaagaacgtgtgtttcgtctag

SEQ ID NO: 492357 - DNA, 242 bp, Homo sapiens
  misc_feature (227)..(227): n is a, c, g, or t
ctggctcagcctctcaagtagctgggaccacagatgtgccaccacgcctggctgctttttgcctgtttggtagagacgggtttcaccatgttgcccaggctgctctgcaacttctgagctagagcgatttgtctgcctgagcctcccaaagtgctgggattgcaggcatgagccaccatgctggcctgatacggttccttgttttaaagtgcattattcaacaagcnaagtaccgattccct

SEQ ID NO: 492358 - DNA, 390 bp, Homo sapiens
attagtctgtgtcagtgtaacatcaaaggaaccattctgtaaagactaccgttcagattagaaacatagcttcactatttacccttgtatcttaactgtgtttacagatattttttggctagttatacagtgataactcagtaactgtttagcatcagtagtcttaattgatcacttgcggtagtcatcacatcattttgcatgcagtgcagtgcatcatcacaacatttcatctcactcacacatttcattctgcattagtcaggcccaacagcaatgcgcagacaacagcgcgtgaagcaacagcgggttaggggtctggtgtcgctgcgtggggcagcaattggtctcccatgcctgtggcaggggccgccccccacagatgtaagg

SEQ ID NO: 492359 - DNA, 480 bp, Homo sapiens
  misc_feature (75)..(75): n is a, c, g, or t
taccgacacccccccccaccccccaccaacccccaaaccacagcacagtttcggggttactaaccacacatttcnaggagaacacacaagttcttccacgatgtcgtacagacgagatttagagaaataccgtgacctgcatgaagatgaaattcttggagccctaacagaggaagagctgaggaccctgcaaaatgagctggatgagctcgaccctgataatgcactgctgcctgcacgcctgccgcagaaggatcagaccaccaaggcgctttttgtcccctttaaaacagaggagctcttggatcacttggaaaagcccgccaaggcgcttacggaccgagaagatctgcccccccactcaggcgaaagcccacgaaaggcctgggctgccaaccattaccccctccccccccagctcggaagcccgaccctcccgccaccaccctcactcctcccctcgccccctctcccaccccg

SEQ ID NO: 492360 - DNA, 216 bp, Homo sapiens
agtggctgaccctgtcttctcccgaaactcggatatttccagtatgtgtccggtgtccccagaactgaacggagatggactggcttgcgggggaccccatgtcctcttccccaacatgaagagcctcgggatccattttcactgctgcagcgcccgtcgcctcctcagctcctcctcgtctgctgtaccttgtttcgtcctcttccttgcctcgtg

SEQ ID NO: 492361 - DNA, 468 bp, Homo sapiens
ggagtgaaatctgcgcggtggtgcatcggtttcatggagaggcgtatttctgcgcgaagccgcctggttcgaaaccgccgaagaggaagtcagcgaaatgctgctgccgatcatggtcggttcgggcctgttcgaagaggaggcagagttctccgacatcgccgccgacgccaacctgatggacgacatgatcgtgcagatcccggaagccctgaccgcgctgtacctgctgtgcaacgcgcctgacgaaaaaccggcgatcctcaagccacgtcaccactgagtcgcttgcccgtggaacccatgggcaaccgtccactgctcctgcgctatgcgctgctggccatcggctggctaagcgtagcgctgggagtcatcggtattttcctgccggtactcccgaccacacccttcctgctactcgccgccgcctgcttcgctcgcagctccccgcgcttctaccactgg

SEQ ID NO: 492362 - DNA, 837 bp, Homo sapiens
  misc_feature (303)..(303): n is a, c, g, or t
  misc_feature (366)..(366): n is a, c, g, or t
  misc_feature (370)..(370): n is a, c, g, or t
  misc_feature (382)..(383): n is a, c, g, or t
  misc_feature (385)..(385): n is a, c, g, or t
  misc_feature (442)..(442): n is a, c, g, or t
  misc_feature (475)..(476): n is a, c, g, or t
  misc_feature (490)..(490): n is a, c, g, or t
  misc_feature (617)..(617): n is a, c, g, or t
  misc_feature (634)..(634): n is a, c, g, or t
gaataaaattttgttaaaatatgtgctcatctcctaagtagctcttcagagtctgaccgtaagtaaaaacacacagaatgtgttgactgggggaggtgaatcacaaaaaagttacgaggagtttaagagttaaatattatttgatcgtggctgtcaaatttagtgaacaacatagatggatttggagttggtagtaggtatggttctcataccagaattctcttaaaaaaaaaaaaagggacaatgggaatggccttatttattttaaaatcaaggcttactagtgggtaggattcccaggtnagcagcagggtggattaaataatctggacaaggagcagcggccatctggggggattcattcgngggnttttaaaatgtnncngtcttggatgctaccatccagggttcttatggtgaccttgtagcctattggtcctgngttctctaacatggggcagtcacgcagatggtnnaggtacttcacaantcacatggctctctgaccccaagcctagtcccttttacatcaccatcttctcagacttctgtgctattcttaaaatatgttggggggcaaggatggaattaggacatcaggttaagcaattcgtganggttaacgtgtgaagtncaggcataataaatttccctgatgtgtggtgtgtttaacagatgttcaaggtacttttatggagctccactgggagggagcggaagatgggcgggtaaaaccggattttgagggactgccgagcagacactatgttgttcaacaaaaaaaaatgcggggcaataaaaggggcgagaaaagagaagcagggaaaaggaggaagg

SEQ ID NO: 492363 - DNA, 157 bp, Homo sapiens
aggctccagcttaacgatatttggaggtcagcacggatactcacgtgtcgacggaacttgtaccagggaaggcatgcaccgcaatggtgaatacacgtcgaccaggctccatgttagcgtacttgggccctcagcacggatctcacgtgtcgaagga

SEQ ID NO: 492364 - DNA, 1172 bp, Homo sapiens
  misc_feature (610)..(610): n is a, c, g, or t
  misc_feature (732)..(732): n is a, c, g, or t
  misc_feature (1172)..(1172): n is a, c, g, or t
gagaaaaggcggttcctcttctccagtgccctccgttccctgtctctgcctctccctcccttcactcccaggcatcaacagcggagacttcgagggggagacgcagaagcggccgagacattgcctagagcgacgtgagactagaagcccatgcctatggtcacccctgtagaccccattctctatacttgtgctccatgtctggactatgggttgcttcatggctgacactaggagtcatgcaaatggagcgcggcatggcaactggtagggcgttcgatacggtagggacgataagaaagtagcctaagctagtagaacagaagcttccattgcatcttttaacgtaaccctaggaatgtcatgcttagtcgactagtagcgtaaataacagggacttggaagctggcgataagcgccgcaataggatggaacttgccgactgagtgggactggttcgtttacatctcactgaccgcggatggaatgtacgctaccatctgcgtgcgttattggaccgattggccgcagcgagaattaacaacaaaatgtccaacttggtctcaattgcatgcagggcctggaggggggtccacccatccgcatgaancgcatcatgaaacccttcaccaggactccctagttctccaagacgggagattccctctggcatcacttgtaccaaccttggtgtgctaggaatatccttgtgaagtgagaagtgaagggccncctctgggacggccccttgcaagtgcttgggtgctggcccttctgaaaaagacccatgtgtaggcggcgcgaattcaccgcattctccccaaggggcgcctaggaagaagcccttattcaatgccgaaggcggaacggactcttgcaaggtcccccccaggtcaagaagcggaagggaaccttgggttgcgaagttgggggaaagcgcccgtattctgtaccggccgtttcactcgtgagcctttccaattgtagaccggttaccccttctttgtggcctttccctgaggggctaggtcacctcggattattggaaactcttggggaccgaaaaaaccgggccagcgattgaagggccttggaggtaaccccccaaatgtcttcaattccccgaatgattggttccgttgtgggcgccatcccaataggggcccccgatn

SEQ ID NO: 492365 - DNA, 363 bp, Homo sapiens
agcatccttttcaatgctgggcactatcattttaaatcaattcggtaaaaaaaaaaaaaaaaagcaatccggttttaattttttaattcattagtaggggttatgtttaattcattattaagaagaagtgttatgtttattagccatttggaattcctttaattcgtggtaatttctcctgggctgggttagtggccggggtatataaatttttccatatttattgggtaagaagttctttatcttaatatggggaggccagctagcatttattggggcacttaccacggtgctaggaaaatggcaaagggtctgggccggtgcgcaggggctcaggcctggtaatcggggaaccgagctcga

SEQ ID NO: 492366 - DNA, 196 bp, Homo sapiens
cagatacaagcacagtactaccagtctatcagcgtgtgcaaagcgcctccataggtaccggcgatacacggtacagcacagacaccagcatggagcatgcagaggccttcctatgtaggagctacacataaagcagcctaggacatgggaacccgtgtggcaacatgtaggacataggaatgagccccaagggctc

SEQ ID NO: 492367 - DNA, 199 bp, Homo sapiens
gagccggccccatatctagcgtcttcatgagtcttcacgagtaaattagtatgacaaggacatcatgtgaccagtgtaattaaaacatctttagatatcagtgcagaaatgtacccctggcaccacttaaaacgtaagagcaggctcaacaacacgtagtgatggaaataagctagctccgctcaatgccatctataga

SEQ ID NO: 492368 - DNA, 921 bp, Homo sapiens
  misc_feature (909)..(909): n is a, c, g, or t
gacttccaggggatttaaagggctagcactcttttcctttgttttcattttttttcttttcccctttgtgttggagccagacattaaagactagtacattttaaagcagccacatatacatgggaaattagaaagtcaccgctcatacctagagaaagatgcaggctcacaaaagatgtgagaaggacttaactttacatctcaggcttatcctcagcacagagacaacctacaacaattcagaatgaaaaagcaaaccctggggaaggggaaggagaatctgattttcacagttatcacattattttatttcaatgtccggttttcaacaacaacaacaaaatcacagcacataaaaagaaacaggcaagtatggcacattcaaaggaaagaaaatgaaccaacgaggtctgtccctgaaaaagttataattgtggatctactagacaaagagtctaaaacaagtatcttaaagatgctcaaaaaataaaagatatggaaaaagtacaaaataaatgatgtatgaactaactagcaaatcaatacagagattcagaaaaagtcacacactagaacgagaaattttgcagttgaacagtataataactgaagtgaacaatccactggagatattcaaaggctatgcgaccggtaggagcaagagtccggcaactgagatcggacaggcaatctgagtctcggacgaacggaacacatcgaccacgcggaccaggcggggccctggagcgacacttcccacgtgaaatcaacctaaaaagcgaaacgcgcgtctggaactggcacgtcccatcggtgacatataagccagcgattcaagggagcagaccccagacactccggcagggacatactcggcgcccacacactatgatcgcacgtactaagtanagaaaactctcg

SEQ ID NO: 492369 - DNA, 1316 bp, Homo sapiens
gaggcaatagaggccgtatgtcgaacggttccgtggtgcagagtgtctgcgagtaaattccaggcgtgcgctcgctctgtctgcggtgtggaactgcataatgaatccgagtaaacggaagccatagaagtccacatacaggctgcccggagcgctactggaagtaggtcatcgcgccttgttcgattcctagcggtcgtgaggaacgaggtatagaggcgggcctgtaggccaggaggcatctggcccgtgggtgccgtgtgactactccctgtggacttgcgacctgaagtggtggagcccgagaggtgtcgctgtcagcaccagcgaagtcggttgagcgctggtcagggcatcggagttccagacttcgtcggctgtacagccaaattacgtacactgtgaagcgtagcctgcatcggacgggagtgcgaggcagctacgctgagttggagaattggtacttgcggtgttgccttgcgtacagggggttacccgggaattcctctgggcatgaaagctgggcgatgctcttgctctaggacagtaccaagtgtccggcccatacaattgaaccttggggataatcgatacggatgcgttcttggcagaggtaagaacggtgcaacctttggcccacatcttgaaacgcgaagtactttcacaccccttagacagatcaggttgcggaacaggtcagcggttaactacattaaaagtgcacgggtattttagttagcacactgcaccgcgatttagagcgggaatattgacaatagcaagtccgttgaaatattggcctagactattgaccggccgattatatacctttcccctcttgacaccacgaaacacacaacgatataaccctatttgacacatatcgccaatacgttccacagcaagtgcaggaagactcccttctcacatagagcgcatgtacttagtgaacccccaaccggtggaggtgttcccccaactatgaaactgtcttgcgagtatcaagtacgctctctaaaaattattctagttcacgcacctctatttgacactatattcagcatacgatatttcatattaacagccgagccccaatatgtcgatatggcgacaattatttgcgtttacatggatggcgataacattgcgcgtttggtgccctccactggccacatacctgtgggagaccaacctaaatgtagccacgacaaataggggacaccacaggacaccccgtcagtctatttgggaagagactacttggagtaagaggcaaagataaccacttacgccatatggttgaaatacacccctga

SEQ ID NO: 492370 - DNA, 248 bp, Homo sapiens
cgccctcacactggccccgagctctacccggttcaagcattgctgaccagtgcgcccttcgagcacggatgtcaacaccctgacccgcttcgtcactggcaggagggcacgtgaaggcccgcggcacgggcgagttgacccatctgctcaactcgctctgcacagcatgtctaagccatctcttcggcggtgcgcaaggtgggcatcgcgcccctctattgcattgctggttctaccagcgtgacagg

SEQ ID NO: 492371 - DNA, 274 bp, Homo sapiens
ctgccgttattcactcgccagaaagtgtgaactatgtgatctcaattgtttctttaaaattcaaaaatattggccaggcacagtggctcacgcctgtaatcccagcactttgggaggccgaggcaggcagatcacctgaggtcggtagttcaagaccagccagacgaacatggagaaaccttgtctctactaaaaatacaaaattagccggggtttcgccatgttggccaggctggtctagaactcctgacctcaggtgtccctactgcctcag

SEQ ID NO: 492372 - DNA, 676 bp, Homo sapiens
  misc_feature (6)..(7): n is a, c, g, or t
cgctannttatgtggtgaatcggacaggggcggaggcaaattggtgctcctcagctccgcttctccgaacatctgtggaccaggccccggggcaggcatcccagtgccctggttctcatcagcattgccttatcatcctcatccccctcaacgtctgctcttctaccgctctggtcctggaaaggacagccacacctttgagtcctggcacagctggcctggcaaggcaagttcccccagacggcacagagtggccgaatcctgggctgagaaacaattccacacgtgaggtgcacaatggaggcagatcctgcgggcctccgtggagctcctggatgagatgaagtcctcgctggagaagctgcaccaaggcatcacagtctcagaccctccctttgacacccagcccggcccgaggacagcttttcctgaggaccccggcacgcagctgttccccacatggacagatggacacaccgaggcctcggcggcaccgctggcacggtgtgagcgccagggcatcttcccaccggccctccgacggcgcaccaaggggctgtgcagacgtggggacacggaccgagatgcacttagaaccaggagctggccggctctggaggcccccactaacttatttgccggctgagttgggggggggctctggggtgccgatccc

SEQ ID NO: 492373 - DNA, 279 bp, Homo sapiens
tagactatgtcataactcttaggagtgagtggggcagtagaactatgtcatacttaggagtgtgtgggaaaggtagaactatgtcatacactcttaggagtgcgtgagacaggtagacactatgtcataactcttaggagtgagtggggcaggtagaactatgtcataactcttaggagtgagtgaggcaaggtagaactctgtcataactcttaggagtgagtggggcaggtagaactatgtcataacccttaggagtgagtgagacaggtagaacta

SEQ ID NO: 492374 - DNA, 103 bp, Homo sapiens
tttcccctttaccagcaaacctgacttccccatgtttattccctttgcctacaaccagttaaaatttgaggaacttatttccttcaataaaataattttaata

SEQ ID NO: 492375 - DNA, 573 bp, Homo sapiens
agggaatcctatcccatttcttgtttagtcaggtttgtcaaagatcagatagttgtagatgtgtgatattacttctgagggctctgttctgttccattggtctatatctctgtttgggtaccagtaccatgctgttttggttactgtagccttgtagtatagtttgaagtcaggtagcatgatgcctccagctttgttcttttggcttaggactgacttggcgatgtgggctcctttttggttccatatgaactttaaagtagttttttccaattctgtgaagaaagtcattggtagcttgatggggatggcgttgaatctataaattaccttgggcagtatggccattttcacgatattgattcttcctatccatgagcatggaatgttcttccatttgtttgtatcctcttttatttcattgagcagtggtttgtagttctccttgaagaggtccttcacatcccttgtaagtgggattcctggttttcatgacccttaggtgtggcctggggttgccaatgcgccaggtgagtgtcaagatattttttcagacattactgtctataatag

SEQ ID NO: 492376 - DNA, 370 bp, Homo sapiens
  misc_feature (20)..(20): n is a, c, g, or t
gaaaacatggccttaccaanatgaaatattgaccaggtgtcaatcccagagagacagagatatgggacctttcagaaagagagcttaaaatagctgttttgaggaaactcaaattcaaggtaacacagaggaggaactcagaatattatcagatacatttaacaaaggaattgaagtaagttaagagaatcaggcagaaattctcgagctgctgaatgcaattgacgtactgaagaatgcgtcacagtctgttagtagcagaactgatcaagcagaagaaagaattagtgagcttgaagacagactatttgaaaatacacagtcagaggagacaaaagaaaaaagaataaaaacgaatgaagcccaccta

SEQ ID NO: 492377 - DNA, 750 bp, Homo sapiens
ctcaaaattacacctttccccaaatcacccctatttcggtaataataaatagggcaacacagttaatttgcttttaaaacttataaaagaatgtttctctatagtttggcctcttctttaatatatacagagcccccacagagacagagagtgcaaataattctccgtcacacacaccccctctggagaaaagagatgtcttttgtgtttttctcacactgcggctttggttatatagagatagttgtttccccacccttcacataacaccccctactataaaatctgctaacacaaaagagaggccccccctttgtagaaactgccctctgttggtttctgctgagagagaaccacaacacatattctctatactctatagaagtgtgagaaggagacttgagtttgtaggagaaatgctgtcccccaatcccacattggagatgcacttcaccccacacttatcacaattgctgcgtcatttttggtgagctactatggagatgtccaaatatttttgaacaataatgggaagcccctttgtccccccaagaatgagtactaggggatcaatggtgcttttaaaaaaggaaagagctacgatgactgggccagaaagaaaagaatggggaactggtattaacccacttgatccagcatcactgggaaatggggacgaattccgccggaggccccgggggataccccccaatacattggtttccaccaaattaagtttttccttcccca

SEQ ID NO: 492378 - DNA, 133 bp, Homo sapiens
tctagaggatcaccaatgcagcggaatcggggaacggaagaagggaaagagcaaaagacaaaaagaggtcagagaatccaagtgttagaggagaacaaaggattcagtatatatacatgatctacaaactcgc

SEQ ID NO: 492379 - DNA, 945 bp, Homo sapiens
gagtctgtgatctgccatggatcgggaaggaactgtgggtgtgtgggtgtatgtgtgtgtgtatgtgtgtggcgcgctgtggtgagtagtatgtgcgcgcgggtagtgtggtgggacaaggtgggtgggggcgcagggtgagtgagagtgcaactcttggtgctcgcattgatatgtcgtcgttactgttctctactcacaaggtatctggtggtggcagtgggacgttaatagtgggttgctttactttgaatttctaaatctgttaaaaatgtgggcgtggagcgggtatgggcggagggcaaagaaacggacaataaggagagtaggaagcgagacgagcacggatgttggggtaccatggacgtctgactgaatagtgataataactgggagttaagtgaaagagattaccacctggcagggaggttggacaacgaggtaagatcattgcatgaagtcagtgtgtgtgtcaactgggaggacttagatgggccatgaaggatattgtactaagaagtaagagtctatgagtaatggttgaatgtcggtaagtacgtttggttgtcacgcggttttcctaagatttatgaaactgttgaaaatttgacgctagtgataattttaacttatgggggcttgggaggttcatggtagatggctgttcaatatttaacctacatcaattgaggggacaactggcgagctaggatgagaagtctcgcggtatattgaccgtggaacgtttggtggaacaagcgtgagtaggaaggagggaattgcgaccccataaaggttgcgagggaaaggcgatgagacgacaaagtgtaataaaaggcatgggacgctgtggaaaaaaataataggcgtcggataacgggggaaggagattgtataagtaaacgcttactattgttgtgagcgtgttctattatgtgggggaaa

SEQ ID NO: 492380 - DNA, 340 bp, Homo sapiens
cgggctccgtgatatcaggagctctctcagcccacactatcctccagacgcaaacgagatgactcagacgttccctggagcaacttctccttataactccgagaactgtatctcaaggtccagcatctcactgacacactcgactgcggcgtcgctcatagtcctcatcataccatctcggagctctcctcttctgactctgtctggctgccgctccgatcctcctcactctcttcctcctccccattcatctcagcagcagaatcaccctctgcttccatctcttctgtgtctaagctaggaggctggacaggcatctggactcgcggggacttgtacg

SEQ ID NO: 492381 - DNA, 1215 bp, Homo sapiens
ctagagtgacaaggtgaattactggacggtgaccattcctcttgctccctgtatattgcacgaccctttgttgcctccctggagactttgtctgtgtctccttcgcatgagagtgagttctccttataggtactcccctgtgtcagagacgtctctctttgtgcaacccgcgggtttattctttttaggcgctctccctcccccaggttcaaccaccctgggtggaaagtttttatctccccgggttttccttcctccccccggaggtttctcccagagtggaacccctttgtcaaccttgagccccttggtgataacgcaaatgtttttttctggtgcaacaaggattcccggggcaaaagtgctccaggattttctttttccctatatggacacaggccccctttggccccaggaaacacttggacgatatgggcccacggaacctgagaagtgaccaaagcctggagatggagaagccaagagggaccccaagcgggtcaatccccagaagttcaccttggaggtccctacacgcccttcaaaccatgaaaaagccacctctgttcgaaagattgggaaacttttcaaaggccaaagatcttaaccgattgagggaccaacaccaggagattttctggaacaaagtagttaatcgaaattataccacttgggctctgattaagaatacagagctggctggagaaaggaagaacatttgtaacaatcccaccggaaagaagactggagaaaaattttccaacaccccatcgatccaccctaactgttacccggagatgcccgggaggccatatcccagaggagaggaatagtccctcgggggatattcctcggtggttggagactcctctccctctctggtggtgctcttcctccagggcccccacccatatgcaagaaggttgatattaagacccaacccagatgttagaatagcttagcctatgtgtgcccaccaccatttaaaaccactttgaaggagcctctaaattcgctagcacaattctcgtggcacgctttttaaaacgttaaagctgctactagtaagttatctcgggcactttttacataacttgaaatactggaaacacataatgcacccggggagaagaaatcaaccttgcacctttataaaccctgtattgtaagtgggaaaagccaatgttttaaataaaaactattttaaaattggga

SEQ ID NO: 492382 - DNA, 140 bp, Homo sapiens
ctcactctgtcactgaggttggagtgaagccttgaactcctgcactcaagtgatcctaccaagtagctgggactagaggaatgtgctgttttttgttttttttagagacagggtcttgctgtgttgcaaaggctagtctc

SEQ ID NO: 492383 - DNA, 1188 bp, Homo sapiens
taacatcaaggtatcacaaggtttattggatagatacaagttattataaaatcagggcatgaacatgacctggataaattaaggtaagactttaatttctcaattacttatataattagggaggggaccaatttcaaattctcctcaccatttggttctcacacccacaaaaaccactttcaaggggctttaacgagatcttctcaaaacggactcagtttgggtgccaagttaacaccgagtgtgttccttttataaaagagaactgtggtgccacttgtgcccgaggcgctcagaggggattattaaaaactcttgagccacaattaaagcccaatttatataggaggtagaaacatacgggcgaatatcactatattacacgggcgaaacaaaccctatcatatctcacggagttaaaaaatattcttctctgtgtgacacaacacccaatatgggtataaactcccaatattatttggcgcaacacactcccagatgtttttacactggggacgcaaagaggggctattctctatacaaggtattctcaggggttgcgcgatattctcaggttcttcataacttttaaaaacacgcctatatgtgatataaccggtgggcacgccacaacagaaggggcgccctgtgcgaaataagaactggcgcctctgttgctgtgaagaacacctttatgtgacgcggtgacatataattggggcagtggcgtggctcaaattatatacttatttcttaaaacgctttttacagaggataactctcccgttagagaactctatttcgcgggagcgcgcgcacacagctctattgcgcattcagacgcactcttttaccgctttaccaaagataaataagcccttttattggccgcgacagggggaaaatccctcaaatggggaacggtgacagatcccagggcggttttaactaattgttggggggcaacaacccctattttcaaggggggagaaggaaaatatttcgccaagaggacggtcagtgcccacacatggacgcggtacactctctcaggcagccccgcgtagtgttttttcgccacaactctgaagggcacgtgagggggggcgacctcatataacaacacagacgctacacccacggagtatccttgttctcttcacagaggagcttacaccacgggtgagc

SEQ ID NO: 492384 - DNA, 795 bp, Homo sapiens
  misc_feature (6)..(6): n is a, c, g, or t
  misc_feature (74)..(74): n is a, c, g, or t
  misc_feature (90)..(91): n is a, c, g, or t
  misc_feature (98)..(98): n is a, c, g, or t
  misc_feature (102)..(102): n is a, c, g, or t
  misc_feature (109)..(109): n is a, c, g, or t
  misc_feature (127)..(127): n is a, c, g, or t
  misc_feature (132)..(132): n is a, c, g, or t
  misc_feature (135)..(135): n is a, c, g, or t
  misc_feature (142)..(142): n is a, c, g, or t
  misc_feature (147)..(148): n is a, c, g, or t
  misc_feature (151)..(151): n is a, c, g, or t
  misc_feature (153)..(153): n is a, c, g, or t
  misc_feature (163)..(163): n is a, c, g, or t
  misc_feature (166)..(166): n is a, c, g, or t
  misc_feature (178)..(178): n is a, c, g, or t
  misc_feature (269)..(269): n is a, c, g, or t
  misc_feature (303)..(303): n is a, c, g, or t
  misc_feature (319)..(319): n is a, c, g, or t
  misc_feature (336)..(336): n is a, c, g, or t
  misc_feature (361)..(361): n is a, c, g, or t
  misc_feature (373)..(373): n is a, c, g, or t
  misc_feature (410)..(410): n is a, c, g, or t
  misc_feature (419)..(419): n is a, c, g, or t
  misc_feature (432)..(432): n is a, c, g, or t
  misc_feature (449)..(449): n is a, c, g, or t
  misc_feature (457)..(457): n is a, c, g, or t
  misc_feature (527)..(527): n is a, c, g, or t
  misc_feature (534)..(534): n is a, c, g, or t
  misc_feature (540)..(540): n is a, c, g, or t
  misc_feature (549)..(549): n is a, c, g, or t
  misc_feature (554)..(554): n is a, c, g, or t
  misc_feature (576)..(576): n is a, c, g, or t
  misc_feature (768)..(768): n is a, c, g, or t
tcagtnttatacacaacctcccgtgtgcattaacatccccataggcccccaccttgatcagcttggagaaagtntcatagatgaagatgnnggaaatntggnaggagangatctcctgggtattgtnggggntgnggggggncgggnnggnancctggggggnganggcgaagaccancgggggggtgggggaggggggggtggagagggggggcaggatgtactctagaccgttggtttcgcagaatgtgagggggggttcctcaaanatcagcgggggttctgggaggggggggagaaggngggggtgagccccagnagggggaagagaatgcnctgcactgaagtggagattaggagntccgagacttcnatgtggttccgggtgttttctcccaggaggccgccgnggtggtggngggtgagggtggnggggagttggtgaggangggggggngagggggtgggggctgaatgcatctgtgatgttacttaggtaataggggtagcggcgccggatattacgnaccaggnccccgnagagctggnctgtntgctgcagagggttatctgggnccccatttaagtctaggcccttgtagaagctggagtctggcttggcagggctggactgatagcgccttcgaagtagctccctctgcacaggcaccagactgagcagtgcctgctcggagggggcatcggtgggaggcagcactaggctgcagtccaggaagccctctagggagtgcagcagctcccctcggntctgagccatgtaggcatctatgcgga

SEQ ID NO: 492385 - DNA, 659 bp, Homo sapiens
  misc_feature (101)..(101): n is a, c, g, or t
  misc_feature (555)..(555): n is a, c, g, or t
  misc_feature (604)..(604): n is a, c, g, or t
tttcagtggttagagatgtaaaccaaaaataaaattctaagcccccaatcaactgaatggatcctcttgttgtccaaggggattccaaagaaccccgaaanacttgctcaggccatgacaggaatggaaaggtcggtcatggcttgtttgtactcttcttgctttggagttcaggcacaaaactgagcagcattaacattaaaatagagattagaagactgacaaaacagactctttgtagcactaagataacaaataccaccctgattgtagtatagcatcacatgacagatagcaggccctgtaagaaatcaaagcattttaccccatatttaacatgttttgaaatggcccttcagggttatctcttgtgggagaagtttacattctgaatagaatcacagtcccattcctttcccagctgtttttctgatcctgaagagattagctgggagtccaataccttttaaagatttaataggagaaacagttgccatctatgcctctgaagatgaccacttaactctttcagctaatgcaccagaaatctttgantccacctatgacctggaagccccctttgctttgagatgccccgcctttntggacagaaccagtgtatacctcacatatattgattcatgtcgtatgtatccctg

SEQ ID NO: 492386 - DNA, 241 bp, Homo sapiens
actagaggaccccggtacgagcggtcgttacacagctcttggcaaggcgtatcttaacccactaactaaggcaggatcaaacctgtgtcctcatgaatcctactcagattcgtttcccctgagccatgatgggaactccctgattcttttttaattgaaatatagttaacctataatactatattagtttcaggtatattacatagtgatttgacatttgcatgcattatgaatcagaccg

SEQ ID NO: 492387 - DNA, 415 bp, Homo sapiens
ccccgcctggatctcaagatcccattgtttaagaaaattacactgtacagcgttaaatatattttggatctcacacttgagtgtaacttaatctacccgattcagaacttttgtagagtgctctcggagttcctacttttgaaatatcattttccatttttattctgtagagtaacatattttctatatttattatatatcacagagactttctgaagcataaccctgattgactctagagtcttttcctagttctgttttctctcagaacctggatttatttggaggtgggtggggcgcgtggtccttggctctatctgtggtgatgcctcataatgagattgcctgagcgcttaccgcatttgaaggctcgtagagattccgtggtctggatgcttgtttgagtctgtctgga

SEQ ID NO: 492388 - DNA, 151 bp, Homo sapiens
cttacacgaagaggacacaggcaacaacggaaagaatccatagaaaacaggatttcatagaaaattttaaaaatcttgtgcatagccatggctatggtggcatgtgccttgtaaccccatgctacttagggactacatggcattgcgccac

SEQ ID NO: 492389 - DNA, 712 bp, Homo sapiens
  misc_feature (135)..(135): n is a, c, g, or t
  misc_feature (159)..(159): n is a, c, g, or t
  misc_feature (180)..(180): n is a, c, g, or t
  misc_feature (226)..(226): n is a, c, g, or t
  misc_feature (232)..(232): n is a, c, g, or t
  misc_feature (235)..(235): n is a, c, g, or t
  misc_feature (238)..(238): n is a, c, g, or t
  misc_feature (243)..(243): n is a, c, g, or t
  misc_feature (247)..(247): n is a, c, g, or t
  misc_feature (258)..(258): n is a, c, g, or t
  misc_feature (265)..(265): n is a, c, g, or t
  misc_feature (268)..(269): n is a, c, g, or t
  misc_feature (273)..(273): n is a, c, g, or t
  misc_feature (283)..(283): n is a, c, g, or t
  misc_feature (304)..(304): n is a, c, g, or t
  misc_feature (308)..(308): n is a, c, g, or t
  misc_feature (312)..(312): n is a, c, g, or t
  misc_feature (322)..(322): n is a, c, g, or t
  misc_feature (325)..(325): n is a, c, g, or t
  misc_feature (331)..(331): n is a, c, g, or t
  misc_feature (334)..(334): n is a, c, g, or t
  misc_feature (342)..(342): n is a, c, g, or t
  misc_feature (349)..(349): n is a, c, g, or t
  misc_feature (384)..(384): n is a, c, g, or t
  misc_feature (386)..(386): n is a, c, g, or t
  misc_feature (388)..(388): n is a, c, g, or t
  misc_feature (390)..(390): n is a, c, g, or t
  misc_feature (406)..(407): n is a, c, g, or t
  misc_feature (410)..(410): n is a, c, g, or t
  misc_feature (425)..(425): n is a, c, g, or t
  misc_feature (429)..(429): n is a, c, g, or t
  misc_feature (438)..(440): n is a, c, g, or t
  misc_feature (451)..(451): n is a, c, g, or t
  misc_feature (463)..(463): n is a, c, g, or t
  misc_feature (466)..(466): n is a, c, g, or t
  misc_feature (470)..(470): n is a, c, g, or t
  misc_feature (483)..(483): n is a, c, g, or t
gttacctgaaaaagggctacctgaccctgtcagacagtggggacaaggtggccgtggaatgggacaaagaccatggggtcctggagtcccacctggcggagaaggggagaggcatggagctatccgacctgatgntttcaatgggaaactctactccgnggatgaccggacgggggtcgnctaccagatcgaaggcagcaaagccgtgccctgggtgattctgtcngacggnganggnaccgngganaaaggcttcanggccgantgnntggnagtgaaggangagcgtctgtacgtgggcggnctgngcanggagtggacnacnactacnggngatgtggngaacganaacccggagtgggtgaaggtggtgggctacaaggncngngnggaccacgagaactgnntgnccaactacaacgccntgcnggctgctgnnngcatccagccnccaggctacctnatncatnagtctgcctgctngagtgacacgctgcagcgctggttcttcctgaccgccgagccagcaggagcgctacagggagaaggacgacgagcgcaagggcgccaaccctggctgctgagcgctcccctgacttcggcgacatcgctgtgagacacgctcggggcggggtcccaatcaggctcctcgtccttcaacgttcatccccaaaccgacgaccagatccatgtggcctacaatccgaggaga

SEQ ID NO: 492390 - DNA, 338 bp, Homo sapiens
  misc_feature (28)..(28): n is a, c, g, or t
  misc_feature (42)..(42): n is a, c, g, or t
  misc_feature (80)..(80): n is a, c, g, or t
  misc_feature (176)..(176): n is a, c, g, or t
  misc_feature (203)..(203): n is a, c, g, or t
  misc_feature (214)..(214): n is a, c, g, or t
catatatatctttttaaaatctttgttnttgatgaccttaanttgtgttaatagggctggtgtgatggctcacacctgtnttcccagcactttggcctaggcaggaggatgcttgagcccaggagtttgagaccagcctggacaacatagtgagaccccggctctacatatatatntttttttatttagctgggcgtggtggnttgtgcctgtngtcacagctactcaggtggctgaggtggcaggattgcttgagcccaggagttcgaggctgcagtagtgagctatgattgcaccactgtactccagcctagatgacagagtgaccctgtttctct

SEQ ID NO: 492391 - DNA, 406 bp, Homo sapiens
atcaacatgtggtacctaatgtagtagtcaaatttaaggctgtcgaggacaatttcaacacttccagcaggtgactatatcaggaaggagcaaaaccaagtgcttcctgcttcaccttctgctgcttttgggacttttctagagctagtagctaaggacaagaccctgcaacccattttttcactggcgagaggaaaaccaccaggcttctcagctatggcttggcaactctggagttcctatggcttccatcagggctccaggccctgataagtggcctcaggcaggcggcgactcgggagcggatgggagagctagtcaggaaggtggaatcgggaccatccccaaacacgttggcgtatgatgatttgcggacctggacgtagttctgcatgctgcgatcggt

SEQ ID NO: 492392 - DNA, 246 bp, Homo sapiens
aggatcccccggtcagactctcctctgcactcaatggaaacgatgtggtgtcgggtaccatggcaggccagcacacggggctcccggcagagaagggaatcggacggcttgaggaactcctgcgccgagcccaggatgacattgcagtcacggtcagtgcagaggaagcagccgaccagtgtccgtccatctgtcatgcgaatgcgcatagtcttgctgagcgcgcccgacagcagctagaggcgc

SEQ ID NO: 492393 - DNA, 106 bp, Homo sapiens
tcgaatgcgaattcctggatcgggtggcaccaagcgtcaaggcgggccacatcgatgatggcaggacggagagtgtctatggttggttttgtatccaatcactgta

SEQ ID NO: 492394 - DNA, 825 bp, Homo sapiens
ctgtaactctgtcagatgaatggacagaacacaaagcattttctcagaaatcttttttccagtttttaactgaagatattccctttttcaccatagccctctattggcttccaaatatcaccttacaaattccacaaagcattcttagcgaaagcttccgagaaacggcattgtgttctcttaattcatctcacggaattgtagctttcccctcaagaagccgatcactaagactgttcttgtggaattcgcaaattgatatttggaagcccatagaggtctatggtgcaaaaggaaatatcctaagagaaaaactgaaaagaatctttctgggaaactgctttgtgttctgtggattcatttcacagagttacagctttctcctcaagaagccttttgcaaaggctgtttcttgtggcatttgcaaagtggtatttggaagcccatcaagggctagggtgaaaaaggaaatatcttccgttaaaacctggaaagaagcttctgagaacctgctttgtgttctgttaattcatctcacagagttacagctttcccctcaagaagccgtttattacggctgttcttgtggaatttgcaaggtgatatttggaagcccagagagggctatggtgaaaaaggaaacatcctatgataaaaactggaaagaagctttctgcgaaactgctttgtgttctgttaattcatctcacagaattacagctttcccttcaagaagcctctgcctaagactgttgttgtggaattttcaaagtgatattttaaagcccttagagagctatggtgaaaaaggaaatatcctataaa

SEQ ID NO: 492395 - DNA, 424 bp, Homo sapiens
  misc_feature (13)..(13): n is a, c, g, or t
  misc_feature (383)..(383): n is a, c, g, or t
gtcgacacggctncgagaagacgacagaggggaaggggccctggtgggatccgtcctcagttccagaaggcagggaacccctcaatttcctagcaattctcttattactcccagaatcggtatactttatatcaatatagaggctggggccggtgtggtggttcacactgtaattccagcactttgggaggctgaggtgggcggatcactgaggtcaggagttcgagaccagcctggccaacatggtgaaaccctgtctctactaaaaatacaaaaattagccaggcgtggtggcgtgcacctgtagtcccagactcaggaggctgaggcagcagaattgcttgaacccaggaggcggaagttacagtgagccaagatcatgnccattgcattccagcctgggtgacaagtgaaactccgtctc

SEQ ID NO: 492396 - DNA, 388 bp, Homo sapiens
tgaagtatgttactactctcaatatacaatcttcatcaggttagtatacatagctggttcacagaatactaaaaatcctgattcatcgactcatatcaaccttaggagtcctttgctgcttgacaaaaatgccagaagcttacatatgctctatcattaccaatacatatcacttatttatataaacttcataaaaaccatttgcgtacagaatgttatttctgtcatattcatgccttgattaatttatactgataggagaaaagtggtcgtgacatttagtttttggttggagtgtaggcttctcaaggttccatgagggactttgtgtgcattagtttgatgtggttgcagtggtgacacgaatctgtacatgtatatacaagag

SEQ ID NO: 492397 - DNA, 424 bp, Homo sapiens
agtccctgagggacacctattggcattgcaattgggtccaaagtgtagtcgacccagctatagagagtggccggaagtcatcggctcatcagcgctatcagggcatccggctcatacagcttggcgttcactgcgacctcatgctcatcatctcgtacagtctgtaccaagtgccgaagcagcatctcgtctatcagtgagcgcatcagctcggcccagtcctggatgcgctcctgatgcgactgaccgagacactcagtccacacgagtcggtccgcactcggccctgttccaccagggtcgccaggcgctctcggatggtcattagtccgcgctatgcgccctagcgggcctcggcctggtacactagcaggagcttatgcaggtcatcggcatcgcggaggaaccgcttacgcagcatgcg

SEQ ID NO: 492398 - DNA, 1914 bp, Homo sapiens
tggccttctagttttgtgtttgcggcgtcttctcttctctcgttgtctagtttctgctgcttgccgcgtccgcctcctggttggggttgggttgttgttgtgtgccgcttgcctgccgtgcaccgcctgttgggtttgttgccttctcgcgcggccggtggtcagctcgtcttgcccgtggtgtgtgtgtcgtcgctgcgtgggggggctgcatcgatccttgtggtttcggacagcgctgtcgctgtttttatggacgtcctggtgtgctgctggtgcgtaatgctccgggtgtggtttgtctgccctggcgctggacgctctgcgtccgtactagcggtcttgcgtgtgggctttactaactctgtctgtattggtggctccgctacccgtggcttttgttcgtgccgcttctcgtggcgtgctcctcgccctccgcgtttgtttgtatattatcttgcgggctggaccgtgtagttgatctttggttgtgtgtggtgggcggcccgccccccccccccccgtttggttctgctgtgggggggggtggttgatatgttgggtggagtggttcgtcttttgttggtgggggtgttgatcctaaccacattcgctcctctctgcggagggtggggggtggtacagaagatgttattgctcgccctccccccgttctgttgtgagtcgacatcccgtttgtgtgtgttcgccccccggcaggttgttcttcgcttccgtcggggttggagttggtccttcgcgccgctcgtcgtcctggttctcctttctttgggtgtggggggcgtcgtctcttccttctactatgtggtgcgcgcagcgcgcgccgcggtgagtagctcaccgctcctcagggagttgtttccgtcggccgcccccaccacatgggtgtcgtgtaggggttgttgtccaccccaccacgtgtgagtcgccgctgtgggggtgtgttctctctccacgcccgttcccactccttggtggcgtgctcctcctgcgcgcccctctgtggggccccgcctgaaacattgggcgtgtgggttgtgaaacttctcgccttcctcgtgtgtgcccctcactcaagaaacacatacacgatcataatgagttagggagattggggagggatgcgctccacatgaggggcgctacaacatgacaggtattatgtgcgcgcacgaatcactgcgcgcacatcgtgttgacactcgcagaccacacactcgtgtgcacacacagcacgtggcgccacatctcatcatggtagacggatacgatgtggtagcccacggcgtagatgtatatgtgcgcgcctctcttgtgtggtgtcccacagcacgcaccttgtgacagaaatactctcaccgccacaaccctctgtgtgggagacgcccccaacacagtgcttcacagagaggagggagtactctccgccctggtgatggggccccacagcagagaagcgtttgtgtgtggaggagaagacgctcccttcttcgtcctccttgtggtgttcgtacgacacactataaattcggcgcagcagagctgctctcaccccggctgttgtcgtaccccacaaccacaccagcagatacacaacagatgatacgcgcacaagggtgtacatgcaccgcaccgctccattgtgtagtgtgcgagtatatgtccacctcgtctgtggggtcccacgcgctactctctgtgagcacatgggcatagaagagagttcgtggagcgcgcgcctccgcgccatgagagctcgcttataggaggatgttcacacagggatttcaccatgaggactcagtgtcacattgcgggcgcacacaggtcacgcattccgcgccctcgcgggcgaccacgcagcccaagacaccccattgtccagaaaaaaac

SEQ ID NO: 492399 - DNA, 847 bp, Homo sapiens
tacatggttgaaaaaatttacccacaaatacctgatcacctgaaagtaaccattacttagaagccactgacaattctcatctgaggtccatgccagcaagcttccttcctccttcatcagtgaagaaacggaggtgtacttccttattgggagactgccagtatgaatatagaggctaatccgacattcactggtggagggaatgacatgtatgcgtttcaaagcatatacaaacgtcatggcagagcaaattgcgtaatagtggtatcccctgaccgttatatgagtagatgccatgcctattggtcgaggccataaaatgatcaattttacattggggcagagaaataacgatctcataaccttttgtccgtgaattatcctgtgctcaggctctatatgaagttatttatcatgccacagagtgatgccctgcatcaatataagaaaagccgtgtattcctttatttcaaacctttggtggcgaatgttgtagcgggtccatgtgtgggctgcttgcttgtattgtgctcctgaaccctctagttttaattggcacacattgcttatgctgtagcaaatctatgccgtgtatttgatgtgcttaaagtcaaggaaaccttggattgacaaaaactcgagccccttctcagtagttggttgctgtagtgtacaaagcgtgttcctgtaatatgtcgctctaatgaactcagaacgtggagtatatggtccataaagacttaaggcggaccatttgtgactgaatactggggacctaaccagtcctagagcacattgggagaagatatatatagaaaatacaatcaatataaaggaaatcatggac

SEQ ID NO: 492400 - DNA, 551 bp, Homo sapiens
  misc_feature (9)..(9): n is a, c, g, or t
  misc_feature (37)..(37): n is a, c, g, or t
  misc_feature (44)..(44): n is a, c, g, or t
  misc_feature (70)..(70): n is a, c, g, or t
  misc_feature (76)..(76): n is a, c, g, or t
  misc_feature (78)..(79): n is a, c, g, or t
  misc_feature (88)..(88): n is a, c, g, or t
  misc_feature (338)..(338): n is a, c, g, or t
  misc_feature (354)..(354): n is a, c, g, or t
  misc_feature (382)..(382): n is a, c, g, or t
  misc_feature (422)..(422): n is a, c, g, or t
  misc_feature (447)..(447): n is a, c, g, or t
  misc_feature (482)..(482): n is a, c, g, or t
  misc_feature (497)..(497): n is a, c, g, or t
  misc_feature (510)..(510): n is a, c, g, or t
  misc_feature (549)..(549): n is a, c, g, or t
cttttaagnaaataaaaagacaaaaccatgcacgtgnactgagnaccgtgtgtgtgaccgcagacaaagngccagngnntggtatggnatccagaagccccttcggtgcagctgttctgcattcttccaaggcactttacagataccttggaatgtatatttttgtcttcttactcagaaggtttgcagtttgtaaaataatcaggattctgctctgtcctgtgtgtggggtcagctccctccacagaggggctccagctctgttggtcacagctgatggggttctctgattgatagggagacgagctcttgagctctaaggaacagtgaggtcgccngttgggagctttgctngggacaccaagcaaatgcatcgtatgtncccttggagacgtttttatgcagctgtgtatgttactatncagaaggagtcgggggtagactttnccgtgtaagctcagtccataaactggttacttctnatcctgggacgtggnctttacattatanggcttggatctgtttctgttgggtcacaggtaggaaatntc

SEQ ID NO: 492401 - DNA, 650 bp, Homo sapiens
  misc_feature (617)..(617): n is a, c, g, or t
ctgcttcacacatttccactttataatggcatttccagaactgaacttcattaagtctttcctaccctaggcaagatgagtagttgactctcattaaatgtttgttgtatttttatcttgagtctaccaacaggagagcaaagatagtacagcatgatcaatttttaagaaaaaataaataaataaaactggacctaggccaggcatggtggctcacacctgtaatcccaggactttgggaggccaaggtgagaggaactcaaggatctctggactctaggagtttgagaccagtctgggcaatgagactcctgtctctatttttaaaaaattaataaattaattatttttaaaaaataaaaaaactagacctagtgaaataaaaggaaatgagttaaaaggataaatcattaacttcgtaatttaaaactgctaggttttttttaaatttttatttattttttcactctcactttgtagcccaaggctggagtgcccctgcccaaatttaggttcactgcaacctttgcctaacagttcaagccattttcctgcctcagctccggagtagctgggattaccaggccttggcacccaacctggattttcctgatttnttagggatgggtttttccatgtttgccggctgg

SEQ ID NO: 492402 - DNA, 207 bp, Homo sapiens
cagaagtactgccgggagagtgccgggctctcaggaagcagcaggcacgtgccacggtggaagccagctgcatgcgcagtgtgacggaaggaggcccttactctctccttcttgttccatgggcaccatactacgtgcacgcctgcagcctttgcgctgctcgctccacgcaagacggtcgtactcccttggccgagttcgtcccag

SEQ ID NO: 492403 - DNA, 857 bp, Homo sapiens
tccacactgaaaattccattgtttagtgtagccaccttcggtcaatgatcttagctagattttcttgataacttgtgcttctctatcagtatttgctgcttcaccttgtacttttatgttatggagagggcttcttttcttaaacctcatgaactaacttctagcttcaaacttttcttctgtggcttccttacttgctcagccttcatagaatggaagacagctaggatgttgatctggattgggcttggccgaagggaatgtgtggctggtttgatcttctgttccgactactaaaactgtctctatatcagcaataaggctgtttaactttcttacccttgtgtgttcactggagtagcgtttttaatttctttcaagaatttttcttttgcattcacaacttggctgttggcacaagaggcctagctatagatggcctgtcttggctttcaactaagcttaatcatttctttttttttttttatttttagggtctttggagaaagtgtcttccgcttgtgtggcccaggactggagtgcaagggcgtgaccctcgggccccactgaaacctcgcgacctccccaggtttcagagagatacctccgtgcatcagcctcctgagtagacggggatcaaaggtgcactgcaccaccggccccgggtaaatttgacaggatacaaccagaagacaagggtacgggccgagtggggccaaggcggactagacacggaacatcaagcgaatgggccaagccggggcacccattaacgtgcggaaaataatggattcgagccccacgacctgagcttcaagagtaaccgtacgagcatgacgaaaaaaaggaaagaacaa

SEQ ID NO: 492404 - DNA, 1035 bp, Homo sapiens
ccatgatctaggtgtgacgtgggacactatgttcgtgatcgctaggttgaagagtcatgaccaggatctgttgatgccacctatatggtttaggttttccattataggctcgagaagtgaggcttgacaggccacctcggagaggagtttcgtcatcacgtgtgtgttagccgagcggggatggggccaatttgctcgtgaacgctgagcatggaagtagaggtagagagagaggtgcacaactggagcaaaggaaagcggtgtaggatgatatagctcgtggactcgagttaggccagtgcagtacacgttggtcaggtggtcgactgcaagctggaccttttcgacactgccagacatgcagcgaaagggaaagcgttcctgtacgccccctacaagcggccaggacgcaggctggtagagcccgtaatccgtcgattcgtgggactcgctactgaaggagacgtgtacgcgcgtgcaggacgctcgaggtggtcacgcttcgcatgcatcgggatgcgtgtcggtcttggcggtcgcacggtgctggcattggctggccgtcggtgagatatggcgggggcgtgcgctcggttcccagtcttgcgacgaaaggacttcctctgtgctccacgtggatcgttggttgcacgaggctcctagagtgtctggaaccccgaagggggctccgtgctgtgtggccccggcgtccctcggaggtcaaccacccttttgccttcgggggtgtggtggcggcacgaagatcggttatgtggtagcacggcgttttgggcccgggccactgggtgccacttgggccgcgcttatccgtcgatgttgtccaagtttggtcctccccaagtgggcggagttgtccccggcgtcgccgtgttgtatgtgcgtgtaccgcaacgactcaactggtgtgggacacgtgcgcgggcaagggtggcattgtaggggtaacgggtgggggtggcgtgtggacttggttgggacgctttttggtggggtggtggtagccagatggtgtag

SEQ ID NO: 492405 - DNA, 736 bp, Homo sapiens
atgttggttacattaatactaactaagagttcattcatttggattatggtgaagttggttaattaatggttctcttagtgaggttcctaggtatctcgtaatacgatgaattggggataattacatttagttgacagtctggcgttagccgatctgggtggtgatggccattatggagagtttcgatgtgtcattagatggatttagataggtggagaggagtataggtcagggtattaagtaggaatgtccctgagtttgggtatgtctgatgttttcttcatggttagactgggattatgggttagggggaggagagtcacagagataaagtgccgctctcattgcatcatatcaaggggaaatactatcagtacggcttatcactgatatcgttaacctcggtcaccaggctgagctagtgtatgccaggtttctttactggtatagttttcccgtactcgtctttctggaaacaagtcattaatcgtagagcacactcagtaggtctgttctccttacaggggagctgtctataaaattatctggaattcttctgctatggatagtcttttatttcttctccgttatatatttattcaagtcatttcatccatatactgcctggacctcatagcatcggccattgactacctcggggttcactaatcctataccacctttcattcattagggtgggcccaaacttctcctagccaacaggacatagaccagt

SEQ ID NO: 492406 - DNA, 929 bp, Homo sapiens
agcggactgctgccgtcgccgccaccgaagcaggtcacagcccctcgaggcgacaggggccccgccgaaccagagcagtggtacaggcatggatgggcaagaacatgcagcgtatggcatgttcctacctcttgtatgtactttgtttacttacagctggactgtggatagtatacttcatagctgtggacagcatgacaacaaacttttaccattaaattcatgctgaaaggaaacctggtgtgaagcatgcaccatatataagcattgcaggtgatgatcctcctgcaaggctgatgtgtaaaagtcaagttatgaacatggcagccttcctagccctttgtggtacgctgtgactgcagctatcatagcaatttgaaaaccgaagaggcttctaaaaccccgtgcgctgcaatatcacagttgccatcggtgcgctcctgtgctcatgggcattcccattcgcaaaatgacccttacctgtgggtacacttcacaccacgcgttcaacaagattgagtgcaacaacacatcccattaaaccggtctgtgcacactatcactgtgaaccccattctgagaaatctcaggagcaaccaattagaccccgtgacatgacattaccaagtgaccttgcgcctagcaccacaccatctcaaagcggtgtcacacccaattcccaacgaaaacttcccacctgggggtcagagagaacaactactcctggaggacatgctacccaagcatgcgcagtgctacttacccaagcgtcacgggcccattcactaactccgaacctgtcctttcacaggaggttggtggtatccactacctaatactttaccattcacctatacagagtggcccccaaaaacggcaacgttaccacccattagttcattcgccagcaaccggggggagtcccccag

SEQ ID NO: 492407 - DNA, 162 bp, Homo sapiens
gcatgcttgtacttgcggtttggttcaccgcagatcactctggaatgacacggttcgagacaacgtgactttaatgggagggtgggtgggccgcagacaggctggcagggcaggtgctgcgtggggccctctccagcccgtcctaccctgggctcacatggg

SEQ ID NO: 492408 - DNA, 256 bp, Homo sapiens
tgatgcatagcaagtacagaaatttttatggccaaataattacaccactatatccatagtaccgcatttggtttatccactcatctgctgatcgttgccccctcttgggtattatgagtaatgcgtatgaacataggatgtacactatctctcttgtaagtccctatcttacggtcactttagcggatacatagtccagggagcagacactacttagatcacactatgctacttgaacacttctaatacactgagg

SEQ ID NO: 492409 - DNA, 251 bp, Homo sapiens
gagtgtcttcaagagttgtcatcatgtcatttaaacattttcatgatggatgctgtatcagtccgttctctcactgctctaaagaactacctgaaaattagctgggtgtggtggagggtgcctgcagtcctagctactcaggaggctgaggcaggagaatcacttgaacctggaggtggagattgcagtgagccaagattgcaccactgcactgcagcctgggagacagagtgatactcagtctgaaattt

SEQ ID NO: 492410 - DNA, 680 bp, Homo sapiens
aagcgctgtacggtctggaattttgggatcttgctgctgaccatctaggctgggctgcccgagcctcgcctcagccccatgatgccctgaagccccaagcatctggtgcctccactatcgatgactgctgactgacactgaggactgagactgaggttgagttctgtctgccttttgttcgtcatttaggtactgagaggctggaaaatgcaccccaagagctattaccgagactggagtcaggagagagcaggaggccctcatgttcaccaggtaacaaagaccacaccggccactggaggagggcaggagcagtcctccctctgaatggctgcagagttaatgttcccaagcccagatccccatttcgggggccttgggagagttaaaggcacctgctggttccaggacctcgctttccatctgttcttgttgcaatgccatcttcaaaccgtattatttattgaagtagtatgtacagttaaggggctggagagagggagcttgctgacctcctgccttgctacactaatgtttacagcacctaagacttagcctccagggccaccacctctcccagcatgatggtgagcatgacagtgtccacaggattccaaggaccatattgagattggaagcatacactcaaagacaatccacaacaggactcttatgtccca

SEQ ID NO: 492411 - DNA, 166 bp, Homo sapiens
attctggactggtttgaacgagtaggaaaatatctcacactcttataaactgtaaaattcacccttttaaagtgtaaaactcagtgatttttagtatattcacaaagttatgcattcatcattactttctagttccagagcattttcatcaccccgtcgtgtggag

SEQ ID NO: 492412 - DNA, 687 bp, Homo sapiens
  misc_feature (388)..(388): n is a, c, g, or t
  misc_feature (440)..(440): n is a, c, g, or t
  misc_feature (589)..(589): n is a, c, g, or t
  misc_feature (596)..(596): n is a, c, g, or t
  misc_feature (644)..(644): n is a, c, g, or t
tgtgatgcactccagcctgggagacagagcgagactgtctccaaaacaaacaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaacaaatatgttcaaataaccacaaccccacccctgctccttggaggacaacgtgatcactgtattcagctctgtcaagaatggtccaggttcttcataaattccccaagtttccaagtagttctttaanagcagtgtgaaaacaagactaatgggacccttcctggttgaagggaatgtangccaattccggcttggtttaaggtatttccctttccaattcaatcccccaatttccccggggaaggggtggtttaaacccaaaagttgcaaattaagggagaataatttgggtggaactggcaaaaagttcccccctcaaatggttccnggccaanttaaaataagtttaaaagggttgattcaagtggattctcccaggcaanttttcaaatccggggaatgggaaaaagccccccaatggttaac

SEQ ID NO: 492413 - DNA, 893 bp, Homo sapiens
cgactgccacccccaactctggccccaccacagccgccccttcctgaaaccatagagcggccgtgtgggcactgggcgccatggtggctcgctccagcgacctgccctatctgattgtcggggtcgtcctgggctccatcgtttctcatcatcgtcaccttcataccccttctgtcttgtgagcagcggcctgtgtctaacgcaacaaacatacaacagagcctgggttttcctcgaagatgcccttccacccgtccatgctcctgtatactataggtgtccacttggcgaggatctcaccaggtcctactcatagccatgtggtacagccctacctcagtaggcatcagtggacgggcctgtgctaatgggatccacatgaattcggggctgcccctcggactgcagtgggctacccgtggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctcttacttatacacacgtgcaccgacgatcgtccacatcaccagctgctgcagccccatcacgacatgctgccaacgcccaggagcagcctgctgctgtgggccagtcaggggtgaggagagccccgacagtcctgtctggaagcagtgtgggaccctccatttcactcagggcccccatgctgatttgggccttgtgccagttgaaagagggtggacaagtcctgactcctgccaagttgagttggacggagactgggtgtccccagcaccccgatagggggccctacgtaggaccaggcaacctggaatgccagctctacacgg

SEQ ID NO: 492414 - DNA, 218 bp, Homo sapiens
ctggcactaaccttggtcgaggcgttacacagttggagcggggcgaggaggttaccccgccgcggcgtcggcatgatcgcaaagtgccggaccgcgaaggtacgcggtaagcgcggaaaaccatctcaccgtcccaccgaaccggatgccgaactcctgcacccgagacgaagccgcgcaccacaacagtccgacgaggaggtgctgggcgaggaaca

SEQ ID NO: 492415 - DNA, 1566 bp, Homo sapiens
  misc_feature (1155)..(1155): n is a, c, g, or t
  misc_feature (1277)..(1277): n is a, c, g, or t
cccgctttatagtagtactgcgtgtcgtgtttatattactagtataatgaaggttgggtggtactcctccctccccgcaggtgtagtattactctcctcttcgaaggagagaggcagtcttgttgttttctcacaccacacagctccagctctgtggtgtgtaccacacctgttgggagggcatgaggcccgtggtgattacaacacaaggggggggcttctattgggtgaaaacaaagacaggtgtttccctgtgtagataaattatatttgtgggtgggagggattactattgttcgtgtgcccataaagaggactccttaagaccggggcaacaaaaagttgggataatctcacgcagaaaggggcttctttctaataattattttttcccccgggggtgttccacgacccgttgttttaaagcgcctcttccccgtgtctctttgggttatcaacagaagagaaaatattggtgtttccacccgcccccacggctctgtttctttgtggttcccccgagagccccttatctgtcccccccggcccccccccccgtgttttaaattccaaacgcccccggttttaaaagaaagagcttggagaatcttgggtgtctctcgtgtgtggcactaatcatggttaatattttataaaaaaagggggggttattaaaaccttctctgagcacaattcgcccccaaggccctctttcccaattttattatgcgcgtccccaaaatttataagcggctctctctcgggtgtataaaaagggtgtttatacacacacgccctctagatgtgtagataatattctctataaggtgagatccccccccgcccccccctgagatgccacagggagacttttataggctaaacttctttttgtgctataaaaataagccactatatgttgaatgtgtgttccacacactctacagcggccacttccacgagtttctttgagagagaccccccccccggctgtatttttatagagagtttttccgcgcgtttgtatacataaaatggtgtttttacccccgccactgtgccgccctttcactcttaattttgtgtagacccacacaaaataataagagtggaattccttatatgggtgagatgtttttgggagattataagaanaatttttgttgtgtggttggaaagagttgtgctcttgtttaaagagtgtccacacttgggaatatttataggggacacctggtgtccctctttgtgtttagaatattttagagagcccacangagaaagagggctttattagatgttttagattattgggagacacctcttgtgaagaatatagaatatatattttccgcgaaaagaatagtttaggatgtttaaagatttaatattttaatattttaggaaaaagaatatatagataggcccatatgggaatatagatccaccacatagaagttctttctcatacccactgtaggggttttcaccacgtggtttattttgcccccggtgaatagtgttaaactgttgggggatttcaccaaaaaagattatggattccca

SEQ ID NO: 492416 - DNA, 175 bp, Homo sapiens
ccaggggcgtgcggtgcacaccgggatgctcaaagataatgctatgcttggaatacctgaagatagatcaggacctgcaaatgtatggaatcaactatttctagatagaaaacaagaaaggaacggacctttcgcttggaggtgatgccctcggactgaatatttatgaaaaaga

SEQ ID NO: 492417 - DNA, 516 bp, Homo sapiens
ggccggaccgacgggtccgcacggtgtagtgacatgcagcaggtctctccttatcaacttaatcatgactgttagtcactacatccagacagagcataacatcagtcagtgataatagccttatcttatctaaagcatcagaagcattgaaatcagttctctcaggaaaatctctttatttttatacaatgaattgatgataagtttcatcattctgttaacttcggcttggaaggcaaacttttccgacttctctctaagttctcttatttgtgatgcatttaatccatccaactgaatagcttcttcctctctctgtactacttcatcatccgtccttgatccttctctacttttacccagatcctcttctactgtaccatccacatcaacttcatcgtcagctctgaccgacccgaaggtcagcaggacgcagcagaggcccagcacccacagggccctcatggcgtgcggccggtgagtctcaagtccccttcgatcgcagggacccactcg

SEQ ID NO: 492418 - DNA, 417 bp, Homo sapiens
  misc_feature (347)..(347): n is a, c, g, or t
cgaaaagcagttttcagccgcttaggctatatttgtttcaactccactctgaggtgtttgattggaattattttagagacttaagttctttccattttttcctaacaaaagttcctgagtccagtatttacaatattacagcactagcagatcagtgtctacaactcatctttttctgctggatcctcttcaccagttgggggagggcctgcacttccatagagtttgctgataattggatgaacaatttcttccagttccttcttcttagctgtgaagtcttcaatgtcagcatcttggtggctttccagccattcaatcttttcttctacagctttttccatggnctccttatcttcagaggaaagtttacctcccagcttttctttatctccaatctgattctttagagaatag

SEQ ID NO: 492419 - DNA, 359 bp, Homo sapiens
  misc_feature (227)..(227): n is a, c, g, or t
  misc_feature (230)..(230): n is a, c, g, or t
  misc_feature (233)..(234): n is a, c, g, or t
  misc_feature (236)..(236): n is a, c, g, or t
  misc_feature (240)..(240): n is a, c, g, or t
  misc_feature (248)..(248): n is a, c, g, or t
  misc_feature (263)..(265): n is a, c, g, or t
acgatccttgatgaatgtgggtgaagtctcttcaccattccttccatatcagtgtgccccccatacctactccttcaccctatttctcctccccccatctattcacctcactaagagacataacctcaaactgtcctatatgctctgttacttcctcccaaggtgccctccactctccctccatccctacacatcccctcagaggaacactcccaggggaggactgncanatnncntcanccacatcnatctaatccatccannncatccatcccatccatcaatccaatccatccatctaatccatccatccatctaatccatccatctcatccatcccatccattgagtccatccat

SEQ ID NO: 492420 - DNA, 668 bp, Homo sapiens
ggggatccactgcaggaaaagcaaaaaaggaaaacttcatttaaaagaagcaagaagtaaaatgggacaatattgggaatgtttaagtctctgaaactctgcgactgaaaagaaaataagatatgattacttaagcttaagattctgaggcataaagaaacattaactttggagtattcatctagactactgaatatacaagatttagagagacacagtggttttcattgcatggatcacgagatcacagtctttgctttaacatgtcataatccctatgggttggactcgttgactgtatttttgtaaaggttgctcgtcagttgaagcctgagccttggaattcatggagtattctaaagactaagcaaatgaaaagtatattcctgttgaagaacccagcggaaatttgtacagcagagcaaatgtaacatgtttctttaggggtatgatctgagaacaaaggaaatattgataaaaccgtccaaagatccagataatgttgcaagagtaaatgggaggtgatagaggttataatctgaatcccaaaggagactgcagctgatgaaagtgcttccaaactgaaaactaggacagtgcctttacgatggtaagcgttaacagtcccactgcttctatatgactcctttaagtacactgtgtatggg

SEQ ID NO: 492421 - DNA, 1022 bp, Homo sapiens
cttggtggctcacgcctgtaatccagtactttgggacggccaacgactgggaacaatctcttagcctaggagtttgacgatcacgcttaacgcaaccactacgtgacatcttgtactctattacacacaactaaacatacacacgttacgacagtggcatagatgtgcatgcaacatgcagttcccatgctacatcaggaaatgctcacggtgagatcggcaattaagcaccagtgccagtctcgacggcttccaagtcgcagttcgtagatacgtgccaaccttgacactccaaaccatggagtagcagataggtagcattcggcttcattaactggtcatcgatactccttggtgctcaatggtgactacctcctaaacatgggtcacatccacaggggtacgcatgaaaacctttacaacacagacacagaacacaacaaacaaacaacgcggaaacaacaacctctcaaaaacaaagcgtgggccaaaacatacctgcgggagcacactccggcaaggcaacaacagccaacaggacagaaagaaccagagacacaaaaactacacagggcaaaaagagaaaggagcacactacttgtgtcaccaacgactacaatatgatgaggcacagagtaccaacgagaaaacattttcattccctaaaagaggacaatcattcacactaaacacgcggactataatcttatgaagtgccagaataatttttagaaaaaaaaacacgtgcctgacacagcaaactcaaccctccccacacaaaagacaacgagcgtggtggacccccccacgagggacgaacaacatgtgcggagctgcaagccacaaccacaaggacgagaccgcccgaggcagaaggagcaatctccacacacgatgaccagtcacaccaccactggagtgaggagcacaacaacacgtcagcgacacaccacagacagaacatgagggaggggaaacacaacacagaagctagcacaccgcaagcgaagaggacacacaga

SEQ ID NO: 492422 - DNA, 414 bp, Homo sapiens
  misc_feature (11)..(11): n is a, c, g, or t
  misc_feature (23)..(23): n is a, c, g, or t
  misc_feature (69)..(69): n is a, c, g, or t
  misc_feature (178)..(178): n is a, c, g, or t
  misc_feature (240)..(240): n is a, c, g, or t
  misc_feature (305)..(305): n is a, c, g, or t
  misc_feature (364)..(364): n is a, c, g, or t
  misc_feature (375)..(375): n is a, c, g, or t
ttacatatcanaataaagatttngaagatacctgaaaggacttgcattcttacttgaataaaagacatnacagaacgtggagactacagtagcctgagctagaaagaaaaaaatctggctcaagaatgctgtttagtgtttggccacagaattaagaatgaaactggcctggcgcggnggctcacgtctgtaatcccagcactttgggaggccgaggcgggaggatcacgagctcagganatcaagaccatcctggctaacacggtgaaatcctgtctctaataatacagttagccaggtgtagnggcgggtgcctatagtcccagttactggggagggtgaggcaggagaatggtgtgaaccnccaaggaggcngcttgcagtgagcctagaggccccactgcacttcgcctg

SEQ ID NO: 492423 - DNA, 657 bp, Homo sapiens
ggcggtgcgtcgggctgcaggagaagatggcggtctccacaggagtaaaagtccctcgtaattttcgcttgttggaagaccttgaagaaggccaaaaaggagtaggcagacggtaccagttagcttgggcgccttgcaagatgcatgaagatatgacacttcacaaggtggcgacaggcatgattatgtgggccacccatggacaaatttattgcaaccagaatatataagcctgaacggtagaatgtggcaccataaatacccagaagctcctccggtcagtaaagaatttgtaacaaaaccttattatagaccggacatacaaataaatcccaggtggggactgggtgggatgcccgggagcaataccaggtgttagcaaaatgggcacaaattcatatacggcattaaactgttgtgtaccttcacagagctaaagacgtctacagtgatgtccaacagacaaatatgcagcttccacagcaaccagaagggaccaaaattacaagcaataaatttcaagtggcatctcaaaacttgtctaaaagatcaacaagcttactaacttcatgttcaatgtcttgattcaattatcacaatgcaaacgtaccccattacgtaacgagaatcccagctggtaaacaatgaccctgtccc

SEQ ID NO: 492424 - DNA, 100 bp, Homo sapiens
caatcgagcttgggaccctatgcgggagggtgaagcccaccaaacagtgaaccccatctggggtttgcaaggaacaaaatgatttactagtaaacacaga

SEQ ID NO: 492425 - DNA, 125 bp, Homo sapiens
actcctatatgcaaaaatatagccaatatcagttaacgaagcgatcattgtgtagcatgtatgtgctatatgaactaatatgtgagcatgtcctaaccatgccgtttctctgactcacaacagta

SEQ ID NO: 492426 - DNA, 1076 bp, Homo sapiens
gccggcggttaattggacgaggataccaggcggttgggacgtgtacacgtatcctgaaaactggagggcttcaaggctctcatcgctgctcagtacagcggggctcaggtccgcatgctctccgcaccaacccacttccattttggccaaaaccaaccgacacccctgaatttctccgacaaatttcctgccggacaaggtcccagctattgagaggtgtgatgatggattctgtgtgtttgagagcaacgccattgcctactatgtgagcaagtgatggagctgcgtgggaagtactccagtaggcagtcgatgcccaggttggtgcatgtgggtgatggctttgctgattcctgatattattttgcccccagccagatagctcgtgggtgttccccaccattggggcatcatgcactcagcaagcaacacagtgccatctgagaatgcaccaggaggaagtgagggcgaattctgggggctgttggatgcattacttgaagacgaggactttgactggtgggcgaacgaggtgatccattggcctgacatcacagttgtcctgcgccctgttgtggtcgtctaatacagcaggctctaaagtcgcttctttcctgacaggacttacccagagtaccaaccgtttggttcctcacctgtattaaccagcctcagttccggtcgtgtcttgtagggaagtgaaactgtgtgagaagatggccagtttgatgctcatgaagtttggcagagatccaatcgagaaaggacatcggcacggaatgagaggttcacgggaagagaagcgaaggccagctgaggggctgaggggaacagggcggtggcctggatcctgagaggagaggtgatgtgagcagcgctggtggtggccacggcagcaccttggtacatgcagagtacttggtcggtgattagggggtacacgagaccccgggcggccattccggcctgtagggggccggcacagggtctgaaaccacacacggcgcagtccaggcgcaagacgtcgcccttgcacctcggctcagccgtacgggcagggaagcctgcacattcac

SEQ ID NO: 492427 - DNA, 404 bp, Homo sapiens
aatgggagcactctgctgtgacttgtagtatattatcccggcgagacacctaaagctggtctgcggcacgttgggatgtgctccttgtcgggctgtagcacagatggcctcgttgtaacattaaactggagatgctggtactgccttggcagaatattgaggaggtcaaaaggctcaagagtgggcatgtagtgtgtatctcttatgacagatcagaagagccaatcatcataccatgatcccaggagggccgagaggtcgcttccttcactaaagggataagtgcatctgtgagagggcacagcgtctttgagaagctcagtggttttgtcctctgttggctggagtagacagttagagacactgccacgccatgcgttgatctgccaggggatcctctaaag

SEQ ID NO: 492428 - DNA, 818 bp, Homo sapiens
taaagaacccttcatcaataaatggaaacctacaaaaatagtcaaaccacttctacaaaatgtcagtatcaggcgggggtcttcaaacccaaagtgattgttgcggattgttaagaggtgaaatattagtgtggcggatgaaccagataggtgaggaaagtttgacccacttaagtgacggtgaagctccggtggaaacccgtggtggctacaacaacaaagtgttgacccgataaatcccgttcggaaagtgggtgaagggagactcgaagttacctctgaagagcctgtgtataggagggtataaaattagaagaaacccagtataaaaaatgtgtaaagtgagccaggtgctttgaacatataatatggggatatacgcggatgtgatattcactaattatagcacctcagtggtttgacgctcccagaggtgaatgtgaaaaactccctggaagtgcgcaagaataataaccgagcagtgtagtctcagcgagaggaggcgcatcttctcagaggagaggaattatcacacggggggagagtatagccctgttggggggggggcccccagaatgccccctcctcaaaaatggggggagggggataggggagcttcaaggcgtcggaagtgtgggtacacacaggggcctcaagaaaaaaactctctgttcaaaagaaaaaaaaaacttcctgtagcgttaaataaaataaggaattaatcccccgaaaatcaaaggaggccattttggggaccaggttgggtattcatggatagcccatgggaaatgaggcttaacacggtgatacaatcggcc

SEQ ID NO: 492429 - DNA, 188 bp, Homo sapiens
aaggcgctgtcggaccaggaagctggaatggggccagaaggctgatgtccctgcaagaatacaaacttgactggatggtagcagtagaggagctcatcctgggccaacccctagactgcccgatgtccagcataacaggtatagtccaccccgcatgagctcctcctgactcctcttagtcagtttca

SEQ ID NO: 492430 - DNA, 327 bp, Homo sapiens
ttcatattgtaacaaccagcccatgaccctgaacaggggcctctcggacctcctaatgacctccggctagacatgtatttcacttccactccataacgctcctcatactaggactactaacctacacagtaaccatataccaataatggcgcgatgtaacacgagaaagcacataccacggccaccaaacaacacctgtcccaaaaggccttcgatacgggataatcctgtttattacctcagaagtgtttttcttcgcaggactttttctgaggccttttaccagctccgagccttagccccttaccccctcaatttaggagggca

SEQ ID NO: 492431 - DNA, 831 bp, Homo sapiens
ggggatagtgaaatccagaaacagtttgaagagctctatagaccttttagaagatccttatccgatggtccgttccacagggatccttggtgttcgtaaaataacttctaagtactgggaaatgatgcccccgaccattcttatgggacctcctgaagaaggtgactggggaactggcatctgacacgagctcagctgatgttcgttgtgctgtctttaagtgtctgccaatagattttggacaagcaaactgagccacccatgtgtagagcagactccttccagctctcagatacagtctccacgacagattcggagaaagtgagggtagctttgtggacatgctcgttgccgatcacagctgtgagggctgctacgtccggaaaatatgtcccactggagcacattctggttcgtctggcaacactgacttctcgacctgtgtctcggcgcctggtgagcctcatctcttaattcttctcctgcctgtgacctcagccggcaggcggtctggtgcgagcgctgtgtcaccccctggtgcagatgaaccaacgccgccagccaggaggttctatcagtacgcccacgaacacaccgcctgaccaagattagcaagctgatccacgttatcgccatcgcttcaatgcctgtatccagagggcagctgagagagcctccaaggacgaggaggcagaggcggacgggccaaccgcacgcgcccgcccgcccccccccgcgccaccacgcgccgccgcccgccccaaaccccggacccggccccttcggaagtcgcaccacccgccaccccacccgcccggcacaacccggccc

SEQ ID NO: 492432 - DNA, 430 bp, Homo sapiens
tcatgtggctttatgaaaaacaaaatatgttggccacatgacagaattcgaagtcagcaaataaaaagaacataaaattgtgttttaactcttttaagatttgatatatgaaggaaaaataggtttaaatgcacccaaatgagaatagccacaataacaaggacaaaatcaaagcaaaatacagaaggaaaaagacagcctatgaggaggagaattagactgtttttatcaatgatacaaaagagattaaaaagggggaaaaaaatcaggcaaacacataaataatctcaactataaaagattaatcaggccagctgtggtagtcatgcctgtaatcctaacactttgggtggccaaggctggaggatcacttgagcccaggagtttgagaccagcataggcaacatggcaaaacttcacttttaccaaa

SEQ ID NO: 492433 - DNA, 229 bp, Homo sapiens
ggcagaggttgcagtgagccgagagcgcaccactccactccagcctggacaacagagcgagactccgtctcaacaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctggacagcggagggaag

SEQ ID NO: 492434 - DNA, 906 bp, Homo sapiens
gcaaatcaaaattatagtgagttaccactttacccccactaggatggttaaagtctaaaagacagtaataagtgtggtgaggatgtggagaaattggaacccttatacattgctggtgggattgtcctggtacagccatttggaaaacagttcctcaaaatgttaaatacagagttaccattgtcccagtatattagttagggttctgcagagaatagaaccaatagagggtgtgtgtgtgtgtgtgtgtgtgtctgtgtgtgtgtgtgtgtgtgtctgtgtgtgtgtgtatgtgtgtgtctgtgtgtgtgtgtgtagagagagagaggaagggacagattattaagagaattggcttacgtgatgggggagactagcgatgttcaaatatgctgcagggtaggaccagcagggtgtagacccagagaagcatcgatgtgcagtgagagtccagaggggagtgctggtgtcagtattccttctctcgtgaagagaggtcagccctttttctctaaagggccttcaagtggattggtgtgagcgccccactcatgaagagtactctgctttatcagagaagtactgatgtaagatgttactccattataaaacacccttgtgtaacggacccccatatgttgtgtgcccaccgacgtcttggtgtggggcttacgccaaattaacaacataaaatagagcaccctacatagagattcacccagggaatttctcagggtacttgaacacgtggtcccttttgttaccccatcacaatttgcgggattataccaaaatcgaagggggaaagcccaatccccccggatataggaaaagggggcggcacacacaagtgtattgcgcccaaggggaaatgttgcacgttggccacaattgagcaacgaaatc

SEQ ID NO: 492435 - DNA, 132 bp, Homo sapiens
ggtgactcttagaggatccctcctccagcgcaacctggtggtcccccgtctcccgggtaggtcaccactattgatgccgaacttagtgctggacacccgatctgggatagctgcactacagcccagaactcc

SEQ ID NO: 492436 - DNA, 151 bp, Homo sapiens
  misc_feature (121)..(121): n is a, c, g, or t
tctctgagtatgacgggattaggcgacaccctcttttcgccatcgcaagcctgctggaatactgacgtagccaggcttcttcgggtctctgaaggcattgaagttgtcgcgcagttgtttngccaactcttcgcggttcttcaacgcgtac

SEQ ID NO: 492437 - DNA, 129 bp, Homo sapiens
acaccttcgaagctagatacaaaacttcacacaggaaaaggcacggactcatggggagactggaaaggatccatcagccattcagcaccaatgcggacgagctccagccccatgggacccgttcacccc

SEQ ID NO: 492438 - DNA, 339 bp, Homo sapiens
  misc_feature (319)..(319): n is a, c, g, or t
ctcaccacaaccttgaactcctgggcttaagagatcttcccacctcagcctcttgagtagctgagactacagggcacaccactttgcccagctaatttaaacaattttttgtagagacaggatcttactatgttgcccaggctggtctcaaactcctggcttcaaatgatcttcctccccagtctcccaaactgttgggattacaggcatcagcaccatgcccagcctcactgttctttgattttgctgttttcccaaagacaaagtttggtagacaggggccaatgctttgctaataaattactacgaaacactactnaaagaattcttaccaaacag

SEQ ID NO: 492439 - DNA, 144 bp, Homo sapiens
tttcttgccacgacttgggacacggctgcgtgtggctccgagcagtcctctcagcccacttgcacggtgggagtagtggattgatgttggcatgccgttttgagactgagaagaataatggggcaggctacttttttggagcat

SEQ ID NO: 492440 - DNA, 213 bp, Homo sapiens
ttactagtcatcccagccatctcagcctggttcagcaccctatgcttggagaggtgctatcatcatattgaaagaaagaagcgcactctggttatctttgagtagtcacggtacttgcactattttctttctatatttttatgaggcttatcttacttcgtgtctttgagagttgctgacctattgagatgggttgaattttatttagaacag

SEQ ID NO: 492441 - DNA, 435 bp, Homo sapiens
ttaagagaatatataaaaacattagggctgtgattatgtatacagcagtatacccggggaacaaagatacagtagtagcgtgggaactactgacagtgtcaagctacccggccagtgactgagcagtagtactagcagcgctccgtgcaaaaggaacgtggcggtgagcaccggcctagtgtgcgccctgcggccaattagaacaccacctgacggaggagggttcctagcgagcgtggagctcctgatggtaatcagctaccctaggtagtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctg

SEQ ID NO: 492442 - DNA, 478 bp, Homo sapiens
gttggaatgtgggtatggttgctggaggtgaaatagaaattctgaaccaggagcacattttggaaatgaggtcaccactgcacaacaacagagtaaaagaagtctgtgtcctgaaaccgagaaacaccattccagtcctgtagctcctgccttattttaacaagagacagaaagaaattcctattttacctaaggccctgttagtttgagctttctctaacttttggctgatacttagcaatcagcaagaaactttatgattttgtttttgctcctaggtctacctgaatgaaggaaaaagactgtcccgcgtattaatttcaactagaaaagagataaagcgaattaattttaaaaatatttctactaacctctagattcagaatatacattcacagcaggctgatttatgctgtgataagaagcaatctccaagtttccgtggctcaacgcaataaatgtatacctaactctaaaa

SEQ ID NO: 492443 - DNA, 556 bp, Homo sapiens
gctgtaggagtacggcacgagggggagttctctgtgcgcgtgcgcgttccctcttctccgcgctcagggtgtcacaggcaccatggcgtattatgggcagcagagcctgcggcagcattggcctttgcagcggcggcaggagcaccaggctctgcagcggcaacccccagacggcttaagccatggcgcttctcacgggattcaacaacaacgttgctgtgaccgacaaagacacctttgaattaagcacatttctctgattccaggaaagcacacggacatgagccaaatgagctttctgagcagcgaggtgttggtgggggacttgatgtgcccctttgagcagtcgggtttgggggctgagagaaagcctaaggctcttaaatggatacctggagggggccaagcacttccctcaagggttctccagcgacaaggcttagggggccttcttccaatggctggctgtggatgggttgggcaatgcctgcaacaacagcggaggaggccttcttcgggacagattggatgttgtagtggaccatgtcagatgcct

SEQ ID NO: 492444 - DNA, 151 bp, Homo sapiens
ctgcattattagatctgatgctactgatgaatttgatctacaaatgcaactaattagtctgtgagatctccttgagattcagagaaggaacatgtgatcagtattgatccagagatctaggctgatgatcactgtccgatcaatatctcag

SEQ ID NO: 492445 - DNA, 1210 bp, Homo sapiens
cgctgggcgaacgacgcgtccgcggactcgtgcgcgtagaaccagcaattgtcctagtagtgcaccctccttgtgcctcacccagtgggctgagcgcctagagtgggtcccaagcaaacctgcgctctcagtgcttccatgtctccctagtgcatgcttctccatacaatacttgcacatgtgtgtgctacggattttgcacatgacaagaaagtccgcagcgtggccctccatgtccattgtgtaaaccaccgtattcaactatatcttctcgacgaccttgagcctcaagtcatgaccatgtcagcctggggccaccgcagtgctgaccccctgcgaagacctctagcgttttaacgtcaaattaccctacattaaagttataagcgtaccaaaatttatgctaggatcatgtatcaacctcatgatgagcaaaccctagtccataaaatcgttgagtagatctttcacatacttcctacccttatacaccacatagaattctattagcctccagaaaatcgtatggtttaggcctttggtaaccaaccatgaaggccaccgagcaagttgggcaaaagagtacgttgaatcggtgtctctagagaagcctatccagcgcggatataacatctatagcacttaccaactccgacggccaaccataatttaggacaggacttttgggactcgtaggcatactagcagagagaggcctccgtgataaaggggcgcccacgctggaccggggcaacgaagcgttggccctcggtagcgcctccatgtcgcggtgggttataccgtaactcaaaccccatgtcgccaacaaaaggggccattacgttttggcgtgattagagttatgtgactcggttataggctgttgacacaacacccccgcgttgataaagacacggcactccatattgggatggtggcaccagagaaggcgatgcgcccattcaacgacaggggtcatttgccacggtgggcaccaatacaagagcggggtgcattgactagaacagtgctgtacgtgtggacttcgaacacgttgttgtcattcataccggagagaggagcacccatgcaggggtgaagttgatctagacggcgcgaaacacacgtctgggcagcacacgatggggcattttggatggggaaaacataccttagacaggggtcaaattggaatgcccactaccggagg

SEQ ID NO: 492446 - DNA, 298 bp, Homo sapiens
gcagtacatatgtcacgatttgtctgtaagaaactatttatgtaataggtaatgaaactgaaactatactgatgcccattaaagagatccagattcattcaaggtgatcttttctctacctgtacaggcgtgtaaacttttttgtgctttatattaaacaaaagtgagagccactgattggtatgtacacacaaatttgtgtctacaacagaaatggataccatcagtgctatataccgtggaaacctaccttaggacaacgacatgtttaccatgaatgtatattttattttacttt

SEQ ID NO: 492447 - DNA, 456 bp, Homo sapiens
tgacacccattcgagactaccataccattcccaccatcacctctaccatcactaactgggcctcagggatagcagtcaccgggagatgaggtccggggcggctctgccccttctatccagcagaagcactaatgtccggagacccaagctcactttggatgactcggtccacaaggctgattataacatgcaagaagctaaaaagctgaagcacaaagctgatgcacggtccgagaaattcggcaaagctgtgaataatgctgatgccgccctctccttcactgaatgtggcaatgccagggaacgcgaccctcggaaagcaaagtccccatacaccatgtactcggagacggtggagctcctcaggtatgcaatgaggctgaagaacttggcaagtccctgggcttcggagggggccaaacagctagcagtactaatgctacggatgttaatcat

SEQ ID NO: 492448 - DNA, 1094 bp, Homo sapiens
acacaggagccaaaaacctgttatatcatctccgatgcaaggggatcaaggtgacggctgaacagacttcccgtctgctggctgtgggtgacatggtgatggccacagtcaacgaaaggcgaaagcagagctcagaaaaaaggtacgatccagcaggtggtcattcagacaagcgaacagtcataccgtagaaaagatggcgtgtttcgttgtatttaagtgcatggagtcatacgtgacacacataacaggcgagcatgcaaaggttctgtcgcagttacaggaccaggtagcacaaggcaggtgtgcagacttgtgggccccggagtggcatccaatgctggcagcatggcatgatgtcgtccaggtagtactttgtaaaaaactaagaaacaaaaggtaatacccgattaaaagatagagaagagaataataaataacatctggggggggatcttagtgacggggcggggcaaaaacacgggggttgggaactgggcacatgggtgcataaagcgtggtactccgtgacccacagattctcgtggtgtcccagaggggggacaagactcgtgccgggctcctcccataataagcggagggcggcattcaaggtgtgcgagaaaagcccgaggggtaaacacaggcgtttaagaacctaggcgcgacggaaacaaaacgcgcacaggcaccgccgagaacagaaaaggcaaaggacagggaaaaccttggacgagacggcggaatgaacgcgcaaacgaggtcacagaaagaaagacatagcgcggaaacgcctaggagcgcttacgcaatggacagaaggacaaagcatggggccgcgcccctgtaggacagcgcagaacaaggagatacattcaccatagaaaaacgaaagggagcgaggaacatctccaggctaaaggttaacctacagaacagggcccagcaaggacactaccatagggacccgcggagagagccactcggcatgggcaatcacggatggggcggccccaacacagggcccccaacgacaccccaaagacccaaagacaacaggggaccatgaggatgggcgaacacgcgacggggag

SEQ ID NO: 492449 - DNA, 292 bp, Homo sapiens
tgctatattttagtagagattgggtttatacctactatttggccaggctgttcttgaacttcctgtacctcattgtgatccacccgcctcagcctctcaaagtgcttaggattacaggtgtgagtcaccacgcccagcccacacatgagttttcaaacattaaaactattacttaatgcccttgtgacaaattagtgttttatgaaaattgttattttatcccacagtacaatagtagtaaggaacgtgtattgttaccttttagtaacttagtgagacacttaagtctctg

SEQ ID NO: 492450 - DNA, 533 bp, Homo sapiens
gagaagctagttaggcacaggactcagagaactgagatcaggtaaacataaactagacgtcgctgattcggataggcaagtaaatagagacgtctaggacagctcggagggatgataggctggtatcgctgtttccagtcaggcagaaagttgcgctttccacccagagcccttctctcctgctgacagtcaggctctcctatgccctctctctgtctccactgatgcagcagccggtgcagcactggcctctggcagacggtagagcttcatggtgcgctgcatggtcatatttctgctcaggtgggaaaacttcacttcaatcagctaccgtgggtttaggtgaccgatgccaatgcctgcaggtgccaacgggctttggtagtaccaccccggtagtgtagactgcttgtgaagatgccctccaggtgaacccgcttggtgatctctcggatcagaactggagcaatcctcttggaacgcagcttcttgtggacacaccggaagtagatctctaccatcttcttctctgt

SEQ ID NO: 492451 - DNA, 890 bp, Homo sapiens
  misc_feature (134)..(134): n is a, c, g, or t
  misc_feature (276)..(276): n is a, c, g, or t
  misc_feature (282)..(282): n is a, c, g, or t
gggtcttcttccttctcgcctaacgccgccaacatggtgttcaggcgcttcgtggaggtggccgggtggcctatgtctcctttggacctcatgccggaaaactggtcgcgattgtagatgttattgatcagaancacggggctttggtgcgagtggacctgtgcactcaagtgacggacgacaggccatagcctttcaacgtgcgatgcagcgtcactagatttcattcctcacagtttcccgcacaggtgcccacacagaagtatgtccgacaangcctgngcagaaggcagacatcaatacaagaatgggcagcccacacgatgggccacagaagattgaagccacgagaaaggaaagccaagatgacacgattttgatcgtgtttaacagttatgagaggcaaacgaaaagtgaggacacagaataatcaagaactgaagttaagaacgcttcaagaaggcagctctcctagaaagcttctcccaaaaaagcacctggtactaagggtactgctgctgctgctgctgctgctgctgctgctgctgctgctaaagttccagcaaaaaagatcaccgcggagtaaaaaggtccagccagaaggttcctgcccagaaaagccacagggccagaaagcagcggcggctccaagaagctcagaagggtccaaaaagctccagccagaaagcacctgctccaaaggcatctggcaagaaagcataagtggcactccatcaagaagtaatagggtcttgtgacctgtgaaaacaaaaagacaaaaccacacccacaggcagcacaaagaaaaaacaacgccggggcgcgtggggggggaaaaggaagggggggtcagccgcccccctggaaggggggggcccaggggaacggcc

SEQ ID NO: 492452 - DNA, 227 bp, Homo sapiens
gatccatcactatgtcacaattggcagcgtggatatcagatacccgattcttcattctgctcagctcacgccggagatgtctgtgatataacactaggttctgcatttaagttgaaggtactgggtcgtcatataaacagctgtgcaagcaagagcacaccagtctaggaggacgcacagagaagggccctgctagtttacttaccaatataccttagcaggtatgg

SEQ ID NO: 492453 - DNA, 383 bp, Homo sapiens
gactgctacagccgtgaacagtcatctgtggctttaactggttggttttaacaggtcgcgagagatatacatgtgatgtatatgtttagatttaagatgtcctaaaaaatgtatatattaagatacacttaacaacatactctgaatataataaacaagatgttggttcaaaaaagggtcaacaagaagaggaagccaagcttcctagcatctgttttggtggccacgcttttccccattaatggtgtgaaagtctgaatcaacagcaaatacagccatacagacctatgtatctgtgtgcatgagtgtgcatgggtgtgcacacagagaagtacatctaggacgacttaagacaaaattatctgtgttgtgttccacaaaca

SEQ ID NO: 492454 - DNA, 751 bp, Homo sapiens
  misc_feature (6)..(6): n is a, c, g, or t
  misc_feature (115)..(115): n is a, c, g, or t
  misc_feature (174)..(174): n is a, c, g, or t
  misc_feature (361)..(361): n is a, c, g, or t
  misc_feature (498)..(498): n is a, c, g, or t
  misc_feature (515)..(515): n is a, c, g, or t
  misc_feature (523)..(524): n is a, c, g, or t
  misc_feature (541)..(541): n is a, c, g, or t
  misc_feature (557)..(557): n is a, c, g, or t
  misc_feature (618)..(618): n is a, c, g, or t
  misc_feature (633)..(633): n is a, c, g, or t
  misc_feature (641)..(641): n is a, c, g, or t
  misc_feature (662)..(662): n is a, c, g, or t
  misc_feature (704)..(704): n is a, c, g, or t
tctttngaaacagggttttgttcttattgcccaggctggagtgcagtggcacaatcttggctcaccgcaacccccgcctcccgggttcaagcaattctcctgcctcagcctccanaaaagccggggttgcaggcgctcaccgccacaccagactaatatttttatttttagtanagacggggtttcaccatgttggccaggctggtcttcaactcctgacctcagataatacacccacctcagcctcctaaaatgctggcattacaggcgtgagccaccatggagcattctcctagtaacattttgctgagtccttttcaaaaagattcaaaccttgtatccaagtctcttaaaaaatgangtgaacatatactcatcgtatgctctccattcagatacactgttgctttatctgaaaaacctacagtaaatgtgaacatgaacttttgttcctaaagcataaaattttaaaaaatgacttaatcacaggttacacantaattttaaaaaaatcnattaaacnnttttgtttggcgattcnaatacaaatacctaanaattttttatctctgttcaaatggtcaaagaattgtgcttgtctataaagccgatgctccnaatttatgaatacanaagaaagnaatttttcaaaaaaaaaaatntctgtttacttataacaattattaaaatcttttaaaaatctntgaacatttccaaaactgaaaaccatgattattttaaggtaactttt

SEQ ID NO: 492455 - DNA, 515 bp, Homo sapiens
catcatcatcatttcatgtcagcatcatcacttcccatgcaacatgggctaatcacgatgccatcatcactgcacaggggccacaggcacttttatgcacccaatggtgcacattttttccagccgcagcacatggtcagaacagatcagtcacaaccccccaatggggaatttaagggggcttgcaaaccatatgaaatagctgccatttgtagtttaaaaaactgtcagccagtttcatcatggttccacctaatcattcattgcaagcacaattattttcttagctcatcaatcaggcttacatagtttgcagtgtattaatagcttttggaaccagtgttttaaacagcatttcctttatcggcacaggcaccatctttcatgcacctgctttctgtttttccaatcatgatcacatagggtgtatgtccccagcaatcaattagtcaaccattcagtcaatgcaccagatcttccgtacatccttatttccatgcttaatgtggtgttgc

SEQ ID NO: 492456 - DNA, 502 bp, Homo sapiens
cggatctattagcaagacaggtggaaaacaggcctctgtgcaaacagccagttgtgaatgcaaggaatagttattgaaggaaattaaaagtgccactcctgtgagcccaagacgtaacagaaagtgacatagacttactgctgatatggacgaagttttagtggtccagacagaagatcaaacgagccacaacattccctttatccaaaaccgaatccagagcaaggccctaattctctttaattctattaaggctgagaggtgaggaagctgcacaagaaaagactgacgctagcaaagggtggttcatgaggttcacaagaagaaaccatctccacaatacaaaagtactaggtgaagcacgcaagtgctgatgtagaagctgcagcatgttatacagaagatctagctaagatcaataatgaaggtggctacactaaacagatttacaagtggaggtaaaacagtcacatcttagaagaagatgtcatctaagactctc

SEQ ID NO: 492457 - DNA, 573 bp, Homo sapiens
caattgattggtgtgatatgtattgttgtggtgtagtgatgggtcccccccccgcgccacgccacatggtgtttgtgtgctattaggacgcgcccccaccttcttatgctggcgcgcgccacacccccctcatgttcttccaaatgatttttttcccctcctgcgttctgattattaattattataaaagatgatggtcgccccccgccgatatttttctctccacgggtctctccgctacatatattatatccctaaaacacatatgtctaataggagagaggaccatacagaaggtcttcctccccccccccgcccccctattattaggtgtatccatagatacatcctcgctctgagcgacactatttctccgacgctatatatatataaatatatctttctagagaagaagtatgtgttgtggagattttaacaaaaaaaccttgtgttgtagaggcaagttgtggtcaacgcccacacgtatgggtctctcacagtgtgagagagatatagaacaatactactccccacacgagtgtggtttcgcccccaccaatgtacagagaaaca

SEQ ID NO: 492458 - DNA, 585 bp, Homo sapiens
gaaatcgtcagagtgccgttccctcaaccggctatctctattcacttgcccctatgccgatcttcttcaggtggcaaaacggttacagcagttctgggtctcatctgttttctccacagtctcaaatgcactgtgtcactctaaactggttaagtttcttgccttcctctaaagcattctcggaatcacatgggcatatgacctaaggaaatcaggggctttgggaagtaaaatggggagtatgtcctggggaggcaaccaacaaggtaaccgtgcagtaagttcttagcatagttctctgtcactttgaaaagaaaacttaaaaaccactgaaaataaatgggtgactctagcagactgcagactactgaccctcaactgcttcagtcactaactggtgattcctctttagttctttccaagaacaacctccttgtgactcatttttagaagaatgacaaaaagaacaggcctacctgtaagcccaacagagacaaggctggaatgactaccagatgcaccagtcatgggtgccatcttgtttctcgtgtggtcactgcactttcatggcattcgaaaacaaaa

SEQ ID NO: 492459 - DNA, 139 bp, Homo sapiens
cttaaacacgtcggggcattccggataggccgagaaagtgttgtggtagggtggggggcatccatatagtcactccaggtttatggagggttcttctactattaggatgccccgacgttactcggattacgccgatgcg

SEQ ID NO: 492460 - DNA, 146 bp, Homo sapiens
tccccaaaaatgtatagtgccttgtttttatgtacagtttatataccgcaaaagtttgctctgcatttttgatgatggtttggaacaaaataaacaatttaactctcaaatagtcaaaataaaaacatatcaatttataataaaaa

SEQ ID NO: 492461 - DNA, 662 bp, Homo sapiens
  misc_feature (8)..(8): n is a, c, g, or t
  misc_feature (10)..(11): n is a, c, g, or t
  misc_feature (14)..(14): n is a, c, g, or t
  misc_feature (19)..(19): n is a, c, g, or t
  misc_feature (24)..(24): n is a, c, g, or t
  misc_feature (28)..(28): n is a, c, g, or t
  misc_feature (34)..(34): n is a, c, g, or t
  misc_feature (50)..(50): n is a, c, g, or t
  misc_feature (56)..(57): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (70)..(70): n is a, c, g, or t
  misc_feature (74)..(74): n is a, c, g, or t
  misc_feature (76)..(77): n is a, c, g, or t
  misc_feature (83)..(83): n is a, c, g, or t
  misc_feature (88)..(89): n is a, c, g, or t
  misc_feature (91)..(92): n is a, c, g, or t
  misc_feature (95)..(96): n is a, c, g, or t
  misc_feature (98)..(98): n is a, c, g, or t
  misc_feature (100)..(101): n is a, c, g, or t
  misc_feature (104)..(105): n is a, c, g, or t
  misc_feature (110)..(110): n is a, c, g, or t
  misc_feature (114)..(114): n is a, c, g, or t
  misc_feature (117)..(117): n is a, c, g, or t
  misc_feature (133)..(134): n is a, c, g, or t
  misc_feature (141)..(141): n is a, c, g, or t
  misc_feature (146)..(147): n is a, c, g, or t
  misc_feature (150)..(150): n is a, c, g, or t
  misc_feature (164)..(164): n is a, c, g, or t
  misc_feature (193)..(193): n is a, c, g, or t
  misc_feature (196)..(196): n is a, c, g, or t
  misc_feature (221)..(221): n is a, c, g, or t
  misc_feature (239)..(239): n is a, c, g, or t
  misc_feature (242)..(242): n is a, c, g, or t
  misc_feature (246)..(246): n is a, c, g, or t
  misc_feature (254)..(254): n is a, c, g, or t
  misc_feature (258)..(258): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (313)..(313): n is a, c, g, or t
  misc_feature (316)..(316): n is a, c, g, or t
  misc_feature (318)..(318): n is a, c, g, or t
  misc_feature (324)..(324): n is a, c, g, or t
  misc_feature (342)..(342): n is a, c, g, or t
  misc_feature (353)..(353): n is a, c, g, or t
  misc_feature (358)..(358): n is a, c, g, or t
  misc_feature (383)..(384): n is a, c, g, or t
  misc_feature (407)..(407): n is a, c, g, or t
  misc_feature (422)..(422): n is a, c, g, or t
  misc_feature (447)..(447): n is a, c, g, or t
  misc_feature (453)..(453): n is a, c, g, or t
  misc_feature (465)..(465): n is a, c, g, or t
  misc_feature (473)..(473): n is a, c, g, or t
  misc_feature (494)..(494): n is a, c, g, or t
  misc_feature (504)..(504): n is a, c, g, or t
  misc_feature (511)..(511): n is a, c, g, or t
  misc_feature (537)..(537): n is a, c, g, or t
  misc_feature (554)..(554): n is a, c, g, or t
  misc_feature (556)..(556): n is a, c, g, or t
  misc_feature (562)..(562): n is a, c, g, or t
  misc_feature (578)..(578): n is a, c, g, or t
  misc_feature (585)..(585): n is a, c, g, or t
  misc_feature (590)..(590): n is a, c, g, or t
  misc_feature (594)..(594): n is a, c, g, or t
  misc_feature (600)..(601): n is a, c, g, or t
  misc_feature (662)..(662): n is a, c, g, or t
acaatgcngnnctncgtgnagacnctgnctggcnagaccatcacccccgnggttgnncccngtgncnccntcgngnntgtccnggccnngnnccnngncnnggnnggccncccnccngccccgccgcggctgnnctttgcnggccnnccnctggccgctgggcnccccctgtctgcctcccccctcccgcccncgncccccctgcccctggtgctccgtcnccccggtgggctgccccnccncganccgccccncccnggccccncccnccccctngcggtggcgccccgtgcccccctcgcgcccgtccccnccncnctcccngccccggccggccttccncctagcacccnccgcngttgctctttgccggccacacccgnnggccgctgggcgccccccgtctncctccccccatcccncaccaacaatctcccctgccactgngtgctnccgtctcccgcnggtggagnatgccgcatctctcgatgccngcaccctgcnctggatncagcacccatccacccctccgcaggngggcagacccaatcgcncncccatnagaaccatgtcccagngccccancatcncccngcatcnnggccaggccttccctcctagcatacagccagcaggttagcatcttttgcacggcccccacn

SEQ ID NO: 492462 - DNA, 398 bp, Homo sapiens
  misc_feature (61)..(61): n is a, c, g, or t
taagcaaaaagaacaaatctggaggcatcacattatctgacttcaaatcacactcgaggantatagttaccaaaacagcatagtactggaatgaaaataggcatgtacaccaacaacagacaaacagagagccaaatcatgagtgaacttccattcacaattgcttcaaagagaataaaatacctaggaatccaacttacaagggatgtgaaggacctcttcaaggagaactacaaaacactgctgaaagaaatatagatgacacaaacaaacggaaacaggtcccatgctcatggatgggtagaatcaatattgtgaaaatgaccatattgccaaaagcaatctggtcattcaatgcaattcccatcaaaataccatcattattcttcacggaacta

SEQ ID NO: 492463 - DNA, 368 bp, Homo sapiens
tgaatagctttgcttggccaatggggttggggaatagggttgtctttcctatgaaaatgccatctgtagcccttgtgagtcacccgtccaaatgtttgcaggtgaattcctctgcttgacatcctccctgtccctttggaccctatgggagtgggcatctccccgcccctgggtatgtgaaagtccttttccatttccaagcaggggggggttcttatttttaaatttttaactctttatttttggatggataaagtgaactttttggcttctgtaagtatgctctatgcccctctaatgttttatcatgtatttatatgttgtacccaggactggctgattctgtaaatggatgttttggcccgaga

SEQ ID NO: 492464 - DNA, 885 bp, Homo sapiens
agcggagtggtgtcgagcgtcgagctcccaaaaccgagctggtgaggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttggaccattggattgcacggggattgaccccattccagtgtgagtggcagaacgcaagaaagacgccaaagacaggaacacgcgccgatgtagtcaccaagggcctataacggaacctctcaacgagcttaaggcctcgaaaggtcaacaccccggctggctagctctcagaaggcgcgacgaagagcacaggcacctactgccacttacgaactacaacgactgacggctctgacagctcggaagtctatgcgtcacgtctaccagctgacgcatacaccgacaaacgttccttcgggtacaggagacggcacggcccacgtcaacgacggcgacaacggggccccactgtgagccggccactaacccacggacggaacgtgctccgggaaggccacagatcacacaccgacgctctacttttacgggtcaactggaagaccatctgacgcggctcgcacgcctgctaccccacgaagcacgcgtcctacagacgcgcgaagctgcccccgggcccaccatcccctactcatcacgcgaccaccggcccccgccgcggcacccacgcccaggacgagaacgtgcactgaacgcaccccccccgcccccccccggccgctcg

SEQ ID NO: 492465 - DNA, 443 bp, Homo sapiens
tcatgtgacttcagtaatctatggtaattgaggctagttttacaatttgttggtaaaataacaattagaaatattattcagagatttacatttagagcatttttgcctgggtctactagtcaaattggtttagccctatttctggtaggtgtctataggtcatacttctgtcgcttttgtaatattgttgatacctgtttgattctggggtatagacaagtggccacgggaaggcctggggacacgtggatgtctgcagcacctaggccaagagctgtggggcagagctacgctacatgtcttccctggctcacttgtgcctcctgaaaatgctgggaggggttggttctccaggcattgctttcataactctgtccttttttctgggctctgtatcaagatacataattaaaattgcttacttcttaagacttttcacaaat

SEQ ID NO: 492466 - DNA, 1397 bp, Homo sapiens
  misc_feature (605)..(605): n is a, c, g, or t
agcgggggggtcgtggccgtgacgcgttgcgtacggcgtcggtcgccgtgctcggtgctggttagctcggcctcgtcctagtggcgcgcttccttccccgtgttcgcgccgtcggtctccaacctaggatatacggacgtggaaggccaactattgctgcttgcgccattccaccaaggataaccgttgcggaatcaccgtgcagagtacttggaagtcgtaggttattcaaccagatcggggtgtccctctagtataccgctggtaataaggtcatccatagcatcctacaagatttagtgatacgattagataaaggagaaattactatagagattgcgcgttgcgttgatcactcagcatggtgtggttctaagctgtcgagtcgtggaatacaatacgaggcaagaaaagtgcatcccgagcgtatcgcattgcgtagaaattaagcgtgcgcgatgcttatgcacttgttttaagcaggattgagggacgagcgtcctcgacgaagaacctaggtcgtgatcattcatgggagaacaacgcatatattgactcacgaagaatgagagctcggttagatccaactggattctccttccctnattgtttggcctccagcgaagcggcgattgaggactcccgttcatcggcatgtacattagaagagcgccgattgttgcctttgtgggcctaggggctgcccttcggaatgttgcgctgtcgttgtattcccctgtgggagtgacgccgatgcgcgggaacatgcagagggccactattacccctagggtcggctctcgacaattaggaacccgtcatgtatattggcgatgaagggttaaccgaggaggttttaatttaacgtgggacctcagtatgtgcgcagaagcggtgggtatgaaaaacgcctccatgagcaaaaagcgtataattctagtaacacaataaccagggaccccatggaaggaatatccggcaggttcaaacagactatccggaagtattcgctgaattggctgcaatgcggctgtttgcgtgaggaaagatccaagccacctcaaagaaacgtgggcctctcatgaacctgaaggacaagatctatttcttgtggcccgtggaagttagtgaaccccaatttctttctgcaaaggggaaatgggttagcagcgctgcaggggtcatttgacgaattgttcgtatgaacaggggataacctgggtggactggcgacaagaagtaacgagaaagggccccagttgcttctagcacttatgtgtgtaccacttggtggtgcaagtttttggcataacatttttattcccaacacataaggattgtgcagttgataaggacacaagaaaagaacattgtcacatttctgtaggaaaggtaag

SEQ ID NO: 492467 - DNA, 112 bp, Homo sapiens
tcctgcacaggggttggttgctgagggatccacatgagtttgatttaggtaagcacgctagctacatgccgtggcaccaagtaagcactcaataaatcactcaactcctttc

SEQ ID NO: 492468 - DNA, 572 bp, Homo sapiens
agagcatgcgtcctgtggcgcggctactaagttaggtatgtgaacatgctgatacttggataccatatctcatctctgttgccgcagtgagggatatgcattgtcaccgaattatcataatcgaccggaggctccggctccgctagttcacgtgactactacgtggcttcaggactcccataataggtgtcgtatcacaggcgagctcgcaagccgatgctcgagtatccattttagtccttgtcatgtacagatggggtctcaccatcttggccaggctggtcttgaactccttgacctcaggtgatctgcctgcctcagcctcccaaagtgctgggatgacaggcgtgagccacctgcacttggccttatatatatatatttttagagatagggtctcgctatgttgccccagggtggtcttgaactccttggctcaagtgatcctcctgcctcggctcccaaagcactaggtttaactgacatgagccactgcgcccaggctgatgtgtgcttttaatttaaattgttcggcagtcctatttggttgtgttttcctttaattaaatctc

SEQ ID NO: 492469 - DNA, 265 bp, Homo sapiens
gcccacggtatctgtaatgagcatggctgtttctctttgtatgaagtggcagttggctgtggagcctcttgattaactgtagataagggatgagattctgaaggaacactgacactagacttaaccaggctagaagtacttgatattcgctttcttctctgtgaaacaggtagaggaagatctactggattcttcaacatcatagtcaccaccagtcttttcagtactgctcctaggagccttttcttggggctccgctccaccg

SEQ ID NO: 492470 - DNA, 270 bp, Homo sapiens
agacagacattctgtggtttgagcggtacgcagtagatcgtggatctaacggaggcgatgatgaatgatgccattcatgatccatgggtgatgaggacgattaagagcagagtgatgctgtggtgccccaggttctggatgagctgggacttagcctaacagatgagctgtctgaacctcccctcaactgggggctcgcttagtgtggctgctggtgggaaaaaagcagaggccgcagcctcagccctagctgatgctgatgcagacctt

SEQ ID NO: 492471 - DNA, 2192 bp, Homo sapiens
agctcagctgggagcgcagaggctcacgcctgtaatcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcaacacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatatcaacacaaagtgacacttcatatgataaccgagagagatccaaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagccctattcccggagctacaggacctatcaagctctctcaaaaaaccattgtgcaaactccaggacctattgtacaatatctggatccaatgtcagatcgcatctcacacaatcactggtcaccttcagcacccgcggtcacccatggcacccataataatttcacagagaaccgcaagtcagctggcagcacctataagaatacctcaagttcacactatggacagttctggaaaaatcacactgactcctgtggttatattaacaggttacatggacgaagaacttcgaaaaaaatcttgttccaaaatccagattctaaaatgtggaggcactgcaaggtctcagatagccgagaagaaaacaaggaagcaactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgaagatgagtataccacaaggacagggagcccaaataaagaaaagtgtgtcagatgtaccaagaggacaggagtccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaaggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagttccaatattgttataagttaagacgtatatgattccgtcaagaaagactggatactttctgaagtaaaacattttaattaaagaaaaaaaaa

SEQ ID NO: 492472 - DNA, 157 bp, Homo sapiens
agttcctggtcccctcacggtctgtaccccaggtagcgggtgctggtcacgtgtgactccaggtgttcacattcacacttaatgacttcctaggcaccaatcatgtatttcaccgtttgcacttttggtatttcaataaaaatgtagatgcacacac

SEQ ID NO: 492473 - DNA, 1080 bp, Homo sapiens
tccgacgcaatcgggtaacttttcccgaccccacttgagaccacgttcgttccaatggtgcctgtgaaattaccaatacccaccttcggtcgctcttcgtgttataatgtttccatcgggccttaggcggaacgtgccctagtcaccctatgtgccccgtgataactggtaaaggataggtgacttgttttttgcaaccgaataagggtcatcttaccccggccgctaagcaactttcctcgtaacccgttgtggttatctggcgccttatctttacgcgacgggtaggatcgtctttgctgtactacgggtgccgtctctttgggccgtccgtggtgcctctgtgatgaggtgacatcgggtgccccctcgtggtccccgcctgaggtcttggcgctgttgtgcgtgggtttctcttctcttctgtttagtctcatctgttggttctgtgaaggccacctggtgtgcggatagtgccgtcgtggcgcaacggcctgtacaacttatctgatcatcggttatccccatgggacatggactcacctttgtccgataaaagcctaagtagatttgaaatgccatgccaagctgcatccgtgttgtgtggcccaggctgcgcccagtcgttcgcgccatgcggcatagccggtgtcctcgttctcagtgtcgtctccccggccgcgctggtttcgcgtcaccgttcgtctcccctgttccatgccggtccatgagtccccaccccatgtgttttaaaaaggcagtagcctttgcagggacctgtctgtcccaactgtttgaacagtgtgctcctcagattgctgtcgttccagacaggatcttcgctagcattcgagagcttgaaacctcttaggattatggggaataaaattatatatatatatattttgcttgttgctggtttcgcatttcttaatttgtgcattggaatgtgttgatgtgcacagctaatgattcaatgcgagacaagattggcgtctgctcgttgtggacgctttcaaataagccctccagcgggcgccgccagcgcgaccgggcgcggcgaagcgcgagcgagcgcga

SEQ ID NO: 492474 - DNA, 406 bp, Homo sapiens
gtacaacaagctctgtggttttatttctcctaaatgggaggaaacagagagaggaagaaaagtatgcaatctcagttgcaaatggaggcaggggctcaccatgttctctgatacgattgtaccgcccattggtaagaatcagaggctgaaaagattctgttactgaaactcaacacttagttgatacctgctacaactttaactactcgttgactgtttacggcttttgctgtaagttggagtatggtgacaaacacacaaaaaattgtcaaccgcagatgtagccatgaagtattatgagcgagtaatagcaagggctttgctgtcctctctctccactgttgtttcaaacaaacacaaaatcaacagcatatgcaatctcaataaaataacatagacatgtgaa

SEQ ID NO: 492475 - DNA, 662 bp, Homo sapiens
  misc_feature (419)..(419): n is a, c, g, or t
  misc_feature (452)..(452): n is a, c, g, or t
  misc_feature (635)..(635): n is a, c, g, or t
ctgatgtgggcctgaccaaacttcccttttttggctcaagccctgggcttcaagggctaaatccacaggcctttggctagcaagctgggtctccctggcaaggccatacctgggggcacctgggccttctggggtctgagtaccactcccctggcccaggagccacttccacttcagctggctgttttcagcaagttcccagggtccccgacaagcccctgctggtgtctccatctcctgccaagcattctccagtgcctcctcctgtgggcctggcctcaaggctatggacagacttctgtcccataccagagacccctcgtgatcgtgccctggcacgtgggcccgggccccggctggttcgctgaagaactgcggatggaagctgcggaagaaggccctgatggggcccaccatcncggacccaagtcttcttcttgcgggcctctcgnctactttctgggttgggcggaagccatcacctggatgcctacgtgggaagggacctcgaatgtgggaccccagcccctcttcagctcgtccttcacagacacggggacaccctgaactattttcacggacaagctggacccagagactcttgaccccggggcctccccttgagagagacccgncctctgactgatggccccgcttctggg

SEQ ID NO: 492476 - DNA, 290 bp, Homo sapiens
tttcattttgcggaggctgtggtggaggatcaccttagatccggaggctcgagatcagcctgggctacatggtgaaaccctgtatctactacacatgctaaaattagccgggcgtggtggcgcgcgccctgtgtcccagctactctttgaggctgggacaggagaatcgcttgaaccccgggggtggtggttgcagtgagctgagatcgcaccactgcactccagcttgggagaaagagtgagactccatgtcaaaaaaaaaaaagggagaattaccttaaaaatttttt

SEQ ID NO: 492477 - DNA, 467 bp, Homo sapiens
cccccggggggggccccttttaaaataatgggtccccccggctgcaggaatttggccccaggggggggttttaatttggggttggagttggttaaaacatttctggatttccttttttaccccctgggttatttggggttggttttaggggaaagaaatggagttgcctaattaaaagggggtttaatttaaattttttaaaaaaacccctttttcagggggggtggagaactggggttaaataaaaaaaaattccttcgccccaacaaattcaaacaggttcttttgtttttcaaaggtagtttagaaattcccctttttcctttttaaaaagactgtcctttaaaaaaattttttttgggaaaaaaggcaattagttttggaaaaaagaaccgttagggtggggaaccccccaaaggcccaaagggttttttcgttttttaaattaaccaaacaaaaacccctta

SEQ ID NO: 492478 - DNA, 773 bp, Homo sapiens
aggagcacatggattgcaagttgaagatagtccccttcataaggaacacgcgatctctctgaatccaatcctagagggtgaacaagataatgcatacatagacccaaggatacatgaagtctgaatgcttaacagcatgcaggaagatatagctgaatataaaataatatatggaattaattttcaagaggtgtactaatgtcactgggcacagtacagggtcaatctgtgccttacagcaggcgagagaccctgtggtataaggacggataagtattaaggacttgctttcttggaaaatagatgcaaatattaaacatgcaatcagctaaaaaagatgaataagaatatacaagcaaaaatataattaaaaaacagaatgcatggttaaagtaaatatttgcccagtttgatattaatacctacctaagaataactgtcattcttagttactcctactgctgctgttgctaggctaccatttttgagggcctactaagttccaagaactatactaaatacttcacattgatggatgttattttcctcattttgtagatcaattctatatgattgatgttaattcctttactttgtcgatgatgaaacaagctcagtttagactcattgcttgtgagtagtggagctgcattctgacccaagtaaattcaactccaaagctcatgcccttaaaaagaaaaaagtctgaaatctggtattctctacagcattcaagtatagacacatggaagttttaaggcatggggaatata

SEQ ID NO: 492479 - DNA, 125 bp, Homo sapiens
attgcaggtaagattacacactgcagtgacctgccatgctacccattctagcactgcccacatgcatgttgccgatgcactgaagagctcttggcccggccggcccccaataaacagtgtcctgg

SEQ ID NO: 492480 - DNA, 149 bp, Homo sapiens
ctcatttcaactttccatggcaatgtcttacaattctctttaggctagggccaggggaagaatccatggaattgaccacttggcaggacattaccaaggtaggggtggctatagagatttcagccgaaccaccctaggggatgaagcaa

SEQ ID NO: 492481 - DNA, 147 bp, Homo sapiens
tctagagcatccccgattacaattgcggagccatccgagggccgtgagggcatgacctgctattacctgacacacgttaaagctgtcggtgcagtcacactgcacgtgcaggtaggccttggggtgtcggttctccaccaccacgat

SEQ ID NO: 492482 - DNA, 247 bp, Homo sapiens
tgcggctaagtctgagcgtttatgaggtttttatgacctcttatatatgctttcataaaataaattgacatcataatgatagtagatcaatatatcaagtatttacataacatattaagtaaccaagtcttccccccaactttaacaaacaagcttttcttaaggtccccaagcccccacaaatttacagaaacgggcagtaaacttttcctgcaaaattgttttggcttcttaggcaatataagaa

SEQ ID NO: 492483 - DNA, 185 bp, Homo sapiens
gggagaggcctatagcggcacccgagaccccaccggtcccctcctcggcctctagtccctcggcaagcgccctgtgagtgcgccattcggaacattggacagaagcccaaagagccagattgtcacaattgtggaacccacattggtctgagatccaaaacgcttcgaggcacccggtcctctag

SEQ ID NO: 492484 - DNA, 160 bp, Homo sapiens
cagccgaaaaagattacaaatcagatagagcgttaccatcacggtatgaatctacgtatacaacataaaactagaaaaggtacaaagaacaggtagctataggaaataatagtgtaaatagcacgtatataaactggctattgaaacttctaaaactagg

SEQ ID NO: 492485 - DNA, 106 bp, Homo sapiens
agtaaggcgcagtagtagctggaatataggttgtacagatcgagcgaggagttcagagcctagagttggaccgtcttagagtaggagacccagaaggagccctgta

SEQ ID NO: 492486 - DNA, 493 bp, Homo sapiens
gttgactgatatggcaccatcactggggaaggctgaatagaggtggtcacggggagggcagatggcttaagggggtgtgacagctgattctggccggactctgggatgtagccaggagggctggatgggtctgctggagggtgctaacgactagtacacggtgcactctgaccagacaggttacctgaaagcagggggcattctattcccgagggaactgcttcgactagatttgctgcctttgctttctagctgggtcgtcgtactctctccctggaaaggggagcagctgtggggaatagtaacagcagggggcaccttgcccagttaggtatacaaagattcaatttcatgcttctggcgactctgcaggtcctgaatctctttgagatgtttatctcgtagtcgtcgcagctctaactttaagtcttcatcttcgatatctgactcattgtcgctactcatgtaggaggagttaaatgaattactaagg

SEQ ID NO: 492487 - DNA, 820 bp, Homo sapiens
cgcgtaacggaagataccttgcgattgctggatacacaacatcgccccttccgcacataaaattggtgcatcgagcgcgagttgaggccctgcatcgccaggtcgtcagtcggtctgaagtgaacgcgcagcataatgcgcgatttcgctgcgcctgcatggcggctacgctgattgttcctggtgaacaaggattgtgagatctgggccggtgactaagccgggcaatatgccttacaggacatgagtatccctgcacaatggctcgttagcttacatttaacaatgtaaccacaacaccctttagaaaccttgaccagccgcaggcaggcagttcatgcatggagtggcgtttcctctcttgcgcgttgctgctgaccgccccggactggggctggcgctggcacaaaaactggtgaccatgtcccatctgatggatcttcgtcagctaaacagtttatcggttcaagtctgtggttttatagtgctgggacgctattgagtattggttctgcgctttatctggcgacgctggttctcagcttggcggattaacgtcgattatcgcacgtacttcgaggcatactttgcttattctccttcgcctaaaggagcgtttatggatacagcaatcactgacgaaacggcgaaacgcctggccttgagttacccctttgatcgagctttgctggcctattggcccggagttcgatgtagcagacatggagggcagattgttatgctgtcgatcggagctacgcggagtcccttatcaatctgaggtcaggtcgacaagatacctgataatacagagtatacc

SEQ ID NO: 492488 - DNA, 107 bp, Homo sapiens
agtgtctgagaaggtgagaatgtgttatactgtatatggaaacctaatgcctcttttctaaagcgttgtacatttttttcgtgaaatagattaaatattttctctct

SEQ ID NO: 492489 - DNA, 128 bp, Homo sapiens
ttgtcagtgagcgttgtcagtggcgcaggaatttaatcaaaaaggccaaatcccatgtcatcatctgactcttcagactcctccttcttctcatcttacttctcctctgctgcagacaggggccagaa

SEQ ID NO: 492490 - DNA, 1115 bp, Homo sapiens
tccccttgaaagggggggggtggggggaccaccaaaaaaggggggggggggctcttgtcaccaaccctctcccccccccgcccccccccccccccgcggtggtacaaatgtatatttttgtgtgtgtctctcccccccccacacaaacgcgcgtggatatttcggggcgcaccacacacacacccgaccccgcgcggccacatgtggtggtgtttttaaagaaaaaagagagggggggcccccgcgaggggcgcgcgcgggcggggctctaaaacccgcgacgccccccggggaaatctccccgcgcgcgccccacacaccctccacacaagagaggaggggagaatctcacacgagggggtaaacccccctccacacacccaccacacacataatataaacacaacactccacataacaccacgcacgcgcaggaggagacatataatacacaccagcgccacgtagcctcaaaaaaaacataaatacacaagagcgtcactccgagcaggcgctagtcacacttgaccatatatagatgatcaacaccaccacaaaacactacccactgtagcgaacacaactaagcgacacacacaaacacatacactcatacgacactagtggtagaacaacaacaccccaactaccaacaaaaaacaccaaaatcatcacttctactacccttcttcacctaaaagaaaaccacacaccgggacgtcagaaggggaacaacacgggcagaaggacgcaaggggagaagaccacccggccggacacgatgtcacacccgacgcacaaaaacagtacagcaggagacacagcaacccaaaagaagctgacagagcatcacacatcacaccaggtgagccaagcagacaaggtagaacaaacaaaaacacaccccccccagcgggacggcaccaaaacaatcatcaaccaacgacacaccaccacaacccaccctccaacacaccaaaaaaaaaaacacacctcagcacacgtcggacgcagcgaagacaataacaagaatcaaaacacccacgccagagagggagcccccgaacacccgcgagaggcgcgcacagcacaccgcaagcactagagagcagaac

SEQ ID NO: 492491 - DNA, 150 bp, Homo sapiens
aatccaacatgctctcgaggcctgagcagagactagactcaagcacagattctggtgatggagtaaagtacagcgtatctcatgtctcacaagagaggacgtcttaagctcacacttctgaggggatgaccatcagtttggctagatcct

SEQ ID NO: 492492 - DNA, 524 bp, Homo sapiens
ccacgcgtccggagccaacacagatctatagatttctttgaactcggaatctcatagcagtaagtagtcaacaaaattcatcaatattatttctctcttataactgcatctgtattcaattttaaaaatgttaaaattgaatacagatgcagttataagagagaaataatattgatgaattttaacatttttaaaactctttttgtagccaatatttttgcacagaactcttacttacatgtctcatcgaaactccagaacaaacatcaaaaggtacattttatgaatcttatttcaagctgatcaaaccatgttagttttattttaaagtactatttctcaaaattaaaaaaaagaacaaaaataagtactatttctaactaaagatttaatatgaaaactgaagtgagagagtgactggttgaattggttgcacagtggttttcaatagtataatctttgtaagtctcaggttgttattagctctttttttttttcccctaatagaaatgaggctgggtgtg

SEQ ID NO: 492493 - DNA, 759 bp, Homo sapiens
  misc_feature (476)..(478): n is a, c, g, or t
  misc_feature (485)..(486): n is a, c, g, or t
  misc_feature (579)..(580): n is a, c, g, or t
caccatgaggattgcacctattttatgcattatgtcatatgccattttcataagcctgcacgttaatctccaaagaagaggatgctcatgatgatccactatagctgcccttagttctatacgtacagagctttctgttcatgacgtaccagcggtcacatgtacacttgcatagtctctgagcatcgtgagctgcaaattcagcgttatcggtagtgcacggtgacgagtgtcactactcatctgacatgtcctcctgatatgtcgcttgagcgcactaatatattctctaagtgcataccggtgaaactcccctgctatgctctaatttcccaatcatctatattacatctttcaatttaattgttaattgtgaaatctgcatgactgtgcgtgaatcacgcagcactacgttaatatcactgcttcctaagctaagtgcgctacaccatgtttggtatacacattaactcaannnactctcnntaaaaaccataattactgttgcagtacagaattttgcaagccaaggaactaaaacaggcaggtctgaaagcaaaactgtcctaatacgaatgnncagttgtttgggaaaatggtctgatcttctcgattatgacaacccaactttgatcacaacttgtttggttcttttgaaccttgggatctaaatctgacattgcttttcacttagttaaacacaaaaggttaatgttaaaaactacttttaaacttgtatatgcctgccatctgaggtga

SEQ ID NO: 492494 - DNA, 387 bp, Homo sapiens
tcttaaaaagtttatgcattaatttgtcatatcccacgaaatttcactctgaagtatcttctcaaagaaatgaaaacaggtccacacaaagacgtatacaccaatatttagagcagcatcattttactttattttgagatggggtctcactctgttgcccaggctggaatacactgatgcaatcacacctcactgcagccctgaaacttctgggccctagtgatcctcccatctcagccccccgagcagctaggactacaggtgtgtgccatgcgctggccaacttttttctattttttgtagaaacagggtctcgccatgttgcctaagcaggtcttgaactcctgggctcaagcgatccacccgccccattctccatagtgctga

SEQ ID NO: 492495 - DNA, 142 bp, Homo sapiens
tccttgtactcgggataggattggctctatgggctgggtcggtcgggctggggcgctcgttacggagttcgttacggaggcgtcgttaggatggcgctcgttacggaagcgctcgttacggaggcgtgttaggaggcgctcg

SEQ ID NO: 492496 - DNA, 808 bp, Homo sapiens
taccgcatagctaggaggtgcagttggtgggcttgaggctcactgcactgcagcctccacctccctggagtcaagtgattctctcacctcagcctcacaagtagctgggactacgggcatgtgccacaatgcctggctaattttttaattttttaatattttttattttatttttttttgagacagagtcttgctctgtcacccaggccggagtgcaatggtgtgatctcggctcactgcaacctctgctcaagcaattctccctgccttagcctcctgagtagctgggattacaggcgcctgccaccacgcccggctaatttttttttttttttagtaaagacaggattttgccattgttggccaggatggtctcaacgctcctgaccatcaggtgatccgccacacctcagcctcccaaaggtgctcggattacaggatgtgagccaccacgcccagccttatttgtaatataaatataattcaattaattaatatggagatggaatttaaatctttgtttgcccaaggctggagtgcaatggcgcagatcttggcctcactgcaaattcaaaccccccaggatacaagcaattctccatggtctcaggcccctgagtagactgggatatcaggcgcccagcaccatatccaggctaattagggcatttgttacagtagacaaatgcggtttcccagtttcggcaagtgatttgagctctacctcagtgacacctgctacgcccaagtgtggcatcagggttacacgactcgtttatttttgacaaccattgtttcgcgatacgaa

SEQ ID NO: 492497 - DNA, 931 bp, Homo sapiens
cacgagctccctgtgggcccaaggtctacaaaaagcgtagtactctaggaccgccggacagtggccgcgggctgagcacgcccgaatggggacacccgcggtggtggataactgtgcgaagagcgcctacctacgggaacacgagccgtccgcgaacccccaaagacttggggaaccagagagacacagagtctgctgagccgggtacatcgacaggcgttctcccaacgagagtgaatcccatggggcccgccacaaacagtggattgccagggagtgcaaaaacaccagggtgaaaacggccacagacgtgcgtccacggattcagaggaaataaccccactcggggacaacaggaaacaaatgcgcggcaaacagctaataggagaaccaccgcctgggccaaaactttctgccggaagttaacctccccgttgccccaccaacgatacaaagggaaatgtacggcccccggaaaaagtcacattattccccggacccctccaaggtgttcctccccacaacaccgcgggtgatcaatacccgccgggtttcccaccccgcccgcggccttaaaaagatgaagtacaggctcccccagtccacacaagaagacgggcagcaatacacctcctgggaacatattccccagggaggtcctgataggaacagcggtgatatcgaggccttctcgggcgctcagcaacatgtgatacttaccacaggggggtaacaccgcggccccctagtggtgcaatccaggactgcacaccgaggaacccaccagttgacgagggtgagctagtttccacaaacaaggagagatgtggggctcaccacaagaacccacaaaggccaacagtcgttgcgtaaaagacgcaaacaggggcttgcgcccaaaaaaaaacaacttttttcgcccaacaaaaca

SEQ ID NO: 492498 - DNA, 166 bp, Homo sapiens
catacctgctgcaaatgccttgacactggtgtgacagccttttaaaaactggtgtttggggctgctctccctccagtggattctcagacagatgccagagtaactttgtggaagtagaaatccaaagcattgactggtgtctagtgggaaatcggtaaaaaaaaaa

SEQ ID NO: 492499 - DNA, 863 bp, Homo sapiens
  misc_feature (46)..(46): n is a, c, g, or t
  misc_feature (769)..(769): n is a, c, g, or t
  misc_feature (844)..(844): n is a, c, g, or t
acccctcaggtacctcttccaaggctctgcagggatcccagcccanaccaacttggtggaaacatacgaacttcaagaagctactacacctatgtcttcctttcgattatgaggtctttgtagaattgaaatacggctcagaggatgatggataaacacagtatcccagaccagggggaaaagacagagcgaaaccaaaatctcctgagatctcacccagttccctccttggtgtatcttatatcagtcacctccatcgatttatttattactcaccctgtcctacggattaagtttctcttaaacctgttcctcccctgaaccctggcagccgcctaagtaaaatgcataagatctgatttgggggaaagtatgtgatcggcatgtcagatctagagctatggaagaagcaagagccaacgagctctacattgacccaaaattctaatcagaagacccatcaactcagacagggtctctctgtgtagccccctgaatatcctggaattcaatcgtagaccgaactggccttgaactaaaagatctgcctgcctctgcctcctaaatgctgagattaaaggtgtgcaccaccacacccaactgaacagtatcagccttaactgaaagccaagaatccaagatcttggcaatggatccagcaagttgtcacttctaccaggtgagcagcagggctcagagcagctggcatcaggaagatgacagagatcaccaagctcaactataacccagagaaggactgagcaggggncccttctaccttctagtgagacaggttctatgtagacttggtacactgggtaggagttaaatttgcagccagaanaaagacagggcaggaaagc

SEQ ID NO: 492500 - DNA, 109 bp, Homo sapiens
tgaatcatgtacaagcttgaagaacaggattccacccaggcaaccacacaacaatgcccagctggctggcagcagctgaaattgattgaagaaccagtcagtaaatgca

SEQ ID NO: 492501 - DNA, 661 bp, Homo sapiens
  misc_feature (44)..(44): n is a, c, g, or t
  misc_feature (69)..(69): n is a, c, g, or t
  misc_feature (73)..(73): n is a, c, g, or t
  misc_feature (98)..(98): n is a, c, g, or t
  misc_feature (127)..(127): n is a, c, g, or t
  misc_feature (143)..(143): n is a, c, g, or t
  misc_feature (154)..(154): n is a, c, g, or t
  misc_feature (159)..(159): n is a, c, g, or t
  misc_feature (257)..(258): n is a, c, g, or t
  misc_feature (263)..(264): n is a, c, g, or t
  misc_feature (282)..(282): n is a, c, g, or t
  misc_feature (287)..(287): n is a, c, g, or t
  misc_feature (302)..(302): n is a, c, g, or t
  misc_feature (330)..(330): n is a, c, g, or t
  misc_feature (332)..(332): n is a, c, g, or t
  misc_feature (366)..(366): n is a, c, g, or t
  misc_feature (375)..(375): n is a, c, g, or t
  misc_feature (393)..(393): n is a, c, g, or t
  misc_feature (395)..(395): n is a, c, g, or t
  misc_feature (401)..(401): n is a, c, g, or t
  misc_feature (412)..(412): n is a, c, g, or t
  misc_feature (453)..(453): n is a, c, g, or t
  misc_feature (478)..(478): n is a, c, g, or t
  misc_feature (485)..(485): n is a, c, g, or t
  misc_feature (492)..(492): n is a, c, g, or t
  misc_feature (507)..(507): n is a, c, g, or t
  misc_feature (522)..(522): n is a, c, g, or t
  misc_feature (529)..(529): n is a, c, g, or t
  misc_feature (544)..(544): n is a, c, g, or t
  misc_feature (548)..(549): n is a, c, g, or t
  misc_feature (578)..(578): n is a, c, g, or t
  misc_feature (652)..(652): n is a, c, g, or t
gggggggggggggggggggaaagagggtctctggaaggacaccnttaggatcccctgactcagggtgcnaccnaaacgggcctggtgttctgggacgnccgggatggagtaaccccaaaaacctccntacgttcaagggaccnttgggtttgtngagtnctttgttggatgagggtcaagatctaggtcaagctgatttcagcaagggtgtgggggttgggttttgtagccccaagatttaattcactttttttatnnggggnnaggaaggtaattttaggnttttntagttaggaaaaggnccctgaaatgtggaatggtgtgggtgtntngggaggtcttgatgtgccaagttggaataaatgntgtggtttnaagaggttgatgaagacngnagttgnttaatttgganaagggttaggaataattaatggataaggggttatgtttggnagaagcagtttttaagaatgagganagaaggngaagctntgagggtgagaaggnggggggttgcccctntcttctnagggctccagagttnatcnngaggggtccctggtggaggctgggccagncggtgccccgatcagtgcgggtgggtgatgagggccgggggtggagtaactgggggcgcaaattttggcgggtntttgctgtc

SEQ ID NO: 492502 - DNA, 336 bp, Homo sapiens
tgaaggctcaaataaagttataccatggagtttctgtctaaacatgaccactactagtcctgaattatcagagtcttaggatggcttagagtaatctcgttcatttgtccttgctttttccttgttttaaagacaagtacaggcaagaaaatggctactctcaagtaaggattattctgaaacacggtctggatttagaaaataaatgaacattagggaaatttccttaattaagactctccaaaccaggtgtggtagctcatgcctgtaatcccagcactttgggaggcagaggtgggtggatcacctgaggttaggagttcgtgactagcctgg

SEQ ID NO: 492503 - DNA, 428 bp, Homo sapiens
  misc_feature (331)..(331): n is a, c, g, or t
  misc_feature (360)..(360): n is a, c, g, or t
  misc_feature (376)..(376): n is a, c, g, or t
  misc_feature (390)..(390): n is a, c, g, or t
  misc_feature (405)..(405): n is a, c, g, or t
gcttcaataccctgtctctacaagaaatacaaaaactagctgagcatggtggtatgtgtctacaatctcagctcactgcaacccccccaccttccgggttcaagcaagtctcctgcctcagcctccccaacagctgggaggctgaggcaggagaattgcttgaactcgggagggcagaggttgcaatgagatgagatcgccccattgcactacaacctggggaaacaaaccaagaccccgtctcaagatttaaaaaaaaaaaaaaaaaaaagatctttaattaaggcggcccgaagcttattccctttagtgaggggttaattttagcttnggcacttggccgttcgtttttacaacgtncgtgactggggaaaancctggggcgtttancccaatttaattcgnctttgcaggcaaaattccccttt

SEQ ID NO: 492504 - DNA, 212 bp, Homo sapiens
ggaatcaagttaaaaagacaagtagatctatcaacagaggtcatgtaatatagaggattataagtactaaacattaaaaaaaagcggggatggggaataaatcagaccaatacctgaagcggaaagcatctacaacacgaaacaaaactggagagaaaagaagttgactttatcaaatctagtagctcagttgaatgcgtccgtcgaagttg

SEQ ID NO: 492505 - DNA, 235 bp, Homo sapiens
aaccccgccgacccttctggacatctgagcagcagagctgatgtcttacttctaggacacaagccccatccggacatttacagaggggcatatcttttctgtacatctaaaactgttttagaataaaaagataaaaagtcactttttttttgtttttttgttttttggtttcgagacagagtctcactctgtcacccaggctggagtgtaatggtatggtcgctcggcgtgtgca

SEQ ID NO: 492506 - DNA, 311 bp, Homo sapiens
  misc_feature (4)..(4): n is a, c, g, or t
  misc_feature (23)..(23): n is a, c, g, or t
  misc_feature (37)..(37): n is a, c, g, or t
  misc_feature (67)..(67): n is a, c, g, or t
  misc_feature (197)..(197): n is a, c, g, or t
  misc_feature (239)..(239): n is a, c, g, or t
  misc_feature (268)..(268): n is a, c, g, or t
  misc_feature (307)..(307): n is a, c, g, or t
tggnccttaaagaaaatgtcagnctcctacaatctangcctgactgttaaggaaagagcacccacanctgctcctacttagctttttttctgtgggtcttacacagtaatcctttttttcttttcttgaaagagactcctcctttcttttcttttcttgaaagagttttaaagagataagatggcaaaagtgactgntctctactcccccagtttgaatggtaaatttgaatggtaaantcccatgaacatatatggaaatgtctttntcctactttctccaataaaggctgttcttagcttttcanttgc

SEQ ID NO: 492507 - DNA, 206 bp, Homo sapiens
cctattaaatggctgtcatcttgaaaacgacagactatggtgtaaccatgattctattatgtattaggtacgtctgtagaccaagatataatttttttaaaaagtaagtttatttctttcaaggtttacaaatgacaaaggtgcaccttgttatttaataattgccattatatgataagagcgtgcatgcacagtccatttagggt

SEQ ID NO: 492508 - DNA, 1240 bp, Homo sapiens
ttcgtcgaccacgcgctcgggtggcccagcatttgggtgagagcacagtaaggactactgctatggatggtacagaaggcttggttagaggccagaaagtactggattctggatgcaccaactcaaaattcctgtcggtcctgagacttagggcagaatcatgaatgtcattggagaacctattgatgaacagaggtcccatcaaaaccaaacaatttgctcccattcatgctgacggctccagagttcatggaacatgacgtgttgagccacggaacatctctggctgactggctatcaacggttgtcgactctgctagctcccctatgccaagggctggcaaaacttgggctttcccggctggtgctggagcttggcaagactgtactgatcatgcgagcttaatcaacaactgtctgccaaacgcccactggctggcttactcatgctgttctgctggctgtcgcgtgcacgacggaccctgtgcaaggcaactgactttactactcatgaaactgacttgatactctcggtgctcactcacacctccatccacgcatgccacctcctaacggtacccgctggctatatggctccaactcgacttgcacccacctggctgcctcgctgccccggcgctagcctctgcactgcgcgctggaacctgatgcgcctgccttaccttctcagaccacccaaccacacgctcaacgactgctacctgctcattcaccccgcctcccccctcctcccgccttcaacccaggcctgcctcagcacgcgccctgcactccctagacgcccacaatcccatccctgctggggcgccctacccaacccctacccccggccccctcggacacgggcgcacttactgccccggcacacaacccacgcccactaccacgaacgacgagccaaaccccgccgacccacccacaccacacgcccgccaacatcacctccaccgaacccgcgccccgcgaccacaccaggcccaacgcgaccccctccccattctcttccccctcccaactctatacactaccttccttcactcctcccccctctcaactaccctcacatccatccataaccaaactctttcctccacctccaccttttcccctctacactcctttctctcttaatcacccccacccctccccccttatcacctctcccacccccccttctccccacacaccctaatctatctcatccacactaaccctcaca

SEQ ID NO: 492509 - DNA, 898 bp, Homo sapiens
caacccccgcggaggaggtcaacataacacggagctcgcgttgtaatggggaccggtcgagaatcgtccctcggtgatactgccaatgtcaacgctcgtgtgttggaccccgccgatagagaagagacaagccgggggacgcggaatgacccaggccgtcctggggactgcttaagcgctgaggcccgccggggtaccgcggatatacacatcaaggtgtgcgaccagcaggggtagacacgcctgctataggacacccttgcagagtccctaatgtctaagggggagacaccccgaattaggaaagacacagaggtgttgaggaacaaccaagaaacgcacgtgggctcggttaaccgggtgcccgggagaatttccccgcgggacaatattcgtccggaaccacaaacgcggtccggaaaactatgcttcaaaaccgcgacatccgggtgatctgttgagataggcgcgaacttgatacccctggggcacgccgccgactaatgggccgcgattttagggaatacttgacagcggattgcggctaagtgatgcagcgtacagcgttggtgcacgctttcgagcaagcagcggcctatatcgcgacggtcttctacctaaagggatacccccaatagttttgccaggcccgcaatatcgggtatttgtttctttacgcgtgggtggccgccagtttgttagtgttttatcttatctacacatgggggactgaagagttcgagagatccccagagggagaatcccgctgcctatgaaaatggccaatgagcacgcatccggatgacggttccctgttctttgaaagaccttttttctggaagaggaggtactgcacttgtagtgttctcaaagacaccattaacttcctatggtctga

SEQ ID NO: 492510 - DNA, 537 bp, Homo sapiens
gatggtcaacaaattcctatgcaaaagacttgacagaagcagagtttcctacgaatttcaacacagcagggtacaaaatatgctaattttactaccttgtacatacactggcaacctctttaacatctagagactagatgttgaaaaattaggactatttgtccattatatatactatatacagagcggaacaaaatagcacaaaacatatagaaaaatggtgtctgaaaatgtccaagtatgaacacactagtcatattaccttaagcaatttcatccctccttcctcctctaaactattgaacaagtatagacattactatactgttcacaaaggtggcttcacaattcaatatccaaaagcatttcctatgaattacagcaaaaagataatttacaaagtggtattttactacctatacatataacatacatcgggcacttctaaacatctagataagactcagatgtatcaagtaaggagtcaatacgtctactctgtatacagcagtcttgaataagctgcaaacatgtaac

SEQ ID NO: 492511 - DNA, 383 bp, Homo sapiens
aaagatactggagaatcgtccacggctgcaggaagcatttcggtttccttctgctataagtcctctcagggaaggctgtcgccgctaccgctgcattaaatagttatgtacatcgcagagagtcccaggccatgggcaggtggaagaggggcgtcatatcaccaggggccaaattatatcatcgtacaccgcactggtgaactttgtactttttcacttctagccatgtactatggaacacgcgaaaccatatacttgtaaatacctcatcctccgtcttctgcttcttggctactattcccgtcttgaaggctagtttgttcccgcctctgcgtttggccacgaagctaagtgtagagcccggaacaccctcctctttcgga

SEQ ID NO: 492512 - DNA, 455 bp, Homo sapiens
  misc_feature (90)..(90): n is a, c, g, or t
ttgggctcagtgcctggcagaaaatgatttcactggcccttttgaaggcaagctgggatgggaccttttttaaactcaaggttaagaatntaggtccgccctcaagcccatactgaccatgcctcatccagagctcctttaaagccagggggctaacggatgttgtgtggagtcctgggtggaggtcctcccccagtggccttcctcccttcctttcacagcgggtttttttgccaggaaatgggggaaggaactaaacccccctgccccttgaaatgtttctgtaaatgggtacttgtgatccccctccgggaatctttgtggtatatacctggggccattttaggttttttcaagtgacttttggaaatcacccttttttatttgggggggaggatggggaaaaaagctgagagtttatgctgaaatggatttatagaatatttgtaatttta

SEQ ID NO: 492513 - DNA, 249 bp, Homo sapiens
  misc_feature (116)..(116): n is a, c, g, or t
  misc_feature (133)..(133): n is a, c, g, or t
  misc_feature (158)..(158): n is a, c, g, or t
  misc_feature (179)..(179): n is a, c, g, or t
  misc_feature (208)..(208): n is a, c, g, or t
  misc_feature (241)..(241): n is a, c, g, or t
  misc_feature (246)..(246): n is a, c, g, or t
ctgttttcaaactcctgggcttctcaagtgatacttctgcctcagccttctgagtagctgagattacaggaacgagccactgtacatatatatatatacacacacacacacaccgngtatatgcccagtaatntgattactggctcaaatggtatttntggttctagatccttgaggantcaccacactgtcttccacaatggttganctaattgacactcccaccaacagtgtaaaagcnttcgnatt

SEQ ID NO: 492514 - DNA, 468 bp, Homo sapiens
ggagtccagacagcctggcaatatggtgaaacccatctctactaaaaatacaaaaattagctggacgtggtggtgcatgcctgtaatcccagctactcaggaggctgaggcaggataattgcttgaacctggaaggcggaggttatggtgagtggagattgcgccattgcactccagcctgggcaacaggagtgaaactatgtttcaaaaaaaaaaaaaaaattaaaaaaattagccaggcatggtggcgtgtgcctgtagtcccagctacccaggaggctgaggtgagaggaccacctgagcccgagaggttgaggctgaagtgagctgtcatcacaccattgcactccaaccggggaaacagagtgagaactggtctcaaagaaaaaaaaaaggagggttatgaatttagtatttttatatttcccttaaaattctagtatctctgaggaaaagcctcaatcagaa

SEQ ID NO: 492515 - DNA, 409 bp, Homo sapiens
  misc_feature (312)..(312): n is a, c, g, or t
ccttgaggcattgcctgtgagaagcctgcagccggtatgggccaggccccagcatactcggccacctcggtggatgtccccactccagtgcagggtgcccacggggaccggtcatctgggcatgtccagcctggagcagctggagcagaacttggcagcggcagaggaagggcccctggagccggctgtcgtggacgccttaatcaagctggcatttggttgctcagaatgtcccaatacttccgctaggccctcgtttctcaggctgcccaagcttttctgtaaactcttttgttaatccacatttccttnaattaaaaacgcctcagtaaattcttagggatggaagtatttggacaaaaacctaatagaagagtcaccaccaaatgaagaataaaactaacaaaaa

SEQ ID NO: 492516 - DNA, 125 bp, Homo sapiens
ccagaactgttcgacagagttgggctgccggactcgcgaaactgcctagtgggcactgtgctactccttccggggtggtgaactccttgcgtctcactgtcgcaggccgcatcacgctctctcca

SEQ ID NO: 492517 - DNA, 356 bp, Homo sapiens
agagatcgatgtggcctggcgatgtcaaggtgcaagaacttctatgaagccaaggtccaagccttgatacatcggccagtaagtatgaagcagagtagaaagctgagacaagatgagcggcaagcgggaggcaggagagagaggcggctccgaccaggcagaccttccagcaaactcaaggccaacattcaatacatagctccgtgctgacacttgccctactgcccacagactgtgcctcacagtctgccccgacgaagagatgactagcgcctcttcatcactcgctgtcggtcccctccctgagccagcatctccatccaccaccccgtgccagctcccgtgccagccttcat

SEQ ID NO: 492518 - DNA, 1289 bp, Homo sapiens
gccaatggaacggccctggaagagacccttgtggtctgactccgtgagcttcaaaaacatgtgaggagggaagagtgtgcagacggaacttcagccgctgctctgttctcagcgtcacgtgcctgcctactgacccctgtccagagcccaccaggccagcgatgtcctctgtctcacttcaacctgaggccctgcctacgtggctgtcagccgaggttaagaaccaagctggcccagaagtatgaccagccagctgggagcaggagctgatgagagtggatctgagtgcgtggtagacacgtgccgtctgcatcggcaacaacttcatggacggccatcaacagatggcatcatactttgcgaattcatcaataatgctgccggccagtgctccgtgaaggaagatcaatgagtcaacccaaaattggcaccagactggagaacatcggcaactacatcgaaggccatacaccaagtatggggtgaagcccctacgacatatgatgagtgccaacgaacctgtatgagaacaactatacatacacaggtgcaagtaccacgactacctgggctttggaccagacaatggcgaatgacgcaaacggaacacaaaggtgcacacgtgagcaggtgagcgctactgccagaaacaatagtcagtgcagcgtggcacattcgattctcgctggtcaagcctaagcacgatcattggtctggcaacgaatcaatagtgtgcatgccagactatgggcaacctaactaatgttgtgcccagtaccaggcactgggcaataggagagggacaaatatgaagcgaagcacgagaacggccaaaaccattaatacgtaataacgcgaaaagtacattggagcacaatggaaccgatgaagcctcagtgaaacaccgagaagacacgagtgcaggatccgttcatcaactgcggcaacgaagaacaaagatgatagcaaagaacagtgcagtggatatctactgcacccaggggaacgacaaatctggcaacgaaatctttacggacaggccgtggcgttacagtaggcacaatggaatggcacagtgcataaagatgagcccagggtttcataccatgtggcaagatagggacgagcaaaataaaagtgcgagcactagagatcgatagagcgttaaaagcggtcatattatcctatgcacagtacagtgttaataatagaaccacaggaaactgtataaacatacccggtgtcacctgtagcctgaggttagtcctcgcccaataaccaagccacgt

SEQ ID NO: 492519 - DNA, 694 bp, Homo sapiens
gtggggcctctgagctctgctcttccggtcggatctctctcctctctgacctggactcacgcgttgtgtgtgctcaacttctgtacctacaaagaaatagataattcaataatggttatcctgccttatctgctaatacataatatatattaccatataaaagtgattaaatgagaaacaatggaatgagtggacttcatattatatgacatagcttttacatatttaaattcaccttgcaataactactgaatatagtcattcttgaaagtatgcaagttgggatttggttatattacaaaaatgtcaatcaagagtattaaaaaatagttaatgtgatagaaaaaccttacatatttttttctttatgttggtttagcgactttaggcgaaaactgttttcatataatctcatcgtgtttacctagaagataggttaaggaaatatattattattccgtgttgatgtgggtgaaggcagagatctaacctggctgtgtttagggccataccacttagtttagaaaatctgtgctagaacctgtgtcttattcctataagctatgtgttcagactgaaactggagaaattatgactatttatttatagtagtagttaaatctgaatgtgtatggacaaaaatatttaatggtcaagtaaatgtttaattcaaagatagttatgaccttataat

SEQ ID NO: 492520 - DNA, 930 bp, Homo sapiens
  misc_feature (18)..(18): n is a, c, g, or t
  misc_feature (26)..(26): n is a, c, g, or t
  misc_feature (28)..(28): n is a, c, g, or t
  misc_feature (30)..(30): n is a, c, g, or t
  misc_feature (36)..(36): n is a, c, g, or t
  misc_feature (48)..(48): n is a, c, g, or t
  misc_feature (54)..(54): n is a, c, g, or t
  misc_feature (59)..(59): n is a, c, g, or t
  misc_feature (64)..(65): n is a, c, g, or t
  misc_feature (73)..(73): n is a, c, g, or t
  misc_feature (77)..(77): n is a, c, g, or t
  misc_feature (107)..(109): n is a, c, g, or t
  misc_feature (111)..(111): n is a, c, g, or t
  misc_feature (123)..(123): n is a, c, g, or t
  misc_feature (126)..(126): n is a, c, g, or t
  misc_feature (133)..(133): n is a, c, g, or t
  misc_feature (137)..(137): n is a, c, g, or t
  misc_feature (143)..(144): n is a, c, g, or t
  misc_feature (147)..(147): n is a, c, g, or t
  misc_feature (151)..(153): n is a, c, g, or t
  misc_feature (186)..(186): n is a, c, g, or t
  misc_feature (209)..(209): n is a, c, g, or t
  misc_feature (220)..(220): n is a, c, g, or t
  misc_feature (224)..(224): n is a, c, g, or t
  misc_feature (228)..(228): n is a, c, g, or t
  misc_feature (232)..(232): n is a, c, g, or t
  misc_feature (247)..(247): n is a, c, g, or t
  misc_feature (258)..(258): n is a, c, g, or t
  misc_feature (278)..(278): n is a, c, g, or t
  misc_feature (299)..(299): n is a, c, g, or t
  misc_feature (362)..(362): n is a, c, g, or t
  misc_feature (395)..(395): n is a, c, g, or t
  misc_feature (451)..(451): n is a, c, g, or t
  misc_feature (468)..(468): n is a, c, g, or t
  misc_feature (493)..(493): n is a, c, g, or t
  misc_feature (536)..(536): n is a, c, g, or t
  misc_feature (539)..(539): n is a, c, g, or t
  misc_feature (567)..(567): n is a, c, g, or t
  misc_feature (677)..(677): n is a, c, g, or t
  misc_feature (763)..(763): n is a, c, g, or t
  misc_feature (831)..(831): n is a, c, g, or t
  misc_feature (909)..(909): n is a, c, g, or t
gagctgctccgcggaacnccgatctntncnccggcngctaccttagcngccgcngatcncccgnngccattcnaccnacgctgctgtggtcgctgctgctgttgctnnnanttttcgtcgccncanccgcggncccnctagannctntttnnnagctgcccgctcctcagcacccgaagattcgcntgtaaaacgcagagaaggtcctnagttgggagcnaatngccntganaaatagcacgaggcntgttgtctacngagtgcagtttaaatacacngacagtaaatggttcaaggcngaaatcatgtacataggggttaattttatacagattaaagcaacagagtgtgacttcactgcngccagttcctcagcaggcttcccaatggatttnaatgttactctacgccttcgagctgaactgggagcactccattctacatgagtganaatgccttggtttcaanactatcggaatgttacttttgggcntccagaaaacattaaggtgaccccaggagaaggctccctcatnatnaggttctcctctaactttaacatagatnatacatccacggcctttttttattatatatgtacattactaggaaaaaggaggaatccaacaggtcaaaggccctttcagaagcaactccatttcattggataacttaanaccctccagagtgtactgtttacaagtccaggcacaactgctttggaacaaaagtaacatctttagagtcgggcatttaagcacantatcttgctacgaaacaatggcagatgcctccactgagcttcagcaagtcatcctgatctccgtgggnacattttcgttgctgtcggtgctggcaggagctgtttcttcctggtcctgaaatatagaggctgattaatactggttnacactccaccaagatccatta

SEQ ID NO: 492521 - DNA, 454 bp, Homo sapiens
aacggtcatccttgacctgcccctggtaattggcaggagatcaggtctaagcagcagaacatccagcatggccagccgaaccagaatctgagcatgagttgggtagagtctgatacagtcccatgatagcccagaagctcacgtccctgctatatggatgtcattcctgaagatcacctgacttgtgagtagcccaaacccaacatcacctctggcctagactggaacagtgggaattggggactgcggtcaacgtaacaacggacacgtaactacatatttactggtaatgtaccccctgcaggttcaatgtatacattgcctagccacacgaactgtattacttgacgggtaggattcgcactaggcattccatcaaatcaaaccaactgtagcgatgtggaagcgaatgtgtggaacgacaacaagacagccagctttaaccctaccttag

SEQ ID NO: 492522 - DNA, 155 bp, Homo sapiens
gcagaagtgtaaacgacacaaaaaagcacaaaacacaaaacaaaaaccacaaaacaaaacaacaaaaaacgaacacgctccaatacctcagagaactctctatcactaaggactttcttacagaagatcttcaccccgtgaaagcaccaagaaac

SEQ ID NO: 492523 - DNA, 255 bp, Homo sapiens
  misc_feature (155)..(155): n is a, c, g, or t
  misc_feature (174)..(174): n is a, c, g, or t
cgcccagtgttgcgctccgagcacaccacacgcgcgcgcgcgcgcgcgaccccgccgatcccgtccactctcgagtgccggcgcaggccggatatgggcccgacgctccagcgccatccatttgcagggctagttgatccggccggtgcgttgtnccacactccttagcggatnccgatttccatgggcacggtcgtgttgtttatatcaaccaacaccttttcgggggtctgatgagcgcaacagggtaccgag

SEQ ID NO: 492524 - DNA, 185 bp, Homo sapiens
acatattactcatcatggtaacaaacttatatttaggcatgggtctattgatctctggggatcaacaagttttttttcttgggtcctactcaaagtaaacaagtatggagatacttggctatgagtgaaaaattacatcatcggagataaaggcgtttcaaaatccagcttcatcttggtggtca

SEQ ID NO: 492525 - DNA, 696 bp, Homo sapiens
gtgcctgccggccgtgtggggtgacggtggacttcccccatatgtagctaagtgcccagccagtcgtttggaaggccgtacaagttttcccgaggatactgtaataacgtacacatgtgaagaaagcttgtgaaacttcctggcgagaaggactcagtgatctgccttaagggcagtcaatggtcagatattgacgagttctgcaatcgtacgctgcgaggtgccaacaaggctaaattctgcatccctcaaacagccttatatcactcagaattatttccagtcggtactgtgtggacatatgagtgccgtccaggttacagaagagacaccttctctatcaccaaaactaacttgccttcagacatttaacacgtggtccacagcagtcgaatctgtaaaaagaacatcatgccctaatcccgggacgcaactacgaaatggtccacgatcgatgtaccaggtggcactatcatcggtgcaaccatctccttctcatgtaacacaggggtacaaaattattttggtcgattctagttgagtctttatttcagggccaggtctgtacagtggagtgacccgtgccagagtgacagagaaattaatgttccaggagcacacaaattggaaatggaataattcaagggaagtgaccattatggtataggaagctgtaggtatgcatgtataaaggat

SEQ ID NO: 492526 - DNA, 148 bp, Homo sapiens
gtagatgggcaggtcttataaggattgatgaccacacagaacaggcctgaataggtgtagatgagccctgagtagtaagcgctccttgagcgtctgtgcagtaccgaggcttcgttgaggcacgtgagctctgccatgtcctccatcc

SEQ ID NO: 492527 - DNA, 427 bp, Homo sapiens
  misc_feature (354)..(354): n is a, c, g, or t
  misc_feature (364)..(364): n is a, c, g, or t
  misc_feature (407)..(407): n is a, c, g, or t
tcgtaacccagatattcctttctattgataataactctttaaaccaattgccaatcagaaaaattttaaatctacttgtgacctggaagccctgcttcaagttgtcctgcccttcctgatcaaaccaatgtaagtcttacatgtactgattgatgtgttatgtcttcctaaaatgtataaaagcaaactgtactctgaccacctttaacacatgttatcaggacctcctgaagctgtttaaccttggcgaaataaactttctaaattgattgagacctgtttcagatacttttgggctcacaataatacggaagaagtatgcataggacagttggaaaacaccaaggaaaagtncacttaggcntaggagggagtggacagggggggaattgggcattggctggatnaacaaaaattcttttgggag

SEQ ID NO: 492528 - DNA, 198 bp, Homo sapiens
cgtaccctcctctagaagaaattccagtaatggatctgtttaagtgttaacgggagcagaagagaagacggtgcatgtacttgcagattatttcgaacatttttagaaataggaattcttgagctctcttttctttcttcagtcttttccatttcgtttttcttttctttttcactgtaatttctgtgcccatttcaa

SEQ ID NO: 492529 - DNA, 486 bp, Homo sapiens
gcggcggcggcgggactgcgcgccccagctccgatccccgttccgcgtcccgccgccgggaggaggtgcccactcgctcgcggagcgcgccggccgacagactcgtgcctgtggtgctgatttccgtccggaaccacaggggtcccacgtcccgagggaggaaagatgcagacctttctgacaaggggaaacgcagacgttggctactggttgagcgagcaagaaatatcaagaagctgaatttccaggccttcgccgagctgtgcaggaagcgagggatggaggttgtgcagcttgaagccttagccggccgatcgaggagcagggcccccttgggaccgttcattcgaattcccgaagcgaaaaggccttggaacctttggaaacaggttccgatttccctcttttgcgccacggcccggcaaaccacagaagcattggagtaataccccacgatcacctgcggcgcagctggtgcacaggttc

SEQ ID NO: 492530 - DNA, 1188 bp, Homo sapiens
taaatgaaggctcatttacttgaaatgtaaaaacttttcacgtgaatacaaattagaaaaagtgatggtgtttaatatcatatggcttttgggtccatcttgggggttaagtttatttactcacttcaggtttttcacctataaaatggtcaagctagcaaaaaaactctgggttttttaaagtggggagaagaagaagaccgtgccagaattatacagaacctcttcatggttaaagagaccatctccgtataaaatgtgacctaggtgggacaagcgtgaattgtgaaatagacgtggtaaagtaagcgtggtaccttgggtcatttttacatcttgggttataacagcgggataacgtgactttcagagtgcagtgtatttacaatacccaagaaataaagcaaaaagtgcgaccttaaaattctaatatagaattctcgtggggatcaccaagttccagggtggctactggactcgtgggctacaatcgtgagataaacttagtgggccatagacctattaaattaaatttccacaaatatacaatttcaaaaaaaaaaacacaaccaaaacaacaacaaaccaaaaaaacaccacaccacaaccaacgacaaacaaacagagagagaagggcaaaaaacaaactacggaggcccacccacacacacaaccaaacaacaaaaaaaagagaaccatcaacccgacacacacaacaagcaacacacagcagacagaacaaaacaaagacaaaacaagcagacaacaaaacagaaacaacaacacgaaccacaccaccacacgagagaagaacaacagagacacaaaaacccacaacaaacgcgcaacaagacaaacaaacacaacaacaacgatcccacccacacaccacacccaacaaaagcagacacgaagaacacagcccccacaaagacacaaacaaaaaaaataaaccacaagaaaacagcacaacaacaacgccagagcaacagacagacgagaccaccaccacgaagacaaccccacgaccaggacagcaccgaagcaggacccacaaccgtgaacaagacacaccaaccacacacaccagccaccgaagcaacaaactcccccaccaccgaccagcacaacaacaaacgacaagaaacgaaacagccgagccacacaacaacaagccaagaccagcag

SEQ ID NO: 492531 - DNA, 701 bp, Homo sapiens
  misc_feature (25)..(25): n is a, c, g, or t
  misc_feature (71)..(71): n is a, c, g, or t
  misc_feature (288)..(288): n is a, c, g, or t
tatgcacactttataaccttaagtntttatttgagaatgtgaaagtacaaagtgcagtagacttcaacaantcttgagtggcccagaatatacagaaaagaagacgttgatgaatgagttatagggttctaatcttagatggtaaaatgttgaaagacacctgtgcgggtttttggggggtatcgtttcttaaacaaattccaatctaggctttagaaagaaaaggttttagccggtttaagccacctttaatcttcatggaataaggcttcaagcttggctcttggngcaggaagaaagagtggcttgagtttacaagaaagggcataaagttaagtttgaagaattgccgcagccttttttgttaaacctttccccaggaattattcaaaattaggaacttttgattattattaacgttgggtttttccttggaagaataggaaccaccttggccttcttaatttttcttaattaaacccatttctccacctgggaacctaattctaaatttcaggtccccttattgaaaattggttattccccttaaaattgttgggcgttttattttggaaaaaacccttaaaattaggcttggccttcaatagaaccaagttaccattgcttcattttaacgcgcggggcgacacaacattatttacacttttttggaattagctgggttagggctcccctatcaa

SEQ ID NO: 492532 - DNA, 1258 bp, Homo sapiens
cccccgatcttgtttggttcttcgcactcgtgttagtattatcgaggcgccccccgctgggtataacagttaagtgctgctaaccaagctgttctgcgccatctgtgtgtgtgaacctttcgcgcgatatttaattatgtatcagagtgcaaacgctttcgttggattactgaactcctgctgacagtggtcttgaaacaacgccttaggttagtacagcgccaaagttttcgcgtcttgctaaaaaacgggtacgattgtcggccacaaagatctaactgaccctcttggtcttgctaacacgaaatgctccaagtttggttaacattgtgaacgttggactttctgtgtaaccaattcacttagctcgggggtataattcacgtgaattggcaatgccctcgagcctataggaccgtgcagcctttctcagatgctcatggcatacgtcctggcccagtgcttcctctgtgtttcgcaccaaaagtatcgtagttcacagctatatgacactggcccaatctgcatcgtgaaatattcgtatcggacagtttcattccacagtgatatcacatgggacacgacaagcgtattacaccctgttggcacactccgacacttatacaccatcttggatgatatcatgtgctcaccgatacgaaatggacacaatcctgaccacgcttttgtaacgacaagggctgtacctttaacacggcttaaatctcgctgatctgattatgaagctgaatttgaatactcatcatgaatcgtgtctgaccaaagaccattgtcccttccaataatcgtctctcttaagacggcaatgctgttctctaacatgactttcacctcaagtttggacccaagaaattacttgttctgtgtatttgacaacaaacaactggtacgctcactaaaatgacctcagcacatcgacgatcttctattaaccatctttactgtcgtttgtgagaagtactctttacatggttcatcccttctccataagccgaatgcacctgaactagacagtgtttcaagtctgatggagagaatgcttgtatttcttcatatggtcgatgaaagtctgcaacgtgcatttgtcatccccagtgccactcaatgccctgaccatgtaaggctttatttattgttaaagaaaccagagttatcccaatacattatcctgtgatttaccttacctacaaaagtggctcctgtttgtttgatgattaactgggttatctttatgaaa

SEQ ID NO: 492533 - DNA, 278 bp, Homo sapiens
actcatgtcccctgtgtttatcatctttggcaaatgtgtattcaagttcctctgccctatgataacttggtttatttggtgttcgttgttaaatcatgggatttctgtagtgatatagagtgtgctcctttcaatcatggcatatggtaggtaaaagtaccaaagtgctcctgttcaacctaaagaaggtgctatagtactaagattcttatctctgtcttctttgacatggtccaatcctctattatgctttcgtgatctaaataggcattatcaac

SEQ ID NO: 492534 - DNA, 155 bp, Homo sapiens
ggcgtgcgatctgtgtgcattgcgaagcctagtactcttacaacgacaaggtgccgaaagccttcatcatcaacgacttgatgatctgcgcccgctggtcgccgcccaggtccttgaagacctcgtacactgcccgccccttctgtcgtcttctc

SEQ ID NO: 492535 - DNA, 790 bp, Homo sapiens
cagagcctgtaaggactgaaacaatccctcccgggctttatgatggacagtcaggggcttggggagcctctgagggactcttatcattgctgcagttgtctggaagcctgggtgggtcatgatctgcatggggatcgatgctttcgtgtacttggcttccattaggtttataaggtcgtgggatgtgtgaaaggttcgacgtgggcccagagcttgaagttcatttgcacctcagctttggcatgtggtgttcgtgccgataaagcacatgtatttctgttacgtgctgcagccattccaaggaattttgtttttgaataacatgggaatatgcgtcacgtggtgttgttgttcaacagtatcatggtatgttgtatgtatcttcgactgatcatttaaagagtttgacctcagagctccaggatcatcagataaacttgtcatgttagtatattctatgtattgtataaatcgaagacttctgtgtgctcttaaatatattaaaaacgagttggacattggcaaatgaaaggagtaactggatatcacacatgtccactctgcggacgcggagactcccaagacctccatctaccagctagctagtttagagcccagcgcaggtcctggacggcacgcgcgcgcaaagcgtgtcctgaggacacggggtgcaagcaaactgggggtgcggcacggaaaaaaacccggggccagcggtgcgctggacaacccagggggccgaggcaagggggccacgcaaggggaccgagaattaaatacccccggctgg

SEQ ID NO: 492536 - DNA, 289 bp, Homo sapiens
tgatgcctccaggtgccgcgattacacgtttagcactgagccggcttagtttctgtatctaaagataacggagtttttatttgtaagtccaatacttcttagcaagcagccttcatgatctagcttctgcataaccctatcgtttcttgtatcaaaggagcttgtgacccacatcacatcccaaaactccactgtgcaaaaatgttggtagttctcaaatgtggaactacagggtagccttctttgcttcaaccttcctcaccaacctatccacctaggaggacataca

SEQ ID NO: 492537 - DNA, 400 bp, Homo sapiens
taccgacggcgctctgctggctgacttgaccgacgtctgcactgcgcgcttttaggtctgtatgtcgtcggcacgctggcgcttgttctacttactgcctcctcgggctcgtccccggccggggtcggctatgtgttttgtccgggggttgcgcctgcgtgtgaggcgtattataccatagccgcctagtttaaagagtactgcggcacgtactattgacccagtgaatgggggcttcgacatgggcttatagggagtcataagtggagtccgtaaaagaggtactctttaactataaaagctattgtgtaagctagtcatattaagttgttggctccggcgtttgatcgttcttgggccgtgacacgtgcgtcgtcgacctgtcccgtgcgcctagggt

SEQ ID NO: 492538 - DNA, 881 bp, Homo sapiens
  misc_feature (42)..(42): n is a, c, g, or t
  misc_feature (45)..(45): n is a, c, g, or t
  misc_feature (60)..(60): n is a, c, g, or t
  misc_feature (111)..(111): n is a, c, g, or t
  misc_feature (231)..(231): n is a, c, g, or t
  misc_feature (243)..(243): n is a, c, g, or t
  misc_feature (246)..(246): n is a, c, g, or t
  misc_feature (282)..(282): n is a, c, g, or t
  misc_feature (291)..(291): n is a, c, g, or t
  misc_feature (467)..(467): n is a, c, g, or t
  misc_feature (511)..(511): n is a, c, g, or t
  misc_feature (521)..(521): n is a, c, g, or t
  misc_feature (526)..(526): n is a, c, g, or t
  misc_feature (847)..(847): n is a, c, g, or t
  misc_feature (878)..(878): n is a, c, g, or t
tttcaagtaccgaaaacaagatttattgcatttcatgcagtntgnagtccatgcagcaanggagatgagcacaatctttaatgtatttaaaaaataaaacagtggccagancagtgcacaaagtcctggttctcctggatcttggagagaagggatggggaggaaaccagctctctgtggagaatgagttcatggcccacaggcaagaaatgttcccacatcttctggatncggaaggctctnggnaaggggcagagaagaatgctggtggaaagggtctgnccctttctntttttctgagggcagaactggcagagtggaaatcctgtacacccttgggaaggaagagcacaggctgccctgccctttagcagtggtggtgagtgcccaagccaggaaacacacaagagaattatttcttcaaccacacgtttcaagaaaatgccataaatatgttatttaatatnctcgtttcatagcattggacacatagctcgatatattgaaatantgattccttngaganaaaaatgaaaaaaagaaaataaaaaataaaaaatattgcatctttctgttgtaggctctcagtccccaggcgtggagagtagtgcaccagtatcttagcctgcaggaggcaatgaagtcccgggtcctctggtgagggaaggtgtgtccccatcgcctgggggctctatggcaaatattgtgctcggggtccttggctttgcagctcaggcctcagtctccagtcacctggggggtctgcccatcagagggctggttggctgactgaataaacatgggctgggcaaggtcttggcctgcaggcatggtgacttgctggatntggctcgtgccgctcgccccgaatcccgcangag

SEQ ID NO: 492539 - DNA, 828 bp, Homo sapiens
  misc_feature (42)..(42): n is a, c, g, or t
  misc_feature (45)..(45): n is a, c, g, or t
  misc_feature (60)..(60): n is a, c, g, or t
  misc_feature (111)..(111): n is a, c, g, or t
  misc_feature (231)..(231): n is a, c, g, or t
  misc_feature (414)..(414): n is a, c, g, or t
  misc_feature (458)..(458): n is a, c, g, or t
  misc_feature (468)..(468): n is a, c, g, or t
  misc_feature (473)..(473): n is a, c, g, or t
  misc_feature (794)..(794): n is a, c, g, or t
  misc_feature (825)..(825): n is a, c, g, or t
tttcaagtaccgaaaacaagatttattgcatttcatgcagtntgnagtccatgcagcaanggagatgagcacaatctttaatgtatttaaaaaataaaacagtggccagancagtgcacaaagtcctggttctcctggatcttggagagaagggatggggaggaaaccagctctctgtggagaatgagttcatggcccacaggcaagaaatgttcccacatcttctggatncggaaggctcttctgagggcagaactggcagagtggaaatcctgtacacccttgggaaggaagagcacaggctgccctgccctttagcagtggtggtgagtgcccaagccaggaaacacacaagagaattatttcttcaaccacacgtttcaagaaaatgccataaatatgttatttaatatnctcgtttcatagcattggacacatagctcgatatattgaaatantgattccttngaganaaaaatgaaaaaaagaaaataaaaaataaaaaatattgcatctttctgttgtaggctctcagtccccaggcgtggagagtagtgcaccagtatcttagcctgcaggaggcaatgaagtcccgggtcctctggtgagggaaggtgtgtccccatcgcctgggggctctatggcaaatattgtgctcggggtccttggctttgcagctcaggcctcagtctccagtcacctggggggtctgcccatcagagggctggttggctgactgaataaacatgggctgggcaaggtcttggcctgcaggcatggtgacttgctggatntggctcgtgccgctcgccccgaatcccgcangag

SEQ ID NO: 492540 - DNA, 130 bp, Homo sapiens
ggcagcactggtggtgcctcagccatggccttgaccgtttttcttcttgggcttcttttttaattcacaggcttttttaccttctattttttttacttagccacccttggggtttaatttgcccagggaa

SEQ ID NO: 492541 - DNA, 139 bp, Homo sapiens
gaatgtcactaaggaaacagactcatttattcctcacatatttattaaaatgcattcactgtgagtgatggaggttcaaagatgaaagaggctcacagcagtaagtatgatctttcaaatacctaaatcagagcggtaa

SEQ ID NO: 492542 - DNA, 425 bp, Homo sapiens
  misc_feature (27)..(27): n is a, c, g, or t
tccgtacacaatatttctaattagtanaaagatctgacatgtacccaggacccatttcacccactgctctgtttggctcgcagtcttttgtctctctcttcagcaaatggtgaggcggataccttttcctcggggaaagagaaatccatggtttgttgcccttgccaataacaaaaatgttggaaagtcgagtggcaaagctgttgccattggcatctttcacgtgaaccacgtcaaaagatccagggtgcctctctctgttggtgatcacaccaattcttcctaggttagcacctccagtcaccatacacaggttaccagtgtcgaacttgatgaaatcagtaatcttgccagtctccaaatcaatctgaatggtatcattcaccttgatgaggggatcggggtaacggatgggtaccgagctc

SEQ ID NO: 492543 - DNA, 248 bp, Homo sapiens
cagggttctggcacatccacgtggacagcatcaccatgaacggagaggccatcgccatgcgctgagggctgccaggccatatgtagacaccggcacctctctgctgcccggcccaaccagccccattgccaacattccagagcgacatcggagccagagagaactcagactggcgacatggctggatcagcatgctcagccatatcaggaagcctgcccccggataatcggatctttccaccattcaa

SEQ ID NO: 492544 - DNA, 254 bp, Homo sapiens
  misc_feature (104)..(104): n is a, c, g, or t
actgtactcatctgttttcagactgcagctgaccatgggtaactgaaaccatggaaagccaaatctcagataagggagaactactgtacagacacttttttatntgacctcatccaggcagcctcagttttgttttggtttgctttttggagatggagtctccctctgtcccccaggatggagtgcagtggcatgatcttggctcactgtaacctccacctcccgggttcaagcgattctcctgcctcggcctc

SEQ ID NO: 492545 - DNA, 1055 bp, Homo sapiens
ggaccagacgataaaggccccgagacacctacataacgtgggagctgggaaacacgtgaggcgggatccgtgccgaacagtcgctggacctgttgctctgcatcaacatggcccatgtcagcccctctgtctgctgcacggaggggcgtcttcagagcacgcaggacacctgactcaaatccagggtccctgctcgatcacctacggggaacccagcaatgggggcttcgggacacagccctcctggcaggacctgggcaagaggccagtggcctgttcctgtgcagcagcgatggtggacatgccagccagcaagcatagatgcctgatcttcctggaacaagagctaagcaccctccttcaaccccgaacatcctgcatccctgccggaggctctgtgaggcacgaaccctgcctcccttaggccggaccttgtggactgaaggccccagccagtctgtgctctcagacgctggctgaatgggcccagtctgctcagaataaagcagtgtcctgggttgccgggacaagaaatccacaaagaatacattcacaaagccatactcacgggggggacctcatgaggagcaggttgcgcctgaccacactgggagcggactaaaatctgcagcagatattggatctacaaccgcatcaccagacggagcccgcaaatgagattcatcttcgtattgcccaatagtgttgattacacacgtatgccagtcacacttcgccgcagcaaatatcaaggcatgccattacaacaagccttccacctaactgcccgacgtttaccccgggcatttcaccctcctgtcgacaaacacctgcggcaaagaggggagaatagatacaccgataccagcgccattacgaagagtgacccattgcaggcgccccatgggcacgcgaaccagtggggcagacgccaccccccccggcaacagcactaggccgcccccgacgtacacccgccgagacatggtcgccgctcaactctccccacgcacagcggcagacaaacccagctacgaccagactaacgagacacc

SEQ ID NO: 492546 - DNA, 853 bp, Homo sapiens
  misc_feature (4)..(4): n is a, c, g, or t
  misc_feature (128)..(128): n is a, c, g, or t
  misc_feature (136)..(136): n is a, c, g, or t
  misc_feature (141)..(142): n is a, c, g, or t
  misc_feature (144)..(144): n is a, c, g, or t
  misc_feature (147)..(147): n is a, c, g, or t
  misc_feature (149)..(150): n is a, c, g, or t
  misc_feature (152)..(153): n is a, c, g, or t
  misc_feature (215)..(215): n is a, c, g, or t
  misc_feature (372)..(372): n is a, c, g, or t
  misc_feature (378)..(378): n is a, c, g, or t
  misc_feature (394)..(394): n is a, c, g, or t
  misc_feature (402)..(402): n is a, c, g, or t
  misc_feature (419)..(419): n is a, c, g, or t
  misc_feature (452)..(452): n is a, c, g, or t
  misc_feature (455)..(456): n is a, c, g, or t
  misc_feature (461)..(461): n is a, c, g, or t
  misc_feature (465)..(465): n is a, c, g, or t
  misc_feature (469)..(469): n is a, c, g, or t
  misc_feature (471)..(473): n is a, c, g, or t
  misc_feature (475)..(475): n is a, c, g, or t
  misc_feature (549)..(549): n is a, c, g, or t
  misc_feature (558)..(558): n is a, c, g, or t
  misc_feature (562)..(562): n is a, c, g, or t
  misc_feature (565)..(565): n is a, c, g, or t
  misc_feature (568)..(568): n is a, c, g, or t
  misc_feature (591)..(591): n is a, c, g, or t
  misc_feature (598)..(598): n is a, c, g, or t
  misc_feature (679)..(679): n is a, c, g, or t
  misc_feature (681)..(681): n is a, c, g, or t
  misc_feature (692)..(692): n is a, c, g, or t
  misc_feature (708)..(708): n is a, c, g, or t
  misc_feature (720)..(720): n is a, c, g, or t
  misc_feature (740)..(741): n is a, c, g, or t
  misc_feature (751)..(751): n is a, c, g, or t
  misc_feature (757)..(757): n is a, c, g, or t
  misc_feature (762)..(762): n is a, c, g, or t
  misc_feature (845)..(845): n is a, c, g, or t
aaanaaaaaactttcaaatgctggtaaccataaaggtctggttttaaggatggcctttaaggaaaggccgtggcaggcgggctgagaggggcggctccacctcagccctgcccacagcacaggctcanagaagccnagatnnanatnanngnntggcatgcaaaggagttgaagacaaaaccatttttttccagcttctctacaaagccaattantaagcaacagttattaaagtgaagtatccatttacagactgacacaaatatcaaaaataagcagcttagatgagtacagaggctggagtgcattttctgctaacaaaaaccactgtgatattctcccagtttagagggaaaagtctatctcaggccnactcanatatggcagaaataantgggtctnaagtgcattttcaattntttctgcccggaaggagcccggatgataaaaanaannctggngttnatancnnnanaaagagcccaaaaacaaaatacgtctaaaaaaggaaaaaaaaaaaaaataaaaaaaaataaaaaaatggctgtnggccggctngggncgncgntgaaaaactgacaatattttttncacccantagggtccacagcagtgtttgaaatgacaggctttttatttctcaggaacagccgagatgacctccagaggtttccagcgnangtataacaatncaccctgcagctctanaaaagggagganggcgaatcaaatccatcatnntacgccaganttcagncctgngggagctgctgcctccaaagaaaacggggacctgggcggactgcgtctctcccccgtgtggagaacgtgacaaatgtgaaggntgggctga

SEQ ID NO: 492547 - DNA, 949 bp, Homo sapiens
gcatttgctggtactgctgtataaatttaatagttttaatatagtgcaacagaagaaactgcatttgaagaaaagagctattgaataccataaattaaccctcaagtctgttctaggtattcttgggcctgaggtcttctgaattaattgagtagcagtatttggctactcagttggttattaactgtgctttttgactgataagagaatacatttaaattttttaaatggtatttatggggccaggtgtggtggctcacacctttaatcccagcactttgggaggccgatcaattatatagatcaacatgatcaaggtgggcagaccactcaaagtcaagagttcaagaccagcctggccaacatggcaaaaccccgtctccactaaaaatgcaaaatttagccaagcatggtggcacacgcctgtagtcctagctactcaggaagctgaggcaggagaacagcttgagcccaggaggcagaggttgcagtgagccgaaatcacgccacagcactccagcctgggtgacagaatgagaccctatctatctcagaaaaaaaaaaaaaaaaaaaagttttccaggggtaaacgtagcaaacaatttcaggtgaccaccaattttccctcagaaagtctcaaaacactttaatgtctccggatcatctctatgctctcaatctcgcatttgaccaaattttccacgtagtctataagcctataagcttgttgtcacaacaggccacacaaaactgcgtgcaccatcacatgtggctttcttggacaaggattgaccctggaacccagacaagggatacaggcactcctaggagcctcacacgtccgtcaaaaattccggtgtgtctaaaaaatccacgtcaactaattcctaagtacccttatatggggcctcctggcgcacaacctgcatcttggggtcgaaggacattc

SEQ ID NO: 492548 - DNA, 256 bp, Homo sapiens
  misc_feature (142)..(142): n is a, c, g, or t
ttcccccccccggggggtcccccttcccttgggggccttccccttttttagggggaaaaaagaggggggaccttttgggaccctaagttttttgatttttttttggggggggtttgggggggcgggcccttttttttacccntgggggggaaaaagatgggggggaaggggggggggggggaaattttcccctccccccttcccctttgggtttttgaaaagggggcccgggggaaaaaattggccggttttttta

SEQ ID NO: 492549 - DNA, 497 bp, Homo sapiens
  misc_feature (6)..(6): n is a, c, g, or t
  misc_feature (447)..(447): n is a, c, g, or t
  misc_feature (475)..(475): n is a, c, g, or t
gaacangtatgagcatttgatgtaaatcttgtcaggagccacacacaccaactttctgtgctcagggacagtgcagtctgtgtggaccagaaccatatgaagtggactcaggagatagtctccaagcctgtctcctcagagtgagcaggctaggcttcagaaggtaggttgatttggctgtcattgttgttattgacttgatgctcagtaatccagagccaatgaaggcaagaataaacgatgacctcagctgctgcacagctcttcactgttctcttaataccaactctacccagcagtcttgcaaagatgtgttgtgggttacatggggacaacgaagagatggatcagcccacatcaccatcaggaatggaaaaccaattcaaaatccctatcctactgattggggagttttacatacttgtaagacaagaggtaattatactncgaatcattaaaggaggtgggtgaaagntctccaacctctgaaaattcac

SEQ ID NO: 492550 - DNA, 185 bp, Homo sapiens
ttcgagccctcaccagtccccactgtagaagaggtgacacttctccaacacagtcaacagaaagaaagacctcagagtcggccccagtcaaacggcggtaccatgacctgactggatgaacatggaacgatgcacagcctggacgacgacgggcaaggattgacgatgagaaccgtcacggggaa

SEQ ID NO: 492551 - DNA, 292 bp, Homo sapiens
tctgactcctagaggatcccttgagattatcgctaggatatagaactcgcagatccttgaatgttgcgggaaaagatatagtaactatgtcgtatttgaatatcatgcttagtattcctctggagtgcgtcttgcacattaagaatatccaatggagcatccaggtttcactctccatgacagtgccattgtgaattgtgctgtactagtaatatactcgtaggtgtctattctgcttaatttacatacccttagtcatagatcatccattacctggcatgctggctggtgt

SEQ ID NO: 492552 - DNA, 908 bp, Homo sapiens
  misc_feature (22)..(22): n is a, c, g, or t
  misc_feature (73)..(73): n is a, c, g, or t
  misc_feature (81)..(82): n is a, c, g, or t
  misc_feature (97)..(97): n is a, c, g, or t
  misc_feature (110)..(110): n is a, c, g, or t
  misc_feature (115)..(115): n is a, c, g, or t
  misc_feature (170)..(170): n is a, c, g, or t
  misc_feature (183)..(183): n is a, c, g, or t
  misc_feature (187)..(187): n is a, c, g, or t
  misc_feature (281)..(281): n is a, c, g, or t
  misc_feature (291)..(291): n is a, c, g, or t
  misc_feature (308)..(308): n is a, c, g, or t
  misc_feature (318)..(318): n is a, c, g, or t
  misc_feature (329)..(330): n is a, c, g, or t
  misc_feature (347)..(347): n is a, c, g, or t
  misc_feature (386)..(386): n is a, c, g, or t
  misc_feature (388)..(388): n is a, c, g, or t
  misc_feature (395)..(395): n is a, c, g, or t
  misc_feature (402)..(403): n is a, c, g, or t
  misc_feature (413)..(413): n is a, c, g, or t
  misc_feature (457)..(457): n is a, c, g, or t
  misc_feature (460)..(461): n is a, c, g, or t
  misc_feature (491)..(491): n is a, c, g, or t
  misc_feature (521)..(521): n is a, c, g, or t
  misc_feature (524)..(524): n is a, c, g, or t
  misc_feature (548)..(548): n is a, c, g, or t
  misc_feature (570)..(570): n is a, c, g, or t
  misc_feature (578)..(578): n is a, c, g, or t
  misc_feature (593)..(594): n is a, c, g, or t
  misc_feature (596)..(596): n is a, c, g, or t
  misc_feature (601)..(601): n is a, c, g, or t
  misc_feature (611)..(611): n is a, c, g, or t
  misc_feature (628)..(628): n is a, c, g, or t
  misc_feature (644)..(644): n is a, c, g, or t
  misc_feature (687)..(687): n is a, c, g, or t
  misc_feature (710)..(711): n is a, c, g, or t
  misc_feature (753)..(753): n is a, c, g, or t
  misc_feature (776)..(777): n is a, c, g, or t
  misc_feature (779)..(781): n is a, c, g, or t
  misc_feature (811)..(811): n is a, c, g, or t
  misc_feature (814)..(814): n is a, c, g, or t
  misc_feature (822)..(822): n is a, c, g, or t
  misc_feature (845)..(845): n is a, c, g, or t
  misc_feature (859)..(859): n is a, c, g, or t
tataagtaatgcctagggtgantggtaggaagtctttctctcaataggaggtgtatgacataggtcggtagcnggaactcnnggggtatgcctgtcngaattcataaganctctnggaggttagaagtcaggcgcttggctgcaaaatatgtctgtcgtagacgttctcncggggagagtgcngtcnatatgttgttccctaggaagattgtagtggtgagggtgtttattataataatgtttgtgtatcgggctatgaagaatagggggaaggcggcttncggggtatcngatgttgaaccttgagnatagtcgggncccccctcggnnaaggcagaagggggtcnggttggcccttcctagtgtggagataaacaatattatgncnaagggcnatgatgnnaggagtaacnagaggtgtccttgtgttgtgataagggtggagaggttaaaggancannttattagtaatgttgatagtagaatgatgnctagggtgcctcaatatgagattgtttggnctnctccccccagtccccggacaaggnggtagtttgagtttgatccccnccctgacnagaggattgagtaanngnctagnctagaggtgnctagaataaataggagncctaggttgaggttgncaagggggttgggtatggggaggggggtcgatagtagaagacngatggtgagacctaaggctgggnnggtgatgtagagggtgatggtagatgtgcggggttttagggnccttttggtgaagagttttatgnngnnnggaaggggttgtagtacccggtaggccgtnaanagttgggncttttctgtagttgtatataccntagaattttctgtntggtaacgattaggaatccaattccgattagaatgggtaaaatgaggag

SEQ ID NO: 492553 - DNA, 546 bp, Homo sapiens
taccgttatgtatggcgtgcacttttcccctcacgtttacgaggctaccgcgtaaagcaggttaagctatttgggtccacaacaatgtagtttttagtaaatgtcatgacttatataaaccctagactcacagtgtagtaactatattatagttcctttcatttttaaaacatttctgtccctttgtgatttcatgctctgcattctgtacatattctttccaaatcactcctcagaacctgccccaagatggagctactgtgttattgttcccttaacatttacttattccattcacatgtgactattcttgttattagtgggaggaaggggctgcatagtgtactataagcagttgtggtaccttagctcccagacacaggtgaatcctccattcattggttaagctccagttttattcttggctcacctatattttgtgataccaaaatattaagttctatatatcctcctcctcttcatcctgtctgtttctcatctctccaaatttacagagttaacatatcttatttctgcttagtcaaa

SEQ ID NO: 492554 - DNA, 629 bp, Homo sapiens
ataaataaagaatatattcgtgttcgtttatcaatgcacagtaagtctacaaactcatgatgcttaaaaaacatttcataaatgatgaattgtgtggcaagcgatcggtctgctttggtgcagacatgtatgagaagctcattgtgaatcacttcttagcacatagattaatacaattggcctatgattgttccaatgatatgtacgagctacttccattaactttttgaaagccaacacagtcccttaaactctagtgcttctgctttatgacatgggaactgttctgtcatcgaatggagtgctattctagctacatacgaattctttcagtatcagttctcatttctatagacttgcaagcctatgtatgaattatgacggggtctccctgacaaggggccggtagccctttctgacataatttcggtcacattccctaattcttgtgttaagcgctccggtttcccatatagtcttaatggtattactgaacagcaaaaagttcttggcactccttacggaacatccggattcgggactgctcatgaccagggcaggagaggtgcattcgactgagatccactacttgttgcgaaggcctattttcacacccagacatgactgca

SEQ ID NO: 492555 - DNA, 836 bp, Homo sapiens
  misc_feature (29)..(29): n is a, c, g, or t
  misc_feature (58)..(58): n is a, c, g, or t
  misc_feature (778)..(778): n is a, c, g, or t
  misc_feature (813)..(813): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 492556 - DNA, 316 bp, Homo sapiens
aactccatggtgattatctgtgtgtctgaacacatcgaacaccgaaaagggcagggagctgtggctcacgcctgtgatcccagcgctttgggaggccaaggcgagtagatcacttgaggtcaggagttcaagaccagtctaggcaacatggtgaaaccccgtctctacctaaaaaatacaaaaattagccgggcgtggtggtgcacgcttgcaatcccagctgcacgggaggctgaggcaggagaaccgcttgaacctgagaggcggaggtcgcagtgagccgaggccgcgccattgcactccggcctgggcaaca

SEQ ID NO: 492557 - DNA, 888 bp, Homo sapiens
  misc_feature (29)..(29): n is a, c, g, or t
  misc_feature (58)..(58): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492558 - DNA, 762 bp, Homo sapiens
caggtctgtgcgtactagtgatgtcagtccgacgcctgtctggtttgctgtctgctgcctggttcaggctggtgcgtccaacgttcgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492559 - DNA, 833 bp, Homo sapiens
  misc_feature (29)..(29): n is a, c, g, or t
  misc_feature (58)..(58): n is a, c, g, or t
  misc_feature (687)..(687): n is a, c, g, or t
  misc_feature (689)..(689): n is a, c, g, or t
  misc_feature (728)..(728): n is a, c, g, or t
  misc_feature (731)..(731): n is a, c, g, or t
  misc_feature (735)..(735): n is a, c, g, or t
  misc_feature (737)..(740): n is a, c, g, or t
  misc_feature (763)..(767): n is a, c, g, or t
  misc_feature (798)..(798): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 492560 - DNA, 713 bp, Homo sapiens
  misc_feature (29)..(29): n is a, c, g, or t
  misc_feature (58)..(58): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcatcagagagagctgcaagga

SEQ ID NO: 492561 - DNA, 147 bp, Homo sapiens
tgacgactttacatcatcacggagggcaccagcgtccgtgctgcagcgccggttcccccaattgaggagtacgtggaggtggggcggcctggagaccctctgactatcgttctggggagattgcactgcatgctgaaccggccccgg

SEQ ID NO: 492562 - DNA, 204 bp, Homo sapiens
ttcacggttgcccgtgctcatcctttccaaaatatgcccggtgctatccgtccagctgctcctagaccaccatttagtactctgagaccagcttcttcacaggtaccacgagtcatgtcaacacagcgtgtagctaacacatcaacatcagaccatgggtccacgtcctgcagctgcagccgctgcagctcggggtaccgagct

SEQ ID NO: 492563 - DNA, 1240 bp, Homo sapiens
  misc_feature (673)..(673): n is a, c, g, or t
  misc_feature (687)..(687): n is a, c, g, or t
  misc_feature (694)..(694): n is a, c, g, or t
  misc_feature (702)..(702): n is a, c, g, or t
  misc_feature (707)..(709): n is a, c, g, or t
  misc_feature (720)..(721): n is a, c, g, or t
  misc_feature (723)..(723): n is a, c, g, or t
  misc_feature (726)..(726): n is a, c, g, or t
  misc_feature (735)..(735): n is a, c, g, or t
  misc_feature (737)..(737): n is a, c, g, or t
  misc_feature (744)..(744): n is a, c, g, or t
  misc_feature (748)..(748): n is a, c, g, or t
  misc_feature (752)..(752): n is a, c, g, or t
  misc_feature (754)..(756): n is a, c, g, or t
  misc_feature (760)..(760): n is a, c, g, or t
  misc_feature (763)..(763): n is a, c, g, or t
  misc_feature (765)..(765): n is a, c, g, or t
  misc_feature (780)..(780): n is a, c, g, or t
  misc_feature (791)..(791): n is a, c, g, or t
  misc_feature (794)..(794): n is a, c, g, or t
  misc_feature (809)..(809): n is a, c, g, or t
  misc_feature (827)..(827): n is a, c, g, or t
  misc_feature (836)..(836): n is a, c, g, or t
  misc_feature (841)..(841): n is a, c, g, or t
  misc_feature (863)..(863): n is a, c, g, or t
  misc_feature (884)..(884): n is a, c, g, or t
  misc_feature (886)..(886): n is a, c, g, or t
  misc_feature (891)..(891): n is a, c, g, or t
  misc_feature (893)..(893): n is a, c, g, or t
  misc_feature (895)..(895): n is a, c, g, or t
  misc_feature (897)..(899): n is a, c, g, or t
  misc_feature (901)..(901): n is a, c, g, or t
  misc_feature (903)..(903): n is a, c, g, or t
  misc_feature (907)..(907): n is a, c, g, or t
  misc_feature (909)..(909): n is a, c, g, or t
  misc_feature (911)..(911): n is a, c, g, or t
ccacctctgcctcccaacgtgccgggaccacaagcgtgagccacaccgccagaccaagatgatttaaagtatacaggaggatgtatgtaggttatgtacaaacactacgccattttatgtcagggactggatccccaggggggttttggaatcattgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgngggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492564 - DNA, 620 bp, Homo sapiens
agtacactccacccttttatgggagggggagatccattttacctactttgtcagactcgatagaagttgctttacatatcacaaaaactccattcttttccacaaaagggtttacagaaaactcttttttgagtgagtgattgcaacttagatactcctgttgcctgaatcagactgtcctagaacagaatggacaatgcttggaggagaatccacacaaacagcacctgttctgagacctatcccagcccaccgcgcctgctcaaatgaagtctttacttcaagtgcaaacagccacatgaggtttctgttgataaaccatgagcttaccgctgatttaaagccccatccccatgattcacacaatcagttcctttttttttgctgctcttggtaaaaagtggattctcatacaggccacgtacatttacttctattcacagtgagtacccaataacaacaaaagcgcttacaaaattgaaagcccgcgactttagcccctttatctgaagaataaccatttcaaattattattatattaaacggggcaggtttaaggctgtttaaacaggcaccttaatgccttcaattcggttgaaaaacaaattaactttaacgga

SEQ ID NO: 492565 - DNA, 864 bp, Homo sapiens
ccacctctgcctcccaacgtgccgggaccacaagcgtgagccacaccgccagaccaagatgatttaaagtatacaggaggatgtatgtaggttatgtacaaacactacgccattttatgtcagggactggatccccaggggggttttggaatcattgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcaacgtctatgacctcctaaaagtacctaaaggcagggctccacaagctgattgcgccgctgtgccgattgcaacccccgtgactgggccgatctttcaaacagacctacaacaagttcgacaccaacccaacaacactgacgccccaaatccaaccaacgggcttatccgctaacgacggacacggccaggccactccccagcaccggccacgccgcacgccgccggcaccacagcgacccgc

SEQ ID NO: 492566 - DNA, 815 bp, Homo sapiens
  misc_feature (652)..(652): n is a, c, g, or t
  misc_feature (670)..(670): n is a, c, g, or t
  misc_feature (675)..(675): n is a, c, g, or t
  misc_feature (701)..(702): n is a, c, g, or t
  misc_feature (706)..(706): n is a, c, g, or t
  misc_feature (724)..(724): n is a, c, g, or t
  misc_feature (743)..(743): n is a, c, g, or t
  misc_feature (756)..(757): n is a, c, g, or t
  misc_feature (766)..(768): n is a, c, g, or t
  misc_feature (782)..(782): n is a, c, g, or t
  misc_feature (809)..(809): n is a, c, g, or t
ccacctctgcctcccaacgtgccgggaccacaagcgtgagccacaccgccagaccaagatgatttaaagtatacaggaggatgtatgtaggttatgtacaaacactacgccattttatgtcagggactggatccccaggggggttttggaatcattgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccgnacgtcctgctcctggctnttgcnctgctctgcctgccctggcttagagnntggngccgtccaaaccgttccnttatccaggctttttgacnacgctatgctccnngcccatcgnnngcaccagctggccnttgacacctaccaggagtttgaagaancctata

SEQ ID NO: 492567 - DNA, 729 bp, Homo sapiens
ccacctctgcctcccaacgtgccgggaccacaagcgtgagccacaccgccagaccaagatgatttaaagtatacaggaggatgtatgtaggttatgtacaaacactacgccattttatgtcagggactggatccccaggggggttttggaatcattgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggcgccacagcggcgagccggcagtccaaggtttcgccaacagcgggtacgggcctctgacagcaacgtctatgacctcctaaaggacctagaggaaggcatccaaacgctgatggggaggctggaaggatacctcacacaacgatgacgcactactcaagctacgggctgctctc

SEQ ID NO: 492568 - DNA, 203 bp, Homo sapiens
gcaaatcacactgaagaatgtatgatatatttgggaatatggacctattcgtcaaatcagagtggggacacaactgtaactagaggacaacttatgtggtctatgaggacaactttgatgccaagatgcatgtgtcaactatcgggattcaatgtttgtacaaatacctgtggtttgtactatatgacacaggcatttcagag

SEQ ID NO: 492569 - DNA, 450 bp, Homo sapiens
gtctacgttctttggtttctgtctggacatgctgcatgtgtctgtataatgagagcagcaataatctcccacttcccctggacgaaaccgaacaagatgtgtttttctttttttttttcctttgtactctgaatgtgggaacttaattgtctgtgtttgctggtgaactatttgtttctatgctaggtgctagtacatattaacgttgtacttcctttgcagaaggggaaaaaaatctgattatatagtgttacttagctgctcaaagttaattgaaattgactgaagtaagactgtggggactctaagatgtctcttcttacagctgggaatgtgtcctcaaagtttgtatattctccaagatgggtcagcagtgttgcaattccaagaaagggactagatgtcagaacttgggcaaaggaggcatttcctgtgactgcttgagattag

SEQ ID NO: 492570 - DNA, 1141 bp, Homo sapiens
  misc_feature (29)..(29): n is a, c, g, or t
  misc_feature (58)..(58): n is a, c, g, or t
  misc_feature (574)..(574): n is a, c, g, or t
  misc_feature (588)..(588): n is a, c, g, or t
  misc_feature (595)..(595): n is a, c, g, or t
  misc_feature (603)..(603): n is a, c, g, or t
  misc_feature (608)..(610): n is a, c, g, or t
  misc_feature (621)..(622): n is a, c, g, or t
  misc_feature (624)..(624): n is a, c, g, or t
  misc_feature (627)..(627): n is a, c, g, or t
  misc_feature (636)..(636): n is a, c, g, or t
  misc_feature (638)..(638): n is a, c, g, or t
  misc_feature (645)..(645): n is a, c, g, or t
  misc_feature (649)..(649): n is a, c, g, or t
  misc_feature (653)..(653): n is a, c, g, or t
  misc_feature (655)..(657): n is a, c, g, or t
  misc_feature (661)..(661): n is a, c, g, or t
  misc_feature (664)..(664): n is a, c, g, or t
  misc_feature (666)..(666): n is a, c, g, or t
  misc_feature (681)..(681): n is a, c, g, or t
  misc_feature (692)..(692): n is a, c, g, or t
  misc_feature (695)..(695): n is a, c, g, or t
  misc_feature (710)..(710): n is a, c, g, or t
  misc_feature (728)..(728): n is a, c, g, or t
  misc_feature (737)..(737): n is a, c, g, or t
  misc_feature (742)..(742): n is a, c, g, or t
  misc_feature (764)..(764): n is a, c, g, or t
  misc_feature (785)..(785): n is a, c, g, or t
  misc_feature (787)..(787): n is a, c, g, or t
  misc_feature (792)..(792): n is a, c, g, or t
  misc_feature (794)..(794): n is a, c, g, or t
  misc_feature (796)..(796): n is a, c, g, or t
  misc_feature (798)..(800): n is a, c, g, or t
  misc_feature (802)..(802): n is a, c, g, or t
  misc_feature (804)..(804): n is a, c, g, or t
  misc_feature (808)..(808): n is a, c, g, or t
  misc_feature (810)..(810): n is a, c, g, or t
  misc_feature (812)..(812): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgngggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492571 - DNA, 242 bp, Homo sapiens
aaaaaaagggggggggggggggccgggccccccccttttttttttcccgggggggggggcgcgggtttccccacacccttttttgggggggggccctgggggggggggggtttccccctttttttaaaaatgggaccggggggttttttaggaaaaaattttggggggttgaaaaagggccttttttttccccggggggggggattttttttttttaaaaaaaaggccccccgggcggggga

SEQ ID NO: 492572 - DNA, 338 bp, Homo sapiens
cccgcctgtgcctccaagtgctgggattacaggcatgagccacgcgcccggcggcatggatttattcacaaggttctagtattaaattctgtggatcccttaggaggagattaatttttttttttttggaatgggggtctcattctgtcacccgggtgggagtgcaggggcccaatcatagctcatggtagcctcaaactccggggctcaggggatcctcgggcctcagcctcccaagtagcgggggttacgggcgtatgccaccatacctagctgatttgggtattttaaatagagagggggttggatcatgtgggccaggcgggtcttaaactcac

SEQ ID NO: 492573 - DNA, 187 bp, Homo sapiens
  misc_feature (93)..(93): n is a, c, g, or t
  misc_feature (99)..(99): n is a, c, g, or t
  misc_feature (123)..(123): n is a, c, g, or t
  misc_feature (147)..(147): n is a, c, g, or t
  misc_feature (161)..(161): n is a, c, g, or t
  misc_feature (180)..(180): n is a, c, g, or t
ctttacctttttaaaattttacttctacgttttggaatataaaaatttctattttaagtttagaatgttatacggcccgaaagtatgcagccnaatcgntcagatcaaacccttttacctggngtttgggactggtttttacttctntgaatctgtataanaaaaataaagccaattgancttccca

SEQ ID NO: 492574 - DNA, 80 bp, Homo sapiens
gcggccgcctactactactactgctcgaattcaagcttctaacgatgtacggggacatgctcaataaatatttttaaatg

SEQ ID NO: 492575 - DNA, 899 bp, Homo sapiens
ttctggaatggaggtacttatgagactgctatatgaacactggacagcactatcaggacgtcgcggacatgggacatttccttccaacatggccgccactgcctctccgcagaccactcggcactgaggatgccgatctgagaatagcagcttctattactatgagtacctggatgaagtggccttcatgctctgccaggacggatgcagtggtgtcctttggcaaagtcttcctcccagtcattctatagcctgattttagtgttgggcctcaggcgggaacctccttcttctcatggtcttgctccgaaatataactcgcaaggtggatggttgagactctatctgctgaactctggccatctccaaccttctgtgcctggatgacactgcccttctggggacatctccgttgaccatggcattgggctctcacgggagttccttgtgcaatgatggctgagcactcatatatactataaactttagcagtgcatctatatcattacgctgcatgagcctggaacaagtacctggacgatcgttcatgctcagccctaccacaggctgaagacccggccaagagcctgctcacttgataccatagaatgcagctgtgggtcgctggacgtcgtccaacccttgataatggtcttttgtacaagacaacatggtcaaatcccacagggttgtgtggtcactgacaacgagatttcagtcgaggcatggcaacacgtttggaaagctcatcatccgttcatgcacgacctcctagggttatcaactcaactcctagcaatgatctttctttacttcacgattcggcatggactctggtaagcaaaaccagacacaggcgaccttctaactagatacacaatttggggcattccaggcaa

SEQ ID NO: 492576 - DNA, 729 bp, Homo sapiens
  misc_feature (308)..(308): n is a, c, g, or t
  misc_feature (544)..(544): n is a, c, g, or t
agcggaggattggcgggcgagcggctgggacgggatgggattcttctcacggcgcacgttctgtgggcggagtgggcggagctgccggggtcagttggtccaagtgtcccggccttgaggttgtccggcgccgggaaccctctcttctctccgcgcgcctctaaagcggagagacattactctccatacgaagtaattgtatgcctacggaacgcgaacacagtatatgtttagctcaaccgcataggaatagattgcatagttgccttggagcattgggagtggtgcgattggctgccaagatgcgnaagtgggaagcgtggggagggacaaagaactctagtacttcattaatgttccaagggtgggttgggggaaaacttccccaaaatgaaggacagacattttgggggcaaaaagggggaaaaaaaatttttcccgtttttccttacctgtggccaaaggaaggtaagaaattgggcaggggttaaaaggggaaaaggagaaaattcgtgggaaagcgcttaaaaaattccatagaaanaaaaacccaaaaggttgtccttggggcgaaccaaattattaattaggaaaaagaattccttccaatggtttccagggatttttccctaaggttgagtgtttttccaaaaaaaccaaaaacgtggggaacaaccaaaaaaaaaggccaaaaaaaggaaaaaggtttagaaggggggagtttttgga

SEQ ID NO: 492577 - DNA, 351 bp, Homo sapiens
tgtgggtctagatgcattcaaaattataaagcagcagaactcattttttggagcggaaaatcaatgctatctattgtatgtcacaattacatatttgaaaatttgccaagaattttactatttatcctttctccccagggttgaacaaaaatattatggaaaacatgggctaattagtagattaaaatagagtaataaaaattctattaatgatttatagggtttgggggcaggtattactggcatacaatgcatattaattacaattttgaaaaatgtaaacatgtgcataaaacaaggtctagactagaactctctagtagaacttctgagataacagaagtctgtatt

SEQ ID NO: 492578 - DNA, 562 bp, Homo sapiens
tccacttctgaatccgctggggcgggttcctgcgcgatctcaaaaccaaccgcattatctgatgacgcggggtgaacttcaccccgttgcttccagcagcagtaaatccatcagcagcaccagattcgactcaaatgacgtcacgcctgctgcttcagcagcgaaatgtaccgcttcgtcatagagggcaaagtgtacgtccgccatccccgccagcgtattggccgaggcgcgggtaaacgcgacgacggtcatcccgacgtttttggcaattcgcgctttatccagcacctgctccgtttcgccgctgcgtgaaacggcaatgaacacctgatagcgggcggcgttgctgagaaaaatgttccggctgtcccccggcccggagataaatgccgttttgcccaacacctgcaatttcttggtcaggtactcggcaaacagataggaaaacccggcaccgtagagaaaaaagctctctttctggcgcagcaggttggcaaactgctggcgtttgtcctgggtgacccactgaaaagtttgctgatagttggcgatgaattgg

SEQ ID NO: 492579 - DNA, 327 bp, Homo sapiens
atcttaatggaggtagttgtaattgaagagaaaagatgacgatagggggcagcctcgggtagcggtgtgggggagagctcaggggcgggtcacttgtggtaggtctaagagccgggttcctggaggcttaggagatcttctctcagcccagatccagccgtcacctcctcctcttcactctcggcggactgcccgcccttggctccatctgcagatgtcttcagagacgagatgtacttggaccagaaggagcagtcggctttctccaggccctgtcgatgggggagcagttcagggtaccgagcctcgaatcgataagtcatggcc

SEQ ID NO: 492580 - DNA, 822 bp, Homo sapiens
cattaagaacagctctgtatctatttagtgtgtcttagtgaaaaaaacatagagattgccctagatggcctttcaggaccttataattcaaatgggcagctggggaggttccagattcttcacatgatatttgtgttaatctgccatgcccgtgtcggctcctcacactctttggagaacttcactgcagccattcctagtcatcgctgctgggtccccatccttgacaatgacactgcctctgataatggcagtaggatcctgagccaagatgacctcctgaggatctccatccccctggactccaacctgagaccggataaatgccgtcgctatattcaaccacagtggcatctccttcatctgaatggcaccttccccactgtaacagagccagacacagagccctgtgtggatggctgggtgtatgaccaaagcaccttcctctccaccacagtgacccagtgggacctggtgtgtggatctcaggcactgaattcagtggctaaatttatatacatgactggtatctttataggatatatcatgggtggccacttatcagacaagtttgggaggaagctcattttcacagtgctctttactgaaaatgggccatcactgaaaactgtgtgtagctttgctcccctccttcctcaatctactggtcactttccgattcctgtcagggattttttcctccaacctggagggacaaagacaggctttgctcaatattagaaatgggccagtcctaaagtttcacagcccgggaaagggcgctgatattatgtggccccaggagagtggacagacacggtt

SEQ ID NO: 492581 - DNA, 229 bp, Homo sapiens
ttatacctgaaattcgtgtccccggtaggtattagattgctgtctgtcaggcaggacacgttgaactcctccgtgtaggaggaaacgtctatgctctccacatactgcttcacgctacccaggttcttatactcacatcgcctgggatcgagacctcagccggcagaggcatacgcagaagctgtacaaaggctactctatgtacccccgacatggacacgaatgttca

SEQ ID NO: 492582 - DNA, 832 bp, Homo sapiens
  misc_feature (627)..(628): n is a, c, g, or t
  misc_feature (631)..(631): n is a, c, g, or t
  misc_feature (638)..(638): n is a, c, g, or t
  misc_feature (640)..(640): n is a, c, g, or t
  misc_feature (654)..(654): n is a, c, g, or t
  misc_feature (656)..(656): n is a, c, g, or t
agtctcgaactcctgacctcaagtgatctgcccaccttggcctcccaagattaaaggtgtgagccaccgcgcctgctattaggtgtattgatattttctatagtggctgttctcaaactttctggtctcaggacttcttgtacccttaaaaattattgaacacccaaagagctttagttatgtagattatgaatattaactgtatcaaaaattaaatgacattttaaatgaaaaatacccatatttttaaaaattgataagtatgttttatcagttttgcaaatcactttacatctagctggatttttgtatctgtttctgccttcactttattgcaaagtgttgttttggttgaagtctgaagaaaacctggcctcataaataggtgattggaaaaggggggagtgttttagtagccttttagatcgttgtgggtgttctttgatactacaaccaaaaatcaagtggtagtttcttaaaggctagttgcaatgtgggatcacactttttgtaccatgtggatcagtgaactttttggcactctgttatgtagaatcgttaatctatctgtactttgaatggatccttttacccgtgaatgatcttgtaatatgctatgtaggttgnnaantactggntncaccgagttctgcngntcttctagaatgtctcatttattatggccgatttaaaaattccactaatctccgaaagtttagcttgggaatcgacacttgcactggaagcaccagttcacatctatttctctgaagaccattttgggggcaaaacgggcggagaagcctttttaaaattggccccggatgttttc

SEQ ID NO: 492583 - DNA, 364 bp, Homo sapiens
ttgtccagtgctgtgcgagcactctcttcagaaaccagcatggagcactaagttaccacgagtgtattgtgatttcttggtattcctccacttaggaatagatgaagtgaaattgtttcttctcccttttacctctggtgtctggaggggatatctgagatcatgctttcttattatttctcttttcttttccctcagaatccttctagaaactacccaagaaatattcagctgactttgcaggaatactttttcagtaggcagataaagcatataccccaaagtaatatgtagctttctttctttctttctttcttttttgagatggggtctcactctgtcacccaggttggagtgcagtggc

SEQ ID NO: 492584 - DNA, 200 bp, Homo sapiens
ctgacctaaggatccccatggatagcggataggggcaacatctgtaccacgcgagttgtgagctcctgccagcagtgcctggctgtgagccccattgtgtgccgtggtgctctagatgaggccctgccatctggctcacctctgctgtgaccgtgacaggagaatctagctgaaggataacttgtgccccaagaatccat

SEQ ID NO: 492585 - DNA, 448 bp, Homo sapiens
  misc_feature (14)..(14): n is a, c, g, or t
  misc_feature (26)..(26): n is a, c, g, or t
  misc_feature (334)..(334): n is a, c, g, or t
  misc_feature (440)..(440): n is a, c, g, or t
taaactgaagcccngcacggtggctnatgcttgtaatccccagcaatttgggatgccgaggtgggcaagatcatgaggtcaggagttcccagacccagcctggccaacacagtgaaaccccgtctctactaaaaatacaaaaattagctgggcatggtggcagacacctgtaatcccagctacttgggaggctgaggcaggagaatcacttgaacccgggaggcggaggttgcagtgggctgagatcacaccactgcactccagcctggacgatagagctagactctgtctccacaaattaaaaaattttaaaaaataaaataggccgggcacnggtgcacgcctgtaatcccagcactttgggaggccgaggcgggcgaatcacaaggtcaggagatcgaaaccatcctggctaacactggtgaaaccccgtctctacntaaaaata

SEQ ID NO: 492586 - DNA, 814 bp, Homo sapiens
  misc_feature (7)..(7): n is a, c, g, or t
  misc_feature (28)..(28): n is a, c, g, or t
  misc_feature (34)..(34): n is a, c, g, or t
  misc_feature (62)..(63): n is a, c, g, or t
  misc_feature (70)..(71): n is a, c, g, or t
  misc_feature (88)..(88): n is a, c, g, or t
  misc_feature (99)..(99): n is a, c, g, or t
  misc_feature (103)..(103): n is a, c, g, or t
  misc_feature (107)..(107): n is a, c, g, or t
  misc_feature (111)..(111): n is a, c, g, or t
  misc_feature (138)..(138): n is a, c, g, or t
  misc_feature (143)..(143): n is a, c, g, or t
  misc_feature (173)..(174): n is a, c, g, or t
  misc_feature (178)..(178): n is a, c, g, or t
  misc_feature (182)..(182): n is a, c, g, or t
  misc_feature (278)..(278): n is a, c, g, or t
  misc_feature (283)..(283): n is a, c, g, or t
  misc_feature (305)..(305): n is a, c, g, or t
gaacggncggaggggacccggacctcgnggaccncgggggggggcagggccgggtgtctggnncaagcgnntcctcgggaggtctcanggcccccttgngggnccangggnaacctggccttgggccgcggtggcccnaggancgggacggggacttgggggcacggcttttnnccangggnccccctaaagcccgttttttccccgttttccgccgcccaaaaagggggcccccccgggttcccccgccctgtttaaccatccagaggggaaattcnctccnttggggcgggaaataacgcccncccatcctgcctgccggggtctcccgcgggtgggtctcttcccccccggggcggggtgcccggggggggccaaaagggggaaataaaagcgccgggggggaaaaaacgcggggaaaccagcggattttctcccgccccgaaataatatccccgtgggggctgccccaaagagtatggtcgtcccgacggggtagggcccttttggggtcggcgtcggcaccccctggcgtgcgtgtgggcggcccccacaaacaatgggtgcaaaacggggcgggctgttatccccccccggggggcggggggccacataacagggtcgcgcccgcgccctgcggggtaaaacgtcgcggcgtttgtccccgccccggaaaaggtcgcccgcctcgtgggggcgtcccccgcacgtgggtgtgttttggggtggcccctggtttccccccccccacgggccgggcggggggttcacccgccccccggggggcgggccggggaaaagcgcccttgcctag

SEQ ID NO: 492587 - DNA, 329 bp, Homo sapiens
acagagcttatttgcggtgcctttccccaccctgcattatgtttttaagcagtggtatgtgttgtgttgtgttgtgtgtagtagtagtgtagtatgtgcgcgcgcaggtgctgcgtgtgtgtgtaagaatatcacactttagacggtattttcacattcagagaactgtgaggctggatgagatcattaaggagaggaggagtacgtagagaagataagttccagggcagagtgagttaaggggcacctccagtgttatgaggttaaggaggtgagatggaacccttacaggagacttgagaggattggctagggaataggagaaaaac

SEQ ID NO: 492588 - DNA, 163 bp, Homo sapiens
  misc_feature (7)..(7): n is a, c, g, or t
tggaatngagaacagcaagtactatgtgactatcattgatgccaggaccagagactttatcaaaacatgattacaggacatctcagctgacgtgctgtccgattgttgctgctggtagtatggtgaatttgaagctggtatctccaagaatgggcagacccga

SEQ ID NO: 492589 - DNA, 151 bp, Homo sapiens
aggtatctagaggatcctgtatcagagcatacccctcggttgatttgtgggcctgatgagggccaacctggccttattggtggatgccaaagaaattaagatgcatctcggggcattggcactggatgagaaagtggctcaattggagatt

SEQ ID NO: 492590 - DNA, 147 bp, Homo sapiens
gatgccagataattcagagtcactctacccatgcttgtaggccaatcacaaccctcaccctccgtaacatagatcatcttccttctggctcctcctcacttcccttccaggacctactaagcagcttactttcttttgtacactcaa

SEQ ID NO: 492591 - DNA, 155 bp, Homo sapiens
gacagaaagaatgtcatctcttcaactagatgtaagctcttgaagaagggctcaataccctctgcttcctctgtatcccttatggtagagttaaataaaattggtggttggaatatttaggaaataaagccacaagattgataagatttttttaa

SEQ ID NO: 492592 - DNA, 968 bp, Homo sapiens
  misc_feature (36)..(36): n is a, c, g, or t
  misc_feature (65)..(66): n is a, c, g, or t
  misc_feature (72)..(72): n is a, c, g, or t
  misc_feature (76)..(76): n is a, c, g, or t
  misc_feature (79)..(79): n is a, c, g, or t
  misc_feature (92)..(92): n is a, c, g, or t
  misc_feature (98)..(98): n is a, c, g, or t
  misc_feature (142)..(142): n is a, c, g, or t
  misc_feature (188)..(189): n is a, c, g, or t
  misc_feature (192)..(192): n is a, c, g, or t
  misc_feature (199)..(199): n is a, c, g, or t
  misc_feature (206)..(207): n is a, c, g, or t
  misc_feature (210)..(210): n is a, c, g, or t
  misc_feature (213)..(213): n is a, c, g, or t
  misc_feature (220)..(220): n is a, c, g, or t
  misc_feature (225)..(225): n is a, c, g, or t
  misc_feature (231)..(231): n is a, c, g, or t
  misc_feature (234)..(234): n is a, c, g, or t
  misc_feature (262)..(262): n is a, c, g, or t
  misc_feature (266)..(266): n is a, c, g, or t
  misc_feature (277)..(277): n is a, c, g, or t
  misc_feature (280)..(280): n is a, c, g, or t
  misc_feature (317)..(317): n is a, c, g, or t
  misc_feature (321)..(321): n is a, c, g, or t
  misc_feature (334)..(334): n is a, c, g, or t
  misc_feature (385)..(385): n is a, c, g, or t
  misc_feature (390)..(390): n is a, c, g, or t
  misc_feature (394)..(394): n is a, c, g, or t
  misc_feature (413)..(413): n is a, c, g, or t
  misc_feature (429)..(429): n is a, c, g, or t
  misc_feature (439)..(439): n is a, c, g, or t
  misc_feature (491)..(491): n is a, c, g, or t
aagtttggaacaaaaaaaggcaggctggtaacccgngccgggattcccccggggtgggccccacnncccccnatcnaantcaggggtcctgntgaacnggctcacccaggtggcaattggccccaaggcttcgcggaacggncccatgccccttggttttttgcccttgttcatgccttgccctttgnnttncaaagangcgtggnnccnggnccaaaancgttnccgttntancccagccttttttgaacccaagccttangctnccaaagcgccntgngccgcgccacccagctgtggcacatttgacaaccttnaccnaggaagtttttgnaagaaaactcttattatctccaaaaaggtacccagaaagttattctatgcnctganatgnacatcctcagaacgctccnttcctgcttactcganaactcttatntccgaaccaccctccgaaccatggcaagaaaacgccgaaccaaaaaaccgantctgaggagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492593 - DNA, 464 bp, Homo sapiens
tcgagcggccgcccgggcaggtcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492594 - DNA, 427 bp, Homo sapiens
actaggccgctcgctgtcctatagtctcctagaatcaattctctgagtccgtgcattcccagataaaggcagctattaaacgtctctgtcacacagataaaagaagagaatcagaaagtgccaaacttttcaacagagtttcacattcctctcttaggtggtcaatattaaccccatggcaaaagcagaaggacactatttaatggttaagggatccattcaagaagaggatattaaaatcgtcaacatatatgcccctaatataggagcacccagatacctataacaaatattaacagacataaaaggagaaatcaatgggaatacaatcacattagaagactttaacaccccactcggcaatggacagaggctctagacagaaaatcagtaaggcaacagagatcaggagcagttccacttaggc

SEQ ID NO: 492595 - DNA, 721 bp, Homo sapiens
  misc_feature (25)..(25): n is a, c, g, or t
  misc_feature (98)..(98): n is a, c, g, or t
  misc_feature (102)..(102): n is a, c, g, or t
  misc_feature (116)..(117): n is a, c, g, or t
  misc_feature (140)..(141): n is a, c, g, or t
  misc_feature (147)..(147): n is a, c, g, or t
  misc_feature (149)..(150): n is a, c, g, or t
  misc_feature (155)..(155): n is a, c, g, or t
  misc_feature (167)..(167): n is a, c, g, or t
  misc_feature (179)..(179): n is a, c, g, or t
  misc_feature (190)..(190): n is a, c, g, or t
  misc_feature (198)..(198): n is a, c, g, or t
  misc_feature (202)..(202): n is a, c, g, or t
  misc_feature (208)..(209): n is a, c, g, or t
  misc_feature (214)..(214): n is a, c, g, or t
  misc_feature (224)..(225): n is a, c, g, or t
  misc_feature (227)..(228): n is a, c, g, or t
  misc_feature (232)..(232): n is a, c, g, or t
  misc_feature (234)..(234): n is a, c, g, or t
  misc_feature (237)..(237): n is a, c, g, or t
  misc_feature (239)..(239): n is a, c, g, or t
  misc_feature (245)..(245): n is a, c, g, or t
  misc_feature (252)..(252): n is a, c, g, or t
  misc_feature (255)..(255): n is a, c, g, or t
  misc_feature (259)..(260): n is a, c, g, or t
  misc_feature (267)..(268): n is a, c, g, or t
  misc_feature (271)..(271): n is a, c, g, or t
  misc_feature (275)..(275): n is a, c, g, or t
  misc_feature (280)..(281): n is a, c, g, or t
  misc_feature (283)..(283): n is a, c, g, or t
  misc_feature (285)..(286): n is a, c, g, or t
  misc_feature (288)..(290): n is a, c, g, or t
tcttccttccctttcttcaatattntttttccttccaaacctttcctttatccattcttttttaccactctattctccaatcccatctctctcaccanctgnccatttacacctannattatttttaataaacctatatnncaaatnannataantattcattcctncattactcccanacctccttctncttctcanactntattcnnacacnctccaacatnnannaaangnaananaaatcnaatctanagntgtnngcatctnnctnctgntcatnnantnntnnntggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492596 - DNA, 767 bp, Homo sapiens
ggaggtgacgtctagatgatccccgttcgcgccttttctggtattaaatcagagcaggctgccgtgcagtccgttcctgttagtccagagctaatgactcatcgctcattctgccaatctcattgcgcgcaccacctggctatttatacctacccagattttgcgcacgatgatcttgcagcataccgtaattatacattcttgcttgagtcccggattgccattcgtgcttctcacacttcatattccaacacccgtcgcgagcatggaggatctgcaacataaatctgatctagtgctgctctggatctggctgttgttcatcgagttctggcttggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492597 - DNA, 110 bp, Homo sapiens
  misc_feature (93)..(93): n is a, c, g, or t
cacgaggccgggtggcctcggtcggtaccctgggcgcggagcagctgcctcattagtattcgtacccacgaggcggcgcagcgggccctcggngacagcgagcgtcgcgg

SEQ ID NO: 492598 - DNA, 690 bp, Homo sapiens
ggcaatacagcaagatcccatctctattttaaagaaaagtctcactttgggaggccaaggcgggtggatcacaaggtcaggagatcgagaccatcctggccaacatagtaaaaccccatctccactaaaaatacaaaaaagtagctgggactacaggcgcccgcctacacgcccggctaattttttgtatttttttttagtagagatggggtttcactgtgttagccaggatggcctcaatctcctgacctcgtgatccgcccgtctcggcctcccaaagtgctgggattacaggcgtgagccaccgcgcccggcccaagaattctttctggaaacaaagaaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492599 - DNA, 456 bp, Homo sapiens
  misc_feature (1)..(1): n is a, c, g, or t
  misc_feature (3)..(3): n is a, c, g, or t
  misc_feature (5)..(6): n is a, c, g, or t
  misc_feature (8)..(8): n is a, c, g, or t
  misc_feature (21)..(21): n is a, c, g, or t
  misc_feature (208)..(208): n is a, c, g, or t
  misc_feature (297)..(297): n is a, c, g, or t
  misc_feature (350)..(350): n is a, c, g, or t
ncncnngngactttaatggtncgttcgtaggtgtcctcggctcggggtagtacccagggtagtgtgcgagcaatctggaaagtagcccatctcgttccagcaaggattctcagcgagcagatctgcttgttgaggaacaggatcacagagatggtgcgcagcatctgttgttccagatgctcttgaagaggtcagagctcctgcaggnggttggctggttgtcccccggatgacatttgtagctgctgctggcacacgaagatgatggcagcacatcgttgagcactggatccactnggggtcacgcgctggcaccacgtcaaacatgtggaagttgacttgccactggncttggctcaaagatccagaagtcaggacatgtagggagcaggtcctgatcgctcggacatgtcagctgcttgacacgtcgacttgtccaggaagtctgggacagca

SEQ ID NO: 492600 - DNA, 395 bp, Homo sapiens
cagagtggcgggagcccgtgcgctaccgaacacctcggacagcgatgacacccagagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492601 - DNA, 152 bp, Homo sapiens
attctgcgacactcatccggtcgactgctcgaagactcgcgatcaccagcgtgcgcgttcgtcgacagtacctgggtcttcacgtgcttggtgttgaccgcgatgccggcaggtatgttctcgcgcctggttgtccttgtagatgtccacgt

SEQ ID NO: 492602 - DNA, 1012 bp, Homo sapiens
ccacctctgcctcccaacgtgccgggaccacaagcgtgagccacaccgccagaccaagatgatttaaagtatacaggaggatgtatgtaggttatgtacaaacactacgccattttatgtcagggactggatccccaggggggttttggaatcattgaggatcccaaggcccaactccccgaaccactcagggtcctgtggacagctcacctagtggcaatggctccaggctcccggacgtccctgctcctggcttttgccctgctctgcctgccctggcttcaagaggagggagtggcttcccaaacattcccttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctaaaactggtccggcatctccctgtgtggtcatccaatcgtgggtggagcccgtggcagttcctcaggagtgtcttcggcaacaggctggtggtacgggggctctgacaggaacgtctatgaactcctaaaggaactagaggaaggcatccaaacgctgatggggaggctggaagacggcagccgccggactgggcagatcctcaagcagacctacagcaagtttgacacaaactcgcacaaccatgacgcactgctcaagaactacggggtggtctactggtttcgggaatggcatggaccatgtcgagaatttctgggcaccgggcatgcagctcgggagggcagtggggttctactgccggtggatccgggaacctccaggccctggccggaatgctcatgcccactggcaaaaaaatgtcaacaaaacaaaagacagcccacaacaccaggggcaccatgatggggcacgggaggaatatcccggaccccgg

SEQ ID NO: 492603 - DNA, 652 bp, Homo sapiens
ggcgccatgtctgtactagcagctatctatcgagtgtgcgaggttatccagaatcacttatgaacctggcgtatacgtgtgtgccaatgtgtggctatgagctgttctaccagcctgctcgaagtatgcacactcgtctccatggtcctggcgattcaccgatgaccattcacgcctgacagctgtggccaatgctgtcctgtgagcacaatagatctgaaagccttgaagtgtgtcctgtggcaaacgtgtggcacattgtggttggtgccactgagttcctgaactgacggccccaaagccggggcagtccctgattcttgaatattcagcagctacgctgaagtattgtacccctaaatgtgcaacagaaacttctgtcctacccatgggtcatctaggcgggcagcccacatccattcccagactggccaccacactgaggccacacgtaggccattccaccttgtgagttgtgaaccctgaggcgtctgagacaggaaggcagtgcgcaatggttgaaacatcatggacactcccaaggcccgtactctgaacaatgaccttaacgtcacttggaaaccgagactcactatgctgatggtacatgccctctgctcgggacaggcctgtgctgtgcagccacactgtc

SEQ ID NO: 492604 - DNA, 393 bp, Homo sapiens
cactaggcagtggtgggcaaaagccaggagcagggacgtcaggagcctggagccattgccactaggtgagctgtccacaggaccctgagtggttcggggagttgtggccttgggatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492605 - DNA, 147 bp, Homo sapiens
tcggctctccacataatttgcccagcccctgcagtcctggaccctgacacgctaaagcaagtcacagtagtgggatgggggtggagcagaggccccccactacccactacagtgcctccgccatatctactctagtactccgaccct

SEQ ID NO: 492606 - DNA, 481 bp, Homo sapiens
gacaccacatttcccttccacatcaccctagcagaggttctccatgagggctccattcaagcagcaaacgtctgcctggatatccaggtgtttccatacatcctctgaaatctaggcagagcttcccaaaccccagttcttgacttctgtgcacccgcagcccaacaccacatgtaagccaccagggctttgtgcttgcactctctgaagcaacagcctgagctgtattgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 492607 - DNA, 643 bp, Homo sapiens
gccggggagggccggtctggacgtcgctcgcgctccgcctgggttcccctcccccaccgggtggtgcgcgcgcgcggacagcggtccgtgggaggaggggttcggggcgcgcgctggggcgcccgtcgcggaacggccggcgtcgcgccctttctttcttagggggctgcgcgtctcgtaggtggaggcatgcaggggtctctagactcgcgtgcccgggggcgggcgaggagaaatgcgcgcgatgaggtcatcggagcgcgcgccctagccaaggttgtatcctgtctgcgcgtcaacctccctcggaagccggggcctccggtgtgggtgtctctgatggtgtcatcacaggtgtccaacgagcatgaaggtgcgtaatgtcttcaatcgccacgaggcagtgtgaagtaagcgcaagacaggcggagcgtcttcatgcctgagttgatggacaagattgaacatcaatactcatggtagggaggtgcaaggcatgaatccatgggtggtgccgactgttggtgctcaagtacctgtctgatcgtacccattaaagacgcaacattttgttggaacgatgctagccagaataaggactgcggttatgacccctctactgatggcagccctatgactacca

SEQ ID NO: 492608 - DNA, 283 bp, Homo sapiens
ccacctctgcctcccaacgtgccgggaccacaagcgtgagccacaccgccagaccaagatgatttaaagtatacaggaggatgtatgtaggttatgtacaaacactacgccattttatgtcagggactggatccccaggggggttttggaatcattgaggatcccaaggcccaactccccgaaccactcagggtcctgtggacagctcacctagtggcaatggctccaggctcccggacgtcatgtcatggctttccatgatgttatgtgttcttgtgaggtg

SEQ ID NO: 492609 - DNA, 128 bp, Homo sapiens
taaaatcttcataattttattcaccccatatactgggctgaaaaagaaaatttcttgattaaaaaaacccctattaaatgatcaccccgtagggaacatttatttatttattttaatggttatttttg

SEQ ID NO: 492610 - DNA, 314 bp, Homo sapiens
tgtggatacatatgtagcagggcagtattgaggctgtgcactagtatgttcgagtcgtgtacagtaggagagtgatattagatcaggagcacgtggttactagcacagagagtactccccagtagattaatcagtgaggggtaaaggcgaggttagcgaggcttgctagaagtcaatcaaacaagctcattcagtgggcagtcagcagatttgaagtccattcacagcaggcatccatgatgcgcactgtgcggtgcgattcgatagtaagcagttatgctcacgccagcacatagtaatgaggcatgataaga

SEQ ID NO: 492611 - DNA, 244 bp, Homo sapiens
aaaatcagattggattaaacaattctagagcaacctcatgcagttctcttagatgatgaaaaggatgttgtcgagataattgacaagttcacagagtcacttactggcaattaccaattgtgaggagaggttcagccctgtttaccaccagccaacagcctatgttaaaggcctccaactaggacgcggactgtccctgcaagtccagcttgagaatcttgcgatgaaaaattaccctggagtt

SEQ ID NO: 492612 - DNA, 399 bp, Homo sapiens
  misc_feature (77)..(77): n is a, c, g, or t
  misc_feature (94)..(94): n is a, c, g, or t
  misc_feature (114)..(114): n is a, c, g, or t
  misc_feature (173)..(173): n is a, c, g, or t
  misc_feature (260)..(260): n is a, c, g, or t
  misc_feature (335)..(335): n is a, c, g, or t
agacgccgctacacaatggagtctcgctctgtcgacccaggctggagtgcaatggtgcgatctcggctcactgcaanctctgcctcccggtganaggtgaagccagctggactnccctgggtctagtggggacttggagaacttttctgtctagctaaagatttgtaaatgcnccaatcagtgctgtgtctagctaaagtttgtaaacgtaccaatcagcactctgtaaaaatgggccaatcagcactctgtaaaatggnccaatcagcactctgtaaaatggaccagtcagcaggatgtgggcggggtcaaataaaggaataaaaagctggtancgagccggcagtggcaaaccgtttgggtccttctcggtaccctggtggctttgttgttttgctc

SEQ ID NO: 492613 - DNA, 1256 bp, Homo sapiens
  misc_feature (772)..(772): n is a, c, g, or t
  misc_feature (811)..(811): n is a, c, g, or t
  misc_feature (846)..(846): n is a, c, g, or t
  misc_feature (878)..(878): n is a, c, g, or t
  misc_feature (885)..(885): n is a, c, g, or t
  misc_feature (927)..(927): n is a, c, g, or t
  misc_feature (940)..(940): n is a, c, g, or t
tgctctttttcctcgcttgcatgcggagatgagcgaggcgggcgcacggatggacagcagggtcgttgtggtcttaagtgatttcccgtttagcggttttcgtgtagaggtctcagttatgttgtggggcttcttcatttacggcacaatgggtttcaatggtctcggcgcctgtggttcctcttgagaggctggttcactgctttcaacgcggccttttttttagcgccctagtgttccgaatgagttgcgttcaatgtggtctctgagcgcgccccgtaaacagggcttctaagagtttttagtcgagcaatgttaaagcgttaattgggggttccagaaccggtgttccctccgaatcccttttgggtgcaaattcaagttaaaaataaaaggttggttcgggggacccttgtctcgtcaggtgtcttctaaggcaaattagtgtactttgtgtttgttctggccgaaatttttatgagatatctctcacctgtcttcccctttgaaccggttaaagctcatagctgtcagctctgaatgaggaggggagaagcccccgggtctttctttgaaaggaatcccctgctttgagggctgcctccctcatggtgtgcgctgtcgtttctcttcctgacgcatcttgtgaaatcacgaggtaactatgccaagcatccacggcggttttgaaagtgaagccctacaccccgcagagtcccggggccctctgtccccacactgccggcccacagttctctctccggagtcaccnaggaatgcacaggtttcgactaccagaaaggggagtccntgggttctttcaaaaaattcgtgaggagagctgtntacagtggaatagggggtctccctggggaatncaggccnagtccttttattttaacatgatgtccatgaagaggtttgccntctgggcagcccngtcggcaaaggagcgtgcatactgcgtttgtgtaattgtttgctgtatctcccttccctctgagctgtattgttctttaatggctgtcttgcccttccaaaaaaaattgaaaaacaaaaaaaaaaaaaaaaacaccgcgaaaggttaacaaaaaaaaaacaaagagtgtttgtggtttaagtttcacgtgggagaaaggagaaccggggaggggcttttttcaccggcttttttaaacttctctttaatataacacacccttaggacgccttgaggtgtattgtagaaaacaacaacacacaacaaaacaacaaac

SEQ ID NO: 492614 - DNA, 1287 bp, Homo sapiens
  misc_feature (772)..(772): n is a, c, g, or t
  misc_feature (811)..(811): n is a, c, g, or t
  misc_feature (846)..(846): n is a, c, g, or t
  misc_feature (878)..(878): n is a, c, g, or t
  misc_feature (885)..(885): n is a, c, g, or t
  misc_feature (927)..(927): n is a, c, g, or t
  misc_feature (940)..(940): n is a, c, g, or t
tgctctttttcctcgcttgcatgcggagatgagcgaggcgggcgcacggatggacagcagggtcgttgtggtcttaagtgatttcccgtttagcggttttcgtgtagaggtctcagttatgttgtggggcttcttcatttacggcacaatgggtttcaatggtctcggcgcctgtggttcctcttgagaggctggttcactgctttcaacgcggccttttttttagcgccctagtgttccgaatgagttgcgttcaatgtggtctctgagcgcgccccgtaaacagggcttctaagagtttttagtcgagcaatgttaaagcgttaattgggggttccagaaccggtgttccctccgaatcccttttgggtgcaaattcaagttaaaaataaaaggttggttcgggggacccttgtctcgtcaggtgtcttctaaggcaaattagtgtactttgtgtttgttctggccgaaatttttatgagatatctctcacctgtcttcccctttgaaccggttaaagctcatagctgtcagctctgaatgaggaggggagaagcccccgggtctttctttgaaaggaatcccctgctttgagggctgcctccctcatggtgtgcgctgtcgtttctcttcctgacgcatcttgtgaaatcacgaggtaactatgccaagcatccacggcggttttgaaagtgaagccctacaccccgcagagtcccggggccctctgtccccacactgccggcccacagttctctctccggagtcaccnaggaatgcacaggtttcgactaccagaaaggggagtccntgggttctttcaaaaaattcgtgaggagagctgtntacagtggaatagggggtctccctggggaatncaggccnagtccttttattttaacatgatgtccatgaagaggtttgccntctgggcagcccngtcggcaaggagcgtgcatactgggcagccctgtcggcaaggagcgtgcatactgcgtttgtgtaattgtttgctgtatctcccttccctctgagctgtattgttctttaatggctgtcttgcccttccaaaaaaaattgaaaaacaaaaaaaaaaaaaaaaacaccgcgaaaggttaacaaaaaaaaaacaaagagtgtttgtggtttaagtttcacgtgggagaaaggagaaccggggaggggcttttttcaccggcttttttaaacttctctttaatataacacacccttaggacgccttgaggtgtattgtagaaaacaacaacacacaacaaaacaacaaac

SEQ ID NO: 492615 - DNA, 407 bp, Homo sapiens
ctcatgtctgtaatcccagcactttgggaagctgagacaggtggatcacaagctcaggagattgagactatcctggctaacatgtgaaaccccatctctactacaagtacaaaaaattagccaggcgtggtgcacatgcctgtaaacctaagctggctaatttgttggcttttctatcttaaggtttgatgaatgcctgtccacctccattcacatctggctttgaacacttaaattagctataggtcttttggctcaaagtcacttggccatagcggtcccaccaagggacaggatagacccagagcaagcagctgtgccgccttggaaatgctatgggacagaataaaagtttggccattgactgctctctggcaaatcttggccagagggggataaggtaaacc

SEQ ID NO: 492616 - DNA, 127 bp, Homo sapiens
agcaggatctctagtcgctgtattgggggagctgacggcataaggatcacagagttctgccaccgcttcctggagggcaaaatcaagccccacctgatgagccagtgagctgccggtgagacgtggt

SEQ ID NO: 492617 - DNA, 494 bp, Homo sapiens
  misc_feature (277)..(277): n is a, c, g, or t
  misc_feature (283)..(283): n is a, c, g, or t
  misc_feature (297)..(297): n is a, c, g, or t
  misc_feature (300)..(300): n is a, c, g, or t
  misc_feature (311)..(311): n is a, c, g, or t
  misc_feature (314)..(314): n is a, c, g, or t
  misc_feature (320)..(320): n is a, c, g, or t
  misc_feature (374)..(374): n is a, c, g, or t
  misc_feature (378)..(378): n is a, c, g, or t
  misc_feature (387)..(387): n is a, c, g, or t
  misc_feature (419)..(419): n is a, c, g, or t
  misc_feature (457)..(457): n is a, c, g, or t
cagctccaaaacccagggcctgtgttctggacccgggggaacttccaggaaatttgggtggtggagacccaaagggttggaggcagctggcccaaggggttgaggcctggctgaattacccatgctttaagaattgggatgggtccccagtgagctcttggattttgttggtgagacctcctgcttcctccctgccatttatcccggcccctttccatgaagcttgagacatatagctggggccctttttttccaaagaacttacctcttgccattnatcccngcccctttccatgnagnttgagacatanagntggggncccttttttccaaagaacttcccttttgccaaaggccctttattttcatatagngacnggctgggcnccattttttccagtcattttggtcccaatcgngggtttttggaattttcccatcccttgtccagaattcnttcccctaagggtaataataaataatttttaacccca

SEQ ID NO: 492618 - DNA, 663 bp, Homo sapiens
agcgggctctctcagcgccgccgtcgccaccgccaccgccaccgccactaccaccggctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcccaaggctgggggacacccgacagattcaaagtccaccatcgcgccagccctcatcagctcaggtctctctgtggtggagcaagagaaactggacaacctgatgctggagttggatgggactgagaacaaatccaagttcggggccaatgccatcctgggtgtgtctctggcagtgtgtaaggcaggggcagctgagcgggaactgcccctgtatcgccacatggctcagctggccgggaactcagacctcatcctgcctgtgccggccttcaacgtgatcaattggtggctctcattgctggcaacgaagctggccatgcaggagttcatgatcctcccagtggggagctgagagctttcgggatgccatggcgactaag

SEQ ID NO: 492619 - DNA, 608 bp, Homo sapiens
tcctgcctgacctgctctgaacaactcctgtgtgaagcattgacttttttttttctgtgacaccccacggggtgacagggaccaataaatagaatgcgagcactgcacagttcgcttccctgaatcgatatgaagaacaccgcaagggacggggcccccgtcatccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaaaaaaaaa

SEQ ID NO: 492620 - DNA, 229 bp, Homo sapiens
ctgctgagtagacaagacgcacagcgcaaaggggccgcctatggcctgatggcctgtagaagggcctttgcacctatcgctgaagcgcaggagaagatggcggcactgactgatgccatccaagataagatgaactttcgccggcgagagggagccctctttgccttcgagatgctctgcaccatgctgtggaaactactctgagccgaatgcggtatacgtgctgtcc

SEQ ID NO: 492621 - DNA, 209 bp, Homo sapiens
cggagacgattgattgagcctggagctcagaccagagcaacatagtaaacccggtctctatcatacaataacgacaaaagaatttaatcttatccccaaagatctggccttcatcctttacacgtaaggggcgatctgtaagataccagacctgagcaggagacctgaggaagccaggagacctgagcaggaaaacggggcaagccaag

SEQ ID NO: 492622 - DNA, 192 bp, Homo sapiens
tttttttaaaaaggggggggggggggggggggggggggccccccccggccccctttttccccgggggtgggggggggaaacccaaaaattttggcccccccgttttttgggggggggggggggggggtttttttttttaaaacccccccccccccccgggggggggggggggggccccctttttttttttta

SEQ ID NO: 492623 - DNA, 677 bp, Homo sapiens
ccatctacaaatgaaatgttcacccgtaactaccaatggggacctaccccgaccaatattcatccccaactggaatgccaaacactgttgtgccatgtggcacactgatgaagcaacttcaccaagatggtaatggtattactggtcatcatgccactctcttcctgcagcagcccactttacaggattagcatcagttgcaggtgccaccgcatacagaatggactgaggcacagaagctggtatcttccgtgtcactcatcagcacagaagtcgcgcccgagtcctcgtttggcacatgccagttgcagttcgttccactgctacatgtgcattatcctcgagaatgaaatgaccctattagtgagtggcgtgctttgggtattctaatgctattctccggcttagacgagacccaactcctcaccttcagcgaagactaggtaactcatgcctcagcgattgctgactgacagctatggtgctatcaaatactccgattcacatctacgaagcttgtgccagaacagatgcggaactccgtgtgcctctggctgcccagtggctatacgattcttgcaagaggctgctacaaatctgatctgctcggggaacgacaagagcctttcattgcgaacatgccttataatcgcgtgtgcgacttgggatccgcacag

SEQ ID NO: 492624 - DNA, 494 bp, Homo sapiens
gggaggccgaggcgggtggatcaactgtggtcaggagtttgagatcagccaggccaacctggtgaaaccccgtctctactaaaaatacaaaaaaaaaaaagaaaagggaaaaaaaaatagcatttatacctctttcctgtgtcttcaaccggccatgaaaatttctgaacacttccaaatttcagtggaataattccaaaacaaaatttataaggtataaaataatttaaacttcttataggtaataggtatactttaaaaaggcctcaggggtatatagatcttctaaacaggctacaattcaggtggcagcttacatttaacgcaactatggttcctctaagttggagaacaactaaggcctatttcactggctggtgtagcctcagtggcctaacatggggtggccaaataaatattcggtaagaattaccactggaatttggtaaaaacccattccgttttcggtttacaattggccaaaaatctcaaag

SEQ ID NO: 492625 - DNA, 293 bp, Homo sapiens
tgctgagtcgatctagagatccccgcagtgcacctgtgtgatttctgctcactgtaacctccacctcccgggctcaagcagttctcctgcctcaccctcccaagtatctaggattactgcttgctgatccgaactatctatccggctatgctgtatgttctagatccctcagtcagcacgttcctactcctagtccctatgggatccattctctgttcatcttcttgctttggtgtccaccaagtgcctgctcccacaagatatccttctatgtcttcggttatgcttccggt

SEQ ID NO: 492626 - DNA, 1473 bp, Homo sapiens
  misc_feature (723)..(723): n is a, c, g, or t
tgggaagttttcatctcatacgtggttatctcttttataattaaaaaaaaaaaatttaaaaactcaaagaaaaacgtctctgtggccgagggcccgaggattaaaacaaacgaggaaacattctcgagaaactccagagggcgaggggaagaggcgtggtgtggcctctctctctctctcaaaaggagacgctgtggcagggggtgtggagaagagagggagagggagacacagagactctcagtgtgtcacacagaaagggatctgcttatcacagatattatcacaccacaccccaccacacccccacacccctctctctaataataaaaaacacagagagagagaaacaagagcgcgccaccatctctatctatataaacacacccacaacaacacaaggacaacactattatatctcacatatacacaccgctcttatctcttgtgtggtgtcgccacacacacatgtggccttatattgtgtagaaaagagagggaggcgcctgtgtgtagagagaagtgtgtgagagaagagagcgcacaggggggtgagagagacgggagaaagatatatgtgtgcgcctctctcagggtctctatagtagtttctcacactattttctcacatatttctctctctctatcacagcgagagaggtctctctctcagggtctctctctctgtgagatgcgacactgtgagacaatctcgagacgagnctctctgtgagcacagagaaaaccccagagtgtactttgtgtgtgtgtgtgcgcgccacaccagacacgtgtgcggcgtggtgtcgccccactgtgtgtgtgtgcggcgtgatgagagaaatgcccacctatggggccaactacaaggaggggtgttttctacaacaaaaacattttatgtgatgagatgcgcgcggtgtggacaagcgcggagatatttgggggaagaaaaaccagccggtggggcgacgcgaccaacatctctctatgaggtggggggcgagatcctctctatccatatcttcttttatacaaacagccccaatattctccccctctgctttttctccctttctaccccaaagatgtgtggtctcacgcgctgtggcaaatctctctcttccccacgggtgttctctctccgccaggaggcactattttctccgggtgggccaccacgatgttgtgggggcccccttttgagcgacccttatagcgttccccccggtggggagtgttacaccccatccctcggcgggggggtttgcttctccacaaaaaaaatattcttccgccaacgtctttaaagttttttctccccccaaagtggttgttcccccctctttgtatacacctctcccccgcgcgactctttccttctgcacgagaggattctttcccgcaaacacgtcgtggtgtgtccccaacgtctgtgggcttcccaccccgctgcgggggccccccagcgcc

SEQ ID NO: 492627 - DNA, 840 bp, Homo sapiens
gagccagtctcacttctaggaatacctagtatatgcgcgtcagcacggcgcattttcctccctactatgcctagaaaggattaatagtagtcgcgggttggatatataggctactctcataaccctccaagcaaccaatccctcttaggcacatatgtgcctattgacatactagtctatgcagtgtgcgagggcgacgggtgggccgtagcccctagcgtagatctgcaatgctcgcaagcacaatatggaccgtagagcgtacgtacatagaggctaaagcatactccaatgctagaactaggtgcgtcccaagcagagttatgatgtagctacacagtgcacaggcgacattttcctcatgcagtatcaacaatacatctcttgaagtcaagcgatcgaagcccagtcccagcgagcgcgtacatgtatttaggcagtcgatcgccgcgctttaactatttgggataaagccgaagggtccaaacagagcatagccttatgttaggcgggtgtcctcggaaacaccttttttcgctccagaaggaccgggtataaaatcccactcgcatccttaggtagcgtatagcgtacgcggtggagacatcccttaaccctccggtcagcaatactctagtgtgacaacatgacctaagacgtccgggaattaattgcccaggtggagaccccaacgttagatcaggggacaaagaacaagggggctgcaccctcggcagtaaatatcgtaagggtccgtacctaaccaagctcgtgccctttgaaggttacatacacattggacaagcactagagaacacttaatacagtactcctgactat

SEQ ID NO: 492628 - DNA, 271 bp, Homo sapiens
gaggattcatcagaaatgaaagaaaacatgagggctgggtgtgctggcttgtgcttgtgataccagctacttgggaggctgagatgggagaccagcctgggtagcatagcgagaccctgtctcactaaaaaaaaaaaagaaaaattgggctgggtacgatggctcgtgcctttagtcccagctattcaggaggctgaggaggagaatcgctagaggccagaagttcaagtccagggtgggcaacatagcaagacgctgtctttacaaaaaa

SEQ ID NO: 492629 - DNA, 611 bp, Homo sapiens
ttttttgagacgagccgcttgtccccaggcggacgcggactgcagtgcgcatctcgctcactgcaactctgcttccgggtcaccccatctcctgcctcagcctcccgagtagctgggtgcctttgtccccagctgtacgggaggctggggtggatgatcgcctgaacccgggaggttgaggccgcagtgggctgtgatcatgtcagtgcactccagcctgggtgacagagtgagaccctgtctcaaaaaaaaaaaaaaaaaaaggtctgtttgtggagtcttagacatttcttttaaagaaatgaagtatttactttattgcatagctttataaattgtgcaagaatcccacatagatcttacaaagtacctttacttttgatggcaagaaatatgcctctgaccaattgttttcagaattcttaaaatgaaaaattgccagaatgttatgttataactgagaagaaagtcatgtaaaataacacaaagtgatagtgaaaaaatagaaaatcagactgataaaaataaatatatttttaaatcatattttatattaatctttttcatctttaagagtcccccattttttacagataaagtgtgaatttgtc

SEQ ID NO: 492630 - DNA, 277 bp, Homo sapiens
  misc_feature (114)..(114): n is a, c, g, or t
  misc_feature (132)..(132): n is a, c, g, or t
  misc_feature (137)..(137): n is a, c, g, or t
  misc_feature (163)..(164): n is a, c, g, or t
  misc_feature (168)..(168): n is a, c, g, or t
  misc_feature (186)..(186): n is a, c, g, or t
  misc_feature (205)..(205): n is a, c, g, or t
  misc_feature (218)..(219): n is a, c, g, or t
  misc_feature (228)..(230): n is a, c, g, or t
  misc_feature (244)..(244): n is a, c, g, or t
  misc_feature (271)..(271): n is a, c, g, or t
tagatcgagcgtgttaccggtgtttatgatgcacctgaggttaaatgacagaggatcccaaggcccaactccccgaaccactctcacctagtggcaatggctccaggctcccgnacgtcctgctcctggctnttgcnctgctctgcctgccctggcttagagnntggngccgtccaaaccgttccnttatccaggctttttgacnacgctatgctccnngcccatcgnnngcaccagctggccnttgacacctaccaggagtttgaagaancctata

SEQ ID NO: 492631 - DNA, 150 bp, Homo sapiens
gcgtgaggcggcttcgtgggcagcgagagtcacagacaagacagcaagcaggattgagcactacacggaaagcttgactctttagagactaccagacgacttaacacaattgaacccagacgtaactactgagtaaccttgagagtgcgg

SEQ ID NO: 492632 - DNA, 740 bp, Homo sapiens
attcggccccacggtgtacacatggtgctcaaccagcagggccggccatcgggcgatgccttcattcagatgacatcagcagagcgagccctagctgctgctcagcgttgccataatgaaggtgatgaaggagcgctacgtaggacgcgtggtcccctagttccacagcacgagatgagccgagtgctgcatggcgagggcacccttggcccgcagccggcatgtccccttccaccctgcaacctgccttgcctctcaccagctacctacagcagcttccaagccaccccaaacgctcattcccacggagacggcagctcttatacccctcttcagcactgctcccagttgccagggtgcctgcttggcccaagccctgtggcctactaattccagtgccagccactcaactctacctgaactacacaagcctactacccaagccccccagtctcccccaccactgtgccctacctcactacacccactgctgccctggcctctgctcccacctcagctgtcgtcccagtcaggagccttggtccgcatgcagcggtgtcccattacacggctggtatgaaggatctgctcaggcgtcttccaggcttaccagctaaccgcttgatgactaacacaggtctgatggcctggtgggtgacccagcttcgcactggccgccacaagccccccaaggcaatgggcgctgccgcaggcacagcaagccacgaggccaagacccc

SEQ ID NO: 492633 - DNA, 260 bp, Homo sapiens
tagcgtctatagcctaagcttgagtgcagaggcgcgatattggatcactgcaaactccacctccctggttcaagcgattctcctgcctcagcctcccacagtgctgagattacaggcatgcaacaccacacccagcctgaaacccagattcataatatgaaatcaaagtcttcagaccttgtaggtgtcctaaaaagcacgcctgagtgacccactagttagcaactgccaatctacaatatcatacacaaagggaaaca

SEQ ID NO: 492634 - DNA, 276 bp, Homo sapiens
gccggaatgagatcgctgcatccccagatgtgattgggcttggttaaccaagggatcgtagcagtaaggttcaagagcctttaatttcagcaaaacctaagaattgagagcaagtgtgagtgtggaggagtagaacttcctagagggaaagagaagggtcagatgtaatacagcaccagttttgtgcagaaggagtaggcatctcgttttcaaataatacagagcatcagtatctgattatgaacgtcacccaacatcaaggtcatcattaaagaa

SEQ ID NO: 492635 - DNA, 660 bp, Homo sapiens
acaagctttctagtaacattcctcttggcgctcgaggtgccacctgctagtcaagtagatacatggtctataagctgtatgtaccatagagatcatccttgatcctgactaaatgttatgagatggctcatcctcatcaccgactgcccaggggagaataccgagtgtcctcggagcgaatcctaatggcactcccttgatgtcattactcggtgagtctatcgtacgagagagtccagagcagatcccggtatcacatttacgctctccaagagtaaaccagtaagaagttgaatccctgaatagaccaataacaggctctgaaattgaggcaataattaatagcctaccaaccaaaaaaagtccagaaccagacagattcacagcagaattctaccagaggtacaaggaggagctggtaccattccttctgaaactattccaatcaataggaaaaaagggaatcctccctaactcattttaagaggccagcatcatcctgataccaaagcctggcagagacacaacaaaaaaagagaattttacgaccaatatccctgatgaacatcgatgcaaaaatcctcaataagatactggcgaactgaatccagaagcacatcaaaaaagcttatacaccatgatcaagtgcgcttcatccct

SEQ ID NO: 492636 - DNA, 503 bp, Homo sapiens
atccccgaattcatcagccagcagtgatatggacaatgaagtccaagctgaggaggtctcagatggagatgaggaacctattgggaattggagtaaaagtcacgtcttgctatgctttagcaaagagacaggcggcactgtgtccctgctctaaggatctgtggaactttgaacttgagagagatgatttagggtatgtggtggaagaaattcctaagtagcaaagcagtcaagatgtggcctggctgcttctaacagcatacactcacatgcgtgcacgaagagagtatctgaaactggaacttatatttaaaagggaagcagagcataaaagtttggaaattttgcagcctgaccatgtggcaggaaaaaaagcacaattttcagggaaggggttcaagccagctacagaaatttgcatgaggagctgaatgttaatagccaagacaatggggaaaatgcctcagagacctttgcagcagccccttccatcacaggcctgg

SEQ ID NO: 492637 - DNA, 333 bp, Homo sapiens
  misc_feature (227)..(227): n is a, c, g, or t
caggcatcacctagatgaccagagctctcatggactcgcttgggctgagtggcgcctgaagctgccctcaatccccttggtgcctgtttcagctcagaagaggtggaattccttggccttctggaggaaccacaacagagatggctaacaagcaaatccaacagcaaccacacgctacaagcgaacagcagagcactctgctactttggtcctgacagcagtacacnagcagcagtgaaggactgcacagcaagccctcaagactggatggaacagaacgtgacaggcattctacgagcttcgtcgagtcagggtacccgagctcggaattcg

SEQ ID NO: 492638 - DNA, 174 bp, Homo sapiens
actgcgcgaaatcgatcaaccctggggttagtatagcttacgtttaactatcgtttattgctaatcgttattcattgtttttccctgttgttaaaagtggtaggctaagcgttttgagctgcattgctgcgtgcttgatgcttgtcccttttgcccaacggtgaccggcgactt

SEQ ID NO: 492639 - DNA, 137 bp, Homo sapiens
tcgagggcacgctcatcagcaaacagcagtaggacaccaagaagtgactcgctattgactatcaccaccaccagcaccagcacaccatgtgaccagcaacaccgagacaggcagagacgactccctatttctcctct

SEQ ID NO: 492640 - DNA, 306 bp, Homo sapiens
gacccagcaggagcgcatgaagttctccatcgggagcaaggcgctggtgcccgatgtctcactgatcgacccggaaaccacggcgagcatggacccgtttctctcggcctgtaccggcatcgatgcgctggtgcatgccatcgaggccttcgtgtccaccggccacgcccgctgaccgatccccacgcgctggaagcatgcgtctgatcaatggcaacctggtgcagatgatcgccaaccccggcgacatcgccctggggaggaaaatcatgctgggcagcatgcaggccgggctggcgttttcca

SEQ ID NO: 492641 - DNA, 838 bp, Homo sapiens
  misc_feature (422)..(422): n is a, c, g, or t
  misc_feature (476)..(476): n is a, c, g, or t
  misc_feature (517)..(517): n is a, c, g, or t
  misc_feature (598)..(598): n is a, c, g, or t
gacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaacccaggttacggcctcagttaagctctttgaacattgagcaataaaatttctctggcatttccattatggattgtgctgatgaaccgggactttttaaaaattatttggtttccttataccttttacccttttaccttaacagactnatttgggtactcagtaaaacaaaattttttggggtcaaaatttctaactgggtntcatcactttataagataattaatttaatttatggaaactngtgaccttagagtaggggtagccctcaaaatatagatttactcatttactcatgggaattttcttcaggtgtaagggtacntttttcactaggaaaagaattcaaattttgcttatgcaatatattttggtggtggtcttcccttaagtgtatatggtatatatgagccttctggttaagttccttaatctggctaagtggtaccttaattagaggggcaatatatgtttcataacggaagagtcttaaataactttgggttgggtcagataggtattggggactgggtataatagggatgttaaaagccataataagtgg

SEQ ID NO: 492642 - DNA, 817 bp, Homo sapiens
  misc_feature (106)..(106): n is a, c, g, or t
  misc_feature (124)..(124): n is a, c, g, or t
agcgggtcttaccttcagcaggagccggttccctgtgtgtgtgtccgctcgccctctgctccgtcctgcggtgcccatgccctcctacggtccaccatggccctgntgcactccggccgcgtcntccccgggatcgccgccgaccttccaccccgggcctcgtccgccagctggtctctgccaggagccagtctcctggctggacccagtgtggaagatggagacctcgctagatcccatatctgaggagtcactgtaagcctttaacgagggacaccaatagtcatacacagatgaatctgcggagttaggtgcctagccgggtatgataacggaaagccattactgtgctgccttagacgttccgctaatggcatgaggcccagagttgtccgctagaaaagatttggcacaacggacatacctgcactttgcggcggactggcttgaacttttgcaagggcatctcgcagaactagccctgggtgagaacatgcgaacgtcttgacatgagtggccggtttgtcacctgtgcagaccattcctggaactggagccttaacggatcggagccagttttctgctaaagatttctgaagttcgagccgagatgtctattctgaccaagagcaacctggggaaagccacaaacccatcttcagggatgctggcattgcagctacgaggttatcggtattcatgaccccaagacttgcagtttggactacacaggcgctgtggcaggacttttcagcactaccagagcatagtgtcttcttctgcatgcctgcagcccaacgatccacggcagtggacc

SEQ ID NO: 492643 - DNA, 699 bp, Homo sapiens
cggctcgggcccgagttcggcccgatccagcagatccaagttttcaccagcatccagtccaacaacgtgctgcaggccctactgacccccatgatgttgctactcggtcgcatgacactgacctactgccgttaaaggcacatggacttcgtgatagccgactctctacagggtccacaggtggatactctctcggctgatactgtgactcgagcccgtaccctgcaccagatcatagcttaagttcatagacctgtcgacgctgtcgacggcgtcttgacttacacggcctacaaacgggcgcctgcactcatgggcttacaggtgcacgtggccattgcgtgacatgactgtgccctgagaggccccttgggcctcgtgttaggtgatgctcccaacagtgctttcagagtgagatacagtgacctttttggagccccacagacttacacatgtatcggaagtgtaactaccccatccaaattcaggctataaggtgcaccaagcaggcaggccctgcccctgggttaccttaaggaatgaggaagtgccttcgaagcaacttgaaccctcgctttggcgcatctcttaacctactgtttacgcagatattacagccgattacaggaccagttaccgtttctaactccagactgttatattagacttaatcgcctgggttttttcgccaccggtccg

SEQ ID NO: 492644 - DNA, 128 bp, Homo sapiens
gatgagctcggtccagtcggtctaccattcttataccttcaccactcaccactctatcaccatcactatcaccatttttatcaccattaccatcaactttaacatcaccaccatcatcaccaccaaca

SEQ ID NO: 492645 - DNA, 1094 bp, Homo sapiens
aacacgatgtacggcgttatcttctacatgagtttgcatacagcgcatggtggtaccgtgttcccgctatcatgctcctaacaagtctactacccaggtacgttggcgcagcaaagttaggctcgtcctatcgcggctgtgacttgtggccaggggagtcttaatggtgtgggccaacgcggtcgatctgagcaggcagtcagcacgcccctgtacaggtgtaccatgacaaaggacccgtgtgctagcagagtccccgtgtgtctcgttggtacgtggttgagaccgcctagagatgccactgccgtaagtagacagcccaggatcaaggagcctgtatcaattgaaacccttcgacaaaccgtaaggtttatgagcgtgccgttacatgtatgtatcacatggttagcaggcatcccgtggcatgactatgtctatgaacccagaaccaatgtcattgggaggcgactcacgtggatgggaatgccctttctacatgtaccagtgactccaagagatgatgcggatgtccagacatggcaatgacttggtaccatagtcggtatgcctatcgcgaggaaaagcactaacctagtcgtcagcgagtacgcattgtaatgcacgagtctatggcgctcgtaaagtacaggacccatggcgtcgcaggcgaatggaaagctgttcgtagaggcctgtgttgaccgggtagtcacgccttgtggggcggcaacggtattgccgcaaggaggtggctctcgggaatgcatagctgggatggtttctgcctcggccacatagagcggtgtacctgacagagaattgcgacgtcattgcaatatttcacattagcgggttgacccccccgaaaggaggttgtcggacgcacatctagaactttggttaagtactcgatctcagttcgaaaataaaccgcgactttgcaggttattcagaaaggcggctccttgatacagatttgcaattcgggcagggtttatgcggaacgcctttgggaaagttcgttcagtcgctcggggacacggggggctttcgaagctgaaaccgatccaagtcgcaaaggttgttaccttgtc

SEQ ID NO: 492646 - DNA, 129 bp, Homo sapiens
ctcgctggtggctgcactgcttgggtgtgacagagactgctggggttgatggatgactgctgggtctggacctgagtacgctggtgatgggtgtgttgcatgcttgttaccacacaatgcacagctgtc

SEQ ID NO: 492647 - DNA, 1541 bp, Homo sapiens
gggtgaagcacacaacgagttttccaaagcttcctttgggagtgggcctgcggtggaatggcttcccaagtacgctggacgtctcaccaaaggacaggtgcacagctcatctgccaagcccaacaggcatggctcacttcttcagttttgccagccccaaggttgtcagcatggtactcccatgtcagcccagcattccaactctgtctagtgtgcaaaaggcacagtgtgtcaacacagctggtctgtgaatcgcaatccatagaactccaaaacacagcacagttccgcatcacactgtggctgttctgcggggggcacaccggcatctcacctatgtaaaccacaacatcatccaggcatccagtttcactacagctgcccaaaacagcgtaggacaatcatcgcatgcatcatccatcacagcacagttccccacacatggcaggccgaaccacagcatccgcacagtggcaacaccagccggcgcaccaccaagcagcggagaatccacagtgcaacgcaagcgggcaccagagccttaagcatatgggacagactgccaacacagaccatgcgccgggtcactggaggaacagacagttcgttccttctcactttaaacgtggggatggcaccattacccacatctcgggctaccaacacgctcttacgcagccacaaggacccactcccactggtacgccaacaagcggtgaataagaacactcagcacaggggtaaccacagcgggggactcacactccatgcaaggagacaacattggagcaccaacggcaaatatccggacaagcgcgcttagcagacacagccgtacgttcgcaacaaaggacacagcccactactagagcgcccaacgttgccacaggaggaagaccgtcaccactggccagaggggacgacacaggcaccccgtgcagcgaacccagtacacacgagcgcacagcacctcacccacccgatacaccccacgggcacgaagaacacgccacgccaccggggccacctccgaccctcaacacagaggcccacagcccaccaccagcacgtcgctgccccagagccgaactgggggcccccatcgcgccacacgcacacgggacagccgcaacagcggagcgcgtaagggccgaatagccgcacacacttggagccaggcgggcagcgacgacaacaacaaccgggagaagcaacaagcgcactcgagagcacctcacacagcggaaccaaggccacgaactaacgcgaggacgcaccccgagccgacaacgctcgacaaccagccacaagacaaccacgacccacatgcggcaccgcaccccacccgcgcgccgccaaaaaagacgacgcgaggacaaacgggacacacacggaacgaaagaacaccggagacaacgaggaacaacagaaacgagacagcacagagctcagagccaagcacccgcgaccagccacaccccgaacacaccagcagacacccaaccccaccgacgcacccacaagcagcagcgcaccctcgc

SEQ ID NO: 492648 - DNA, 378 bp, Homo sapiens
gaggtcccagtgcccccaaccctccagcagcccaacccgacgacgaagaggatgaggaagagcttctgcttcttgcagccagagcttccaggccggccttgcaaccaagcgcccttaaattgtggttaagtcctcccggccggttaaccactttccaaacaatagggcatatcctccctccttctatataactaagagacccgagagcccgaagagattcagggcagacagaccctcaatagtgagcctcgcaggagaggcacaccaaacatctgttaactccctctccccaccctgtctcggggcgcagcgcacttccacaatttactaccatactcagagtccagctttacaggcgacgattacttctgctctcgt

SEQ ID NO: 492649 - DNA, 568 bp, Homo sapiens
ggaattcggcacgagatatatttccctttcttatggaggacaatatttatgcggctgagacgggtttgaaacaaaagaatatgcgcaatctatgcgaagagggcaaaataggtgcacatggaaaaccagtgatttttctccatcctaaagactgtggtggaggccttgcggaactggagcaagcttgatttatatttgcaagcaactgattttaatgacctggaaaagcctatcaaatactatcacaatgtactatgacattgagtccttgactgcttgcatcatgtacaagttcacagtttatgactgatttacagagcgatttgaatatatacctatgtcaatacatagatatgtgtattatttagattaaccaacatatttcgcaagttgaatttgaagaaaatattgattactaattacttagggcacattatttcatatagaacctaattattcctcttcttgagttagaacaagtttgagttactggactcgttttacaacggccttactgggtacctggcgttacccaacttagaacccttggaacacatcgccttttgtc

SEQ ID NO: 492650 - DNA, 163 bp, Homo sapiens
tgggagcaggcagggcccctgggagcctgggttttttggcccgttccatgggactcatccctccctcccagggctgttgtgaggtgttgtgggactgggtgtcctgcaaacgcccagctcggggcccagccaggggggggccccccataaacgctcccccata

SEQ ID NO: 492651 - DNA, 130 bp, Homo sapiens
agctcggtaccagccactgtactcagacacgggggcgtcatcccgggcctggtcctggtgaatcgggggagccactgtactcagacacgggggcgtcatcccgggcctggtcctggtgccctccacctcg

SEQ ID NO: 492652 - DNA, 515 bp, Homo sapiens
  misc_feature (16)..(16): n is a, c, g, or t
  misc_feature (33)..(33): n is a, c, g, or t
  misc_feature (48)..(48): n is a, c, g, or t
  misc_feature (67)..(67): n is a, c, g, or t
  misc_feature (207)..(207): n is a, c, g, or t
gggaccagggcactgngcttgttaggtggtacntcattggaaagggtngaaacttattaaaatattngcattattttaaggcaaggaaatgtttatccttaaaccaactcggtatcttaacttatacaaaaaggcttcatggatgtgaaattggcattccagaagaaaagtgatttttaaggaaataatttaacaattttctaaatnaaaatcaacaaattaatcaatatacattgtcctgcatccattaactactaagaaaacacatttacttctgtattgtgtctttgcttgagaacctgaagcaatctaacagcttcataatgttgctttccagataagatcagtcttgaaactattataaccaaattattatctctaagaaccaagttgttttatgttgaaacccaaaatttcagtctcgagaaaaggaattctgcctttaccaggaagaactatctgggattctgatggtagttgaatgtgttaggaataaacctctgctatgatacatt

SEQ ID NO: 492653 - DNA, 707 bp, Homo sapiens
  misc_feature (27)..(27): n is a, c, g, or t
  misc_feature (51)..(51): n is a, c, g, or t
tacctggaggctcaacggcagaagctncaccacaaaagcgaaatgggcacnccacagggagaaaactggttgtcctggatgtttgaaaagttggtcgttgtcatggtgtgttacttcatcctatctatcattaactccatggcacaaagttatgccaaactgaatccagcagcggttgaactcagagcgagacaaactacatcaagtagagaaagttttaaaactgcagacaattggcgtggatgggttctgcctataacatttgggcaggactccaagccgcggaaggcaccacttcccattttccaacctgtaatcaactcattaaacaagctcttcttgtcctgcaaagcagtttagtccaatacttgtgccacatgaacattacttttagcctttcttgtgctaaggtaaggtataccaccctcgatgcacatccaccttgtggtaacacttaggctggactgtgatcgtacaggcacagcaacaccttgcaaaaagatctgggccttctgtagttggcaccttttcaaaaggggccaacaatgaatacaaatatacgagaattccacagccgcgacaacaaaaaggttcctaaggtattgtcacatattgtcaagctccataagggcttgtcacacacatgacttgctgcagtatgccttaggtcatccaaactttattctacattatatcgaattgataca

SEQ ID NO: 492654 - DNA, 363 bp, Homo sapiens
  misc_feature (29)..(29): n is a, c, g, or t
  misc_feature (309)..(309): n is a, c, g, or t
  misc_feature (350)..(350): n is a, c, g, or t
atcctgggatgcggtgaggaactggccgnggtagttggagttgagatcctggaggaccagcgcggacagctgcgccgcggcggcgtccgccttgcgaccggtgtcccggacatgatccacctgcagattgaccaggatcgcggtcagcaccatggcgatcatcatggggatgatgatgaccatgagggcggcctgggtcatcaggccacggtcatcgcgccggagaccggccaggcggttacggattcgagacatcatcggtgcgttcaccccgttcagttggtgacggtcagaggttggaatactgcngcaaccccgtggtggagttgtgcatcagcagttggacgtanagtgactgcgtct

SEQ ID NO: 492655 - DNA, 197 bp, Homo sapiens
  misc_feature (21)..(21): n is a, c, g, or t
  misc_feature (71)..(71): n is a, c, g, or t
  misc_feature (90)..(90): n is a, c, g, or t
  misc_feature (117)..(117): n is a, c, g, or t
  misc_feature (122)..(122): n is a, c, g, or t
  misc_feature (125)..(125): n is a, c, g, or t
  misc_feature (172)..(173): n is a, c, g, or t
  misc_feature (178)..(179): n is a, c, g, or t
  misc_feature (195)..(195): n is a, c, g, or t
  misc_feature (197)..(197): n is a, c, g, or t
tgtttgatagatatgtttatnttccattaaccgagtatgatgcaaaatcattggtatatttttgctggtgnttataggtgtttagaaatntaatagtttcatatccagtatacaggnatcanatncttcaatttacagctgttttttttttctgatttatataatgggtttnntttcnnggtgcttattcctatngn

SEQ ID NO: 492656 - DNA, 289 bp, Homo sapiens
  misc_feature (235)..(235): n is a, c, g, or t
  misc_feature (276)..(276): n is a, c, g, or t
gccggaggcactgtcgaagacggtgaacttcaagggcaaccggatcgacatcggtggacatcgattcttctccaaatcgacacggtcatggagcggtggctcaacatccttcctccggaaaagaccggcggcgagacgttcaccttgaagcatcagggtaaatcgcgcccgttcgagggtgacgcggacggcgtcgatccggaaacgaccgacgacgtgatgctggaatactgcngcaaccccgtggtggagttgtgcatcagcagttggacgtanagtgactgcgtct

SEQ ID NO: 492657 - DNA, 146 bp, Homo sapiens
atctgattataagcgagtgacggtataaggagtgggatctgtgtcgcagtgttaaaaaaattccaccagatctaaaaactattgcagtcaaacagaaattttcagactacttgtggaatgtcactgcctcggggtatttcacaaga

SEQ ID NO: 492658 - DNA, 293 bp, Homo sapiens
  misc_feature (33)..(33): n is a, c, g, or t
cccaggaaacacgctagtaacatggaactaaanttcaccaatgaatacttttttttttaatttgaaacggagtctccctctgtcgcccaggctggattgcagtggccgcgatctcggctcactgcaagctctgcctcccgggttaatgccattctcctgcctcagcctcccgagtagctaagattataggcttcagccaacacacctcgcctggtgttacctgttttccctatttatttttctctgtagctgttcatacagaggcagacttcatagctgtttccctgtgttac

SEQ ID NO: 492659 - DNA, 810 bp, Homo sapiens
agcggggtgggaagctctgctctggctccggcaggcacaggcggctcgggaggtgcagctgccggctccagccccgggccccgcccgtccgacgcgcgcccgcgcctcccaattcccagatgccggggctggggctctaggctgccgcggcggactcaaaggatggagctgactgggcggcgaggcccagggacggtgccgggagatggctgcgccagagcaggtgggatcgcgacaagagaggcagcgtagagcctgagacttggcccgaaaccatggacaggtaccagggaaaacccgggagacaccgaaggacgagcacctgagcgacaacaggggaaggcagggtgcaccagggaacgcgaccgaacaagcgaacagtgaacataaggaagccggacaatgcacgttgagaagagcgaaagaagcaccggacgaatggagacacactcgcggcgcaaacgcgccgacgagagcaaggaacagaggatgacacgagcaaggagagaaacagcatagtatacaggctggaacatttatgtcgaaaggacaaagcgctagtaaggccataagaatccacatggtgaaacaaatcgagagaatgaaactgatggctactccacaagaccctacgacttgatcagcccacaccggtcaagacacttcacaaaagtattttcaaaagcaaagaaccaccgcgaatcacgagcacaataacagcacggaacaggcaacacgaccgcgtacacccaaataactcccacacaacacatgccagtaccacggcaccaaatcactcgtatgcaacgc

SEQ ID NO: 492660 - DNA, 554 bp, Homo sapiens
agctggtatctaaggatccatgagaccaggctgagatctgagatcgacagtcagaagcagtgcgcaactgcagggcgcattgctgatgctgagcaggtggggagatggccctcaaggatggcaagaacaagctggaaggctggaggatggcctggagaaaggcaaagaaggacctggccggctgctgaaggagtacaggagttgatgaattgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctaatggcagtggtcttggctttggaggtggcttcagttccagcagtggcagagccattgggggtggcctcagctctgttggaggcggcagttccaccatcaagtacagcaccacctcctcctccagcaggaagagctataagcactaaagtgcg

SEQ ID NO: 492661 - DNA, 385 bp, Homo sapiens
taaaatatttaagagctcaaggggatacgggcggaagggggaaaatctcactactacttttaatcctaagctcagggtgtttcagatatctatttcacacccaagaccatgaaccccatcatagtattggtgcctcctatgaaacctatgacatgtcagtcagcctggctgccggcggggtgcggtatataagtccattacatatccctaatagctggatggaaaccctgaaaatgacatgaagtccctagagaaattgggccatgcgggtgcttctcaccaggttggaccttttacaaacaaaatctcggttgtccaagggcgacttacagagtgtccattagggtggccagagatgttagggggactacaatttcaatcccct

SEQ ID NO: 492662 - DNA, 511 bp, Homo sapiens
gtagtaagaacacttaacatgaaatctaccctcctgacaaatcttttgttgtacaatactgtaatattaactatagggacagtgttttacagcagacctgtagaacttaattagcttgtgtaactgaaactttatacccactgaatagcaactctttgtttccccctcttcccagcccctggcaaccaccatgctacttgatgcatctgtgtgtttgagtattttatatacctcatataagtggtatcatgcattatttgtcctgtgactggctttcacttagcatagtgtttcagggttcatccatgttgtcacatgtggcaggatttccttttttaaaacttaatattccattgaatgtgtatactatattttctaactaattcatccggtgatggaccattaggttgtttccacattttgggccttgtgaattaatgcttccaaggaacgtaggaatgaaaaaaccccctcaagaaaccggaattaggtttttttggttaaaaattca

SEQ ID NO: 492663 - DNA, 950 bp, Homo sapiens
ggttatggtgggtccgtgtctcaagtccacccaaggtctcctcgtatcgcctggtaaaaaggcactcggacctgaaacaggtgaggagaatgagtaccttccaagacagcagtggcagctccagataatagagaaaccctttgaggtgtagtgatgcactggaaaggagtctgggagcatgactatgggtggagtgctccggggagcctgcaccgagtctgaattgcaagataatcttgcgacgagagtccaggagctccagcattcacgtgttgcatatgccgtcacctgggaagtgtcttgagaagccgcgaggtatagtgctgtatggaacaggtgcgtgcttattatatcaggttgcacgaagtacgacactgttcatcagcaggcctcagcatcctcgtactcgtttatcggggccagattcgacatgggtctgtatcgtcatcaactggtggtgtacccgagaagacaaagtatctatgacctaatgctaagatctctgtgatgcctgggagatggactgggcagattgtgaccgccttaatggcctgacagattcagagctgtagctgctcttttgaagcctgacacgattactactgcgtgcaggacatacaccaacagtttgggtctcatcacccacgcattgcaaattcactgtcgcacttgatggctcagtgctaagattcgcgcgcaattattggagtcctttctcttgacaaacgacgaggctgtatctccaatgccagaatcaagaaagtcagggctcccgagaatgtagctcgccctttgcagcgaactggttccttggatggcaaaccctgcacgggtatcagctccttacgtaccatgcacgaccccgagattgtgtcccaaagcatacttgcaaacggcggattttcaaggcggcatctcactatgcgggcaccgcggctacaatgtctcaa

SEQ ID NO: 492664 - DNA, 550 bp, Homo sapiens
  misc_feature (36)..(36): n is a, c, g, or t
  misc_feature (182)..(182): n is a, c, g, or t
  misc_feature (234)..(234): n is a, c, g, or t
  misc_feature (262)..(262): n is a, c, g, or t
  misc_feature (308)..(308): n is a, c, g, or t
  misc_feature (387)..(387): n is a, c, g, or t
  misc_feature (431)..(431): n is a, c, g, or t
  misc_feature (434)..(434): n is a, c, g, or t
  misc_feature (463)..(463): n is a, c, g, or t
  misc_feature (507)..(507): n is a, c, g, or t
tcccagccagtgaggttagcatggttaggagtccanatgtgtgcaagatgcttgtgtggaggctcatgtatgcatgtgtgtatatgcaaagctgcacatgacaatgtgcatgccagtccagagttagatgtacctatgcagttgccctcaagcgaagggtcatatttggaaacaaggatggntctaaacatgtaagcgtgcatgtgggcatgtatgtatctggggcctaaggangtggggaagtgggtgttggggtaagggntgggcttcagggcatttgcagaaggaggaatgggtgggagggaaanatgggcagagcaaaaaaaagaaatgaaagccaggcaggaaagtggaagaacaggggaaggctcatgtaatggattaaanctcacacaaagattaaatttccttgattcctgagagtttttctnttngatttttaccccctcagtctatcactgcnagagaaagaggtagaaaagacaaacagaccacaaaagacaaganccagacatatagacagacgcacctgttgcatgtgcatgagcca

SEQ ID NO: 492665 - DNA, 341 bp, Homo sapiens
gtggtgcatctcagctcagtgaacctccactccctggctcgagtctctcctgctccaccttctgagcagctgggattacaggcacataccaccatgcctggctaatttttgtattttagcagagacgaggtttgggcatgtcggccaggccagtctcttactcttgacctcaaatggtttgcctcggcctcccaaagtactgggattacaggcgtgagccactgtgcccgaacttattaaatacattctttataaagacacatacatgcatatgtcagtaggtgcattatgcacaatagcaaagagatggaatcaagctaaatgcccatcagtactagact

SEQ ID NO: 492666 - DNA, 425 bp, Homo sapiens
tcatggtggccagacagaatcgccggaggactttccaaggcttcccgttggcgaagaccacaccggtcccctggaagatggcgtccgtgatggcaataggccccctgccagagaaagcctctgcctgctccaccagggcctcccgcaccgtctggtagccacacaggatgaccacaggccgggagcccaggtacaccgtgaagatgtccccgtgtttctcccgcagccgctggaaggagtggagaaagcccttgtgatggatctgcaggatgttccccaggaggggcagaggccaaggtccgggcggaaggtggcccggggaggcggggcggccccaggcccagagcagcaggaggccagtgaggcccaggaggagcgagaaggcggacagcaccatggtcccctctctgcctgccgtgagctcg

SEQ ID NO: 492667 - DNA, 491 bp, Homo sapiens
gactatacaggatcccccacgagcacagcgctgcttatagagaaagataaggctatctaagagtctactgtccaagggatttatcgtggggagaaacgcatggaaaacatcacaacactacctctataaattggactcatggcaggattccaaggaattcagtatgccatcaacattaagcaatataatcagagctaaactcaacaaaatttttctttcagcgataatcctaatttttggtaaattatcgtggaacctgcccccaataattcaaagtgagtccttttctattttccctaagtgtcggctggtctgagaaataaagggaaagagtacaaaagagagaaattttaaagctgggtgtctggggagacatcacatgcccaagccgcaaaaccagcaagtttttattagtgattttcaaaaggggagggagtgtacgaatatggtatgagtcacagagatcacatgcttcacaaggtaataaaata

SEQ ID NO: 492668 - DNA, 226 bp, Homo sapiens
gaatggcgtgacctggtttaacggcaacctccgcctccggggttaaagggagtctcctgcctaatcctccggagtggctgggattacaggcttgccccaccacaccaagttagttttgaatttttaatagagatggggtttctcgatgttggtcaggccgacctcgatctcttgacctaaggtgatccgcccgcctggccctcccaaagtgttggggttacaggca

SEQ ID NO: 492669 - DNA, 289 bp, Homo sapiens
gtacataccgcactgtggatggcctttaagcaacgtttataggcatactgtaccccttgctatgttagagtggtgccactgaagtttccccttgctatgtctagagtggtggacctgaagtttggacacttgtttgtccgttagttagtactgagatggagtcttgctctgtcgccaggctggagtgtagcgacgcgatcttggctcactgcaacctctgacttctgggttctagcaattctcctgcctcagcctccagaatagctgggacttcaaggtgggctacgta

SEQ ID NO: 492670 - DNA, 135 bp, Homo sapiens
acagagatacataatgtgcatgatgcaaaggatcggcagaaagcgcaagacgtatagtacgtacaagtcgatacaagtcacgactcacctacggaatgacaggactgcgacggatggacaacacgattctatcat

SEQ ID NO: 492671 - DNA, 924 bp, Homo sapiens
gaaagcaactcgacctccgtccgctctgcttgttagagctcttgaagaagggcagcctcctgcctactatccgccagactgaacggatgagatgtgaaatggctgtggcttctggtccacctataacagtacaggtgtcctcctggaggtaggcggggtccttctcctatgatacatggatggcggagatacggcgaacacccagatactgttgcagatctcctcctgctgcatcaggtgcatccaccacatctttcccggtttaagaagctggtcctacaggagttcaccaaacctctcgcttccttcactactgttgccatttgagcctccagttaaagccttgatgccaacgccctgtatgatgatctgtgtcccaagactaggcattggtcatgatgccttgcgcctgacgaggacatcctctgtctccggatgtctccagtactgaaagtgtagctccttgctgagtcaacccgacaactgtgttccctatgtgaggctgtgggtgcgatccacatacttgtgactgtttccactggacaggagtgaaatattcattgatctctcaattctatcaaagaagagtgttccgatccaggggtagcagatgcttctgttggatcaaaggctcccaggacgtatgatttcgccaggggaggaattatgagtcttggctccagaaggaatggaataattgcgtgtggtcttaacccagtggtgggagagctcggaattttgccaccgtgacgccgcgacgagttacttggcccatccctttgaaggagaccggaatgacttagtcattacctgaaagttgtggactggtggctctgccgattcagggggcccatcgtccgttttgtgacacccgatgctgttctccggccatgcctggtccctcgcagggacttcttccgaaag

SEQ ID NO: 492672 - DNA, 87 bp, Homo sapiens
  misc_feature (25)..(25): n is a, c, g, or t
  misc_feature (38)..(38): n is a, c, g, or t
gaatcctggtcccggcgtgcacttntaaaggacttcanatgtggtggagaagacagcacctgccgtggtctatatcgagatcctgga

SEQ ID NO: 492673 - DNA, 557 bp, Homo sapiens
gactctagctccaaagatcgtcagcctcgcgagtagctgagactacaggcatgcaacagctgcacccagtgctgaaagtgctgatcattatgtgtttatcataccggcctgtttatgatttacaatgatgtgtggattttacccatctgtttatgactacagccctataactggacacagccttctctctataacatctgagcctctaataaatgccactatacttaacacagggaaaatcagtgcatacaatctcaaataattaaccgaatcaacacagactttctagtgacttatcttcataaaggccctagctcatggaagcaatgtagcgtagagcattctaaaatattccggactttttacactgaaaattaaacacttcattcaaaaaaagcgattattattatttttagtccaaggataaagtatcttaagaatatggctggacgtgccaatcaatatgttacaattttatttgaaacatatatttatatcgctaaatgcagggtgtacctggcataattgggctataattagtccctaggaaatttact

SEQ ID NO: 492674 - DNA, 492 bp, Homo sapiens
ggtcggcggagccgctcgggcattggagcaagactaagactgcccggcgctgacagacagacagacagacagacagaagactgaccatggcagacgagccgaaacccatcagtccgtttaaggatgcctggctggcggcttcggcggcatgtgcctggtgtttgtggggttccccctggacacggtcaaggtccgactgcagacacaaccaccaagtttgtctggacagccacctatgtactctgggaccttggactgtctccggaagactcttatgagagagggcatcacagggctgtatcggggcatggctgcgcccatcattggagtcacccctatgttcgccgtgtgcttctttgggtttggtctggggaagaaactacagcagaaatcttcagaggatgaacttagctacccacagctgtttacagctgggatgttctctggtgtgttcacccacaggaatcatgacccctggagaacggatcaaat

SEQ ID NO: 492675 - DNA, 1016 bp, Homo sapiens
  misc_feature (1013)..(1014): n is a, c, g, or t
gctgggaattgtccgaatctgccttctgcatatcttgagtccagagtgggatgcccaggaacagcgtggtgcatgcactgattcgtgcgtaacatatgcgtaaatactgtgactcacgaacattagaatggtaagctttagcgacaatacagcgtggtctactgtaacttgtaatactgatagcacacatttggataagttgaacttgctgttcggtagaattgcattttcacttacagtgtattcacgggtgggtgcccaggcacttagcacattaggagtcgaaccagtgtgaaatcaattatgatagtgagttgccgtgccaggtataatggtgcgcgcagataaatagtgttgttgagaatcatgactctcggctcctgatcacttgtccatattcgctacttcagtcatctggcctcatttcctgcatacatcgtgaggtgaccaccctggttttacggaccgtcagtgttcctgcttgtttggtggttgaccgtgacctgagatgttatacgacttgtgtgtccaatcaccataaagccaagttcttagattattgtgcccatcgcctttcaggataacacggatgtttgttaccctactagaaacgtctattggaaagggggtgtagagggcgttgtgttgttggaaacctttaaacacttggtgtttcgcgcagtggcgatcgtgggacaggcgtgcaggagggtcaactgggtcccttggtgcaacaatgagtgttgggctaaccatgttttttggcgtccccatgaaaggatttcgacgactgggagggagtccttagtggacccatgtggcgcctcacttctggcgcttgaacgaatggcgttaactaatcggggccggaaaaatttggacacgaatcaggcaacaggttatgggcagtatccacaactcaatggggcagaaccacatattttgacacagtgggacaacagcttgcgtgatgcaacagactaccgggaccctctgccctattacacctcggnngg

SEQ ID NO: 492676 - DNA, 365 bp, Homo sapiens
  misc_feature (122)..(122): n is a, c, g, or t
ggtccctcccccaatggcacaacaatttgacatgagatttgggtggggacacagagcctaaccatatcattaggctaagcaatgatgttcagtaggctaggtacgttaactgcattttgacnttaggatgttttcaacatatagtgggtttattgggatgtaaccacattgtaagacaagaagtaagtgtagtggtagtaataataataaatatctaagactaacactgagattctattctatctagtagttctcaggccctgatgtgcaaatgaatcacctaagatgttaatttaaaatgcatctatcccacccaattccccagtttctgatcattagataggagatccatcaaagtgactttt

SEQ ID NO: 492677 - DNA, 645 bp, Homo sapiens
  misc_feature (417)..(417): n is a, c, g, or t
  misc_feature (563)..(563): n is a, c, g, or t
  misc_feature (578)..(578): n is a, c, g, or t
  misc_feature (600)..(600): n is a, c, g, or t
  misc_feature (602)..(602): n is a, c, g, or t
  misc_feature (620)..(620): n is a, c, g, or t
cttacacctttttttttcccccctcctttcaaaaactcatccacctatcattttgctccttttatttacattttcttactcttctcctgctataatttcacttataataacatcactcctttgctttaaatatctatatctttaatattttcctcgttccatctattttctatttaattttccacttcatttagcataacacatttacctcatttaacatataaatctatttctaaaaacttctgtctatatgtatttttttgttaaaaaattctacactttgttcttaacatgtcataattttaaaaaaactttacttatacattcgcttaaaattcattagctagtgtctcctcctttcctaatactttagctttaaactagtaaactccacctttttcctgtactagtaaatanttttacaatatttaaactacctactaaatactatttattaaacccttacttccatatttccttaaattaaaacaaaaaacacctttaacttatataccccagttctttcttaatctatatcttacactaactcaacttcttatacnatctttttttcttcnccgcccggttcacaaccaaagncngttcagtcatcattcaancccggcccctggtccaattgacata

SEQ ID NO: 492678 - DNA, 807 bp, Homo sapiens
  misc_feature (142)..(142): n is a, c, g, or t
  misc_feature (227)..(227): n is a, c, g, or t
  misc_feature (249)..(249): n is a, c, g, or t
  misc_feature (256)..(256): n is a, c, g, or t
  misc_feature (261)..(261): n is a, c, g, or t
  misc_feature (278)..(279): n is a, c, g, or t
  misc_feature (337)..(338): n is a, c, g, or t
  misc_feature (354)..(354): n is a, c, g, or t
  misc_feature (362)..(363): n is a, c, g, or t
  misc_feature (405)..(405): n is a, c, g, or t
  misc_feature (418)..(418): n is a, c, g, or t
  misc_feature (456)..(456): n is a, c, g, or t
  misc_feature (458)..(458): n is a, c, g, or t
  misc_feature (471)..(471): n is a, c, g, or t
aaaagatgccaactctgttacctcgtctttgagaaaagccaacttagacaagaggctgcttgaactctttccagttaacagacagagtgtggatcattatgctaaatacttcactgacgcaggtcttaaggagctttccganttcctccgagtccagcagtccctgggcaccaggaaggaactgcagaaggagctccaggagcgtctttctcaggaatgcccgatcnaggaggtggtgctttatgtcanagaaganatgangaggaatgatcttccannaaacagcagtgattggtcttctgtggacatgtataatgaacgctgttgagtggaacanngaaggaagaacttgtngcagagcnnggctctgaagcacctgaagcaatatgctcccctgctggccgngttcagctcccanggccagtcagagctgatcctcctccagaaggttcaggnantactgctacgacnaacatccatttcagtgaaaggccgtttcagaagattgtggtgtctcttttataagagctgatgttctgagcgaagaaggcaaatacgtgaaatggtataaggaagcacatgttgctagccggcaagcagtgttttgcgttgaccagatgaagaaatttgttgaggtggttagcaaaatgcagaagaagaatccgaagtcggaaggtgatggaaccattatagatggctcaagcaagcacaatagcttaggttatcacagcacacttttttgattggtgaatgctgaaccatttgagaagagaaagttggattcgtgttgttcgcaaaggaaagtaa

SEQ ID NO: 492679 - DNA, 574 bp, Homo sapiens
  misc_feature (41)..(41): n is a, c, g, or t
  misc_feature (508)..(508): n is a, c, g, or t
  misc_feature (522)..(522): n is a, c, g, or t
  misc_feature (553)..(553): n is a, c, g, or t
  misc_feature (566)..(566): n is a, c, g, or t
gggattacctcactaaagggacaacgctggagttctacgtntgaggatgaagtccgaagaaaaacgggctgaagactcttcgcacgaacaccggcatgcctcaaacccagaaggagacagcgacacaaaacaagcctcagtacccaaatgccttctccatgtaaactttggacgtaaactttatgcttcagggggcctcccatcggctgtgctctccggtcttctcatcttcctggagttaagggatggctcaggtggacgcaacatcaggtaaaacctggtgatagaacgcgaggagttcctccatagccctggaggttgagttcaaatcctctgtctcaagtgggttggcaatcttggcttggaaattcccccttcttttggaaacccatttaaagcagttcagagtcagcgcctgcagcctgagcggcagttcccttctccactgtgcaggtgggtgttaagtgcagaagggttgccaccggtcttgggcgtagccagcagctcncgggaggcccctgnaggtgggacgtcttggggcaccgtgggcggnaaggagcaagcangggcgtcg

SEQ ID NO: 492680 - DNA, 1122 bp, Homo sapiens
ctggacgcgttgtggcggcggtggcggtgcaggaggccggtgcaggggtgcggagggaccgacttggacgcacgggcgggcgtgccggtgagccatggagcgcgtgccctggggccctggggtgcgctgggcccgagggtgtggcttcccatcgggcacgacatggcagacctgtgcgttgcgaggctccctggtggctcggcttggaccgcgatggggctggtgccctggcctcctaacggggctgctgtctgtgggcggtagctgggcgggagcagcttctaccatccatgctcccgagaacctcgtgagcaacctcgcctacactaatacaccatgccctggctcatggtcgtgtcacaatccagttccgtctgctcgagaggagccaccgggaatggacggtacactggccgcatgaaccccgccgcccactgccagtgaacttgcgcgcccgggctcggcctgggaggctgaagccgtctttggttgtgtggcgtcctttcctggcctggtcggcggcccctgtgccctcgcggtcccggggtattcgtccgttgccccgtgctccgtccttgcgctttgcgcggcctggtgagtggtctggcctacctacgccttgcttgtggacaggaaggacaccgtatcccactgatcgctgcctgaacttgcggtgacacaaatgcgagcggcagtgccctccgtcggggcatctgcatgacgaagcccctacgtcgggtgagggcaccccgtggctgtcatgagaaacgcttgccatgcgtgaacggggacactgtcacggatacaatcccacctcccccctccagtaccgaaacactctcaaaacctcactcgaatcgtcaccatcccttaccaaaacataccgccccacgctcacaaaaccatctccaccccctaccactttcttgcttcaaccatccagtaccctatgctgaccaaaaaaccacccacttcctccatcaactacaaaacgaccaaacttccatacaccgcatcctgcgccccatgacatgtacacccttacacatacagtgcttccctccctcaaaccctacccacgtcacaacccatcgtacctacccattacatacaactcaactc

SEQ ID NO: 492681 - DNA, 168 bp, Homo sapiens
  misc_feature (27)..(27): n is a, c, g, or t
  misc_feature (46)..(46): n is a, c, g, or t
  misc_feature (132)..(132): n is a, c, g, or t
atttttttcagcctgcttctctctgtngttcagattaggtaatttnattcttctgtctcgaagctcactgattctttattctgtctaatctgttctgctgttgagcccatttattcctgattttaatatttnagttattgtatgttttatttctaaaatttccattca

SEQ ID NO: 492682 - DNA, 85 bp, Homo sapiens
  misc_feature (29)..(29): n is a, c, g, or t
  misc_feature (47)..(47): n is a, c, g, or t
catactacatagctgctcgaatatcaagncttcaaccgatgtacggnggacatgaaaacattctcctccgcataagcctgcgtca

SEQ ID NO: 492683 - DNA, 380 bp, Homo sapiens
  misc_feature (120)..(120): n is a, c, g, or t
  misc_feature (126)..(126): n is a, c, g, or t
tggacccataccaaaacgcgcaggacacctgtcggcgatctacgccagcgcatgggcgaacaagccctgcaccgattcagtttcatgatctggactggggcaagatcgacccgtggagtntgagtngtatttcccccatgcctcccggtttctggacgcaatggggcgagtatctgacgccggcggtcggccgcatgatctggtcgggtaccgagactgcgcagatctgggccggggcaatggacggtgcagtccgcgccggacatcgcgcggcaatggaagcgctccaggcgttacttcaacctcggaggaacgcctgatgaagcggattatgatggttggagccatcgtcgtgagcgcagcgtgctggtggaagggag

SEQ ID NO: 492684 - DNA, 321 bp, Homo sapiens
ggtgcctttggaggcacctaatcttggatgtacacaacaccataatggacactacacttcctctgacattacaagaataaaaagaatgggggaatccttcatctgatgacaaacacaagaactacataaaacgttactgtccctatcaaaatattaaccctcagcattatccttcaattcacataacggcatatgacaacgatgaacgggtacctctgaaaggcattgtaagttattctgagaaactcaaggacgccatcgcggagcttgctaaggacacaggtcaagggcaatagaaccctaatatcattctagatattc

SEQ ID NO: 492685 - DNA, 969 bp, Homo sapiens
gctcaaagaggtttaccggctccaagatggatggcgaggccaccaggccccttgccccgggaccgcagcggccccctcccctcctcctctggcactccgtcctcctcctcccaggtcacgtggtaccctggcggcgtagcaaccgcatccccaatagagcgctctacatcacccagaaatggcaactggtgcatccgttcactacgcgaaccgtggcgagccacactgcagagacgatcgagatccaagactgccgagactaggctctgcaaccagaaacgggacatacaaggtgacttgcacgagctagacgggcgcgcgcgacctggcctgcagcctgacagccacgcacacccggccagccctgccggcctaccagctgcccagatgcggcaatgccccgttccactggcgggcagccacccttgtccacgagtcgcgggccccatcgcgcaccttccccccccttcgttcacattgacagcccaccgtcatacattcgcttaccaatagccacccagtggacacttgacaggcgagcaaggagatgctcgctagagggcgaaacggaacgaggggagaaaggcgcccacggccggtaactacaaattaaccgcgcggaagcacagacaataagagaacggaggccacttccatagaaccacagccaaataggaaaacaggcgaagcacacgaactacgaagacacactgcgacgatgtacaaaaggcataccggtaaccccgtgcaccattcgcgcccgattaagagacaagcaaagtgcaatccgcagatgcccgaagcaaaacgggagcaaccaaggctgaccaacctgatagcacgcagaccaccctaccactagccacacaacatcgaacagcaactgagaaactagaccataaaaggaagtcacgcagaacacaaagaaacacaaaacatcgaagtgacagcagcaccaacaaaaggaca

SEQ ID NO: 492686 - DNA, 391 bp, Homo sapiens
  misc_feature (262)..(262): n is a, c, g, or t
  misc_feature (356)..(356): n is a, c, g, or t
aagtttaacttaataaaaaattcactttattttaaagattagttcttctcaaataggactacattacgatctggcaccggtactgagacaatttcatctctttatgaggcacgttttgtttggtttatcaggatatattaattacaggaagaacagccaatgaagtgctaccaggtcaacagggcttgtggtccagtttataaactgctaaaagcgatggctgaaaatgaagtttctaatgagcttttcctcatagtagtanttttcttctccaataaaaagtaacatgaatattctctgtcaactcttagttgcttactggttgacccactaggagaggtgcgttacccaacacncttttctttattgtttgaatcttgtttgtcggttg

SEQ ID NO: 492687 - DNA, 115 bp, Homo sapiens
tgcctgaagcttacgcagccatgtgaactgtgagtctattatatctctttcctttataaattacctggtctcaggacagatcctttgatagcagtatgaacaatggactaattac

SEQ ID NO: 492688 - DNA, 149 bp, Homo sapiens
tccccagcactttgggcaggcgaggcgggcagatcactgaggtcaggagtttgagaccaacatgggccacatggcgaaaccccatctccactaaacaatacagaccttagctgtatttcgtccatgccatgctggctggtccccgtgct

SEQ ID NO: 492689 - DNA, 282 bp, Homo sapiens
  misc_feature (55)..(56): n is a, c, g, or t
aatggaatggaatggaatcaacacgattgcaatcgattggaatggaatggaattnncccgaataaaatggaatggaatggaatggaacggaacggaatggaatggaatggaacggaatggtatggaacggaacggaatggaatggaatggaatggaatggaatggaatggaatggaatggaatcaacgcgagtgtaggggaatggaatggaatggaatgcaatggaatggaatggaatggaatgcaaaggaatggaatcaacccgagtggaatagcatggaa

SEQ ID NO: 492690 - DNA, 173 bp, Homo sapiens
agactccccagattatctctggctgttgtaaagatttcccatgctgacatggacagcattacaaacagtatgcagcacacaaataaagaacctggaacccaggtatgtgcagagaaggagagaacccctggaggacgcagtagtccattctaacatctggtgtttcaagcccc

SEQ ID NO: 492691 - DNA, 150 bp, Homo sapiens
agaagagagactagttctctcttctctgcagtagcgcctcggtggcggtgtgcaggtttgcccgccgggtgttgttaagggagacagatgttggagggccacaagggtacttcgccacggattgaggcggcagccttagcttaaggttcg

SEQ ID NO: 492692 - DNA, 444 bp, Homo sapiens
  misc_feature (337)..(337): n is a, c, g, or t
tttgacagcatcgtcaacaccggggttccctacccccgcttcctgtgggccgaaaccatcggcttctttagaaggctgctttggaggaacccaaaccggagggtgggttctagcgaaaaaaatccaaaaaatgtgaaaaaaccgccctttttcaggattttggggtgggaagccctgttgggccggggcctcccccccccctttgggccccccctggccggccgccccgaggtcagcaatttttacggggggttccccgggggggccccccccttggggccgcccccggcgggggggccccttccaaccggggggcaggcaccctttttggattttnattttggggccgggggggggtagccccctcccctgccccggcccccgcccccgcccgaggggtttttgttttttaaaaggcctttggggtttgccgggcccctgcca

SEQ ID NO: 492693 - DNA, 125 bp, Homo sapiens
acctgcaaactttttttgtaaagaccagatagtaagtattttatgctttgtgagccatacagtttttgtgcaactagtcaactctcaactcaccgtggacagcatgtaaatggatgggagtggct

SEQ ID NO: 492694 - DNA, 418 bp, Homo sapiens
ggcccgtgccactaagaggcagctttggtggccaagtggcttgcattgttgttgctcctcaaagggcctgtgaagggctgggcaggtcgcaaagacctcttgtgaggggaagctagattaaagggggagggatcctggaggataaaggcccagcacgtgcgcctggactccacaggaccaacagaccgagcgggcggggccagctgggagtcaggccccccgggcttcacgcagggagcccaaatattgggaacaaaagcaggaaaagaagagtgagagcaggagggagggagggagcgaggaagcagaaattagggggtcttagatgaaaaaaaaaagaaagtagctttagggggaatgtgctgtggagtgtgaaattgcagcccatggtgctccatattgtaccagaagctcttcc

SEQ ID NO: 492695 - DNA, 145 bp, Homo sapiens
tgctaaggtgatctacaggatcttaggcgcttgtggaaatacttaagcgcctgcatcacggctgaggtgcaccccacataggtgtagtcaatcatgatgtccccgaagacctccgaggggttcagcagctccaacaagcgcctgg

SEQ ID NO: 492696 - DNA, 267 bp, Homo sapiens
aaaatatctctgtttggaagcccatttgactccaccattgaagactgaagaaatttgtggctttaaaaaatctggtgctagagaagtaatgcaggctttgattcaaacacgttggagtgcctgtctgttccaaatactctatgcctcctttttttgcttaaaatggcaggctctggatcctctgttctgctatattcagagcagttctactttcttcttttactgatcagattttacattttcttaaaagagagttctgttgacttt

SEQ ID NO: 492697 - DNA, 117 bp, Homo sapiens
ctcagccggaccgggcgcggaaaactagtgcgttagaagtcggatgcggtggtccacctgtaatcccagcactttgtgaggcccaggcaggcggatcacttgaggttaggagttcaa

SEQ ID NO: 492698 - DNA, 537 bp, Homo sapiens
ttttttcatcggttatatgatgaagatattgtacgagacagtggacatatggttaaatgtttagattctttttggtgatccgatttctccatattccgttgcatggagttacgacagagtttggctagttggaagactctaggaaaaatatgcacaatattcaagccgaacctagatagaggaaacgagttacctgtttctgggtgcttctttcagagagcattctcttgggcctttgggttgggaagccccttggtccaaaattaatggcaggatcgtcgattctagcccattaatttcctggggacaaccaatcaaaaagggcctgtatgatcctccatgaacaggcggggaattccttggggttcgcaaggttggttatccccgccacaccaaggtaaaatttccccgttcccaaaaaaacacccaacgagcacaaacattcaccaaggcaattttaaaccctcctgtttcctgggttcctttcttccaccaaaggttcttcttaccaggctttttcatggttcaaaccggttg

SEQ ID NO: 492699 - DNA, 494 bp, Homo sapiens
  misc_feature (153)..(153): n is a, c, g, or t
  misc_feature (354)..(354): n is a, c, g, or t
gaaactatcttgctgagaaatcacaactctttcaaactatacatttggactctggggcttgcagcagtaggcatcacttacggcacacctacttcagaaaccagcagggtattacttcatattaaatttattcttgggtattcagtggccagngagagatgtggctcacaccgtgttaatccttagcacacttggggaaggccgagggtgggctcgactcaccgtgaggctcaggagtttcgacccagcctgggccaaccggggtgtgaaccccattcttctactaaacaacacaaaatttagctcggggcatgtgggggcgcatgtgccttattaattccaaggctacttggngagaggcgtgaggttgtgccagttaagcgtgaagaatgtggtgcccatgtgccactctccgagccgtggccaaacaagaggagtgtgcaacactccaatctcaaaaaaaaaacaaaagagggggttccttctaaaagccg

SEQ ID NO: 492700 - DNA, 346 bp, Homo sapiens
  misc_feature (154)..(154): n is a, c, g, or t
  misc_feature (276)..(276): n is a, c, g, or t
  misc_feature (296)..(296): n is a, c, g, or t
  misc_feature (301)..(301): n is a, c, g, or t
  misc_feature (327)..(327): n is a, c, g, or t
ccagtacgaccttccctacaaggggctgcccatcctggacagcactcccggccaccctgggtgttgagacggagttggctctgtcgcgcaggctggagtgcggtggcgcgatctcggctcactgcaacctccgcctcccgggttcacgccattntcctgcctcagcctcccaggtagctgggactacaggcgcccgccaccacgactggctaatttttgtatttttagtagagacagggttcaccatgttggccaggatggtcttgatcccttganctcgtgatccgcctgccttngcctnccaaagtgctgggatgacaaggtgtnagccaccggggccggcaat

SEQ ID NO: 492701 - DNA, 130 bp, Homo sapiens
aaaaccatggcattagactgcactaaattaacaagcatgttagttgctggtagaggttttggaggttgcagtgagccaagatcgcgccactgcactccagcctgggcgacagagtgagattccatctcca

SEQ ID NO: 492702 - DNA, 892 bp, Homo sapiens
tcccaggagctgtgcgctcggcgtcgcggtgtgggtccggcgggcgcggttcggcgggcggcggccgtgcagacgagtctgcggagacggagtttcgtcatgttggccaggcccagtttgagatctttgaagatatcctcaacgtgaggctctgctgccatgaaggtgacgattaagtgctggaacggcgtggccacttggctctgggtggccaacgatgagaactggtggcatcctgctcggatggcatttagacggatgctggcctgactgcaaggtgccacggcagacagacttgccctgcttggtgtggggccagtggttcccagctgcattccacatgcattgcatcgctctaagtggctgcacgcacagtgaggtgcagcagcagctgcccctagtggtgccgacagggaatggaaagttcaaaggagtgatggcccgatcctggtctcatcgctaggaggtggcagtcctgatgactccttcctcatgctgtggcgccgatggctgctaggggacagcgccacctgagactagcaacaaggttggataaacaagggctggagctggggttcggtctattgccatcactatgttgacgagttttatcgcaataaggtgaaaagatcaattaaaagctatctcaaagtcttggagtcaagtaaattgataaccatgtagagggattgttattccgaggattgcagagcaaagactagggcgaactgtcgaaattggggtcccttgttgccactaaagtgtggttacccttgagacccaaggtattacgtgggctgcaaagagttggccagaatttgggcaggttgtccccaatattcggtgggagcgatcatagaattcagaataaggctggcttcacctggcatag

SEQ ID NO: 492703 - DNA, 307 bp, Homo sapiens
cctctacgagcgcatctcacatagtatagtaataaaataaaataaaaaattatccaacaggccaggtgcaatcgctcacgtccgttatcccaaagcgctgggattacaggcgtgagccattacacctggccagaagtcagtaagttttacgttcttggatggtagtactagaagtgtttagaaggatttaaaacatgtctgggatgcagtggaggcgtagaaggccattgtgggaagctccacagagtcctgccagaggcggattgctggcgctcgttagtagaagggtacccgacgctcgaatttc

SEQ ID NO: 492704 - DNA, 262 bp, Homo sapiens
agacttcatgtcgtggtcccagtccttcagccgttcgagtcttcccagtctaaatacaatacgtgtgactgaggaatcttttgaaatgatcccacattgtgatgcatgcctgtaatcccagctgcttgggaggctgagggagagttgcttgaacccaggaggcggaggttgctgtgaccaggatcaaaccactgcactccagcctgggtgacagagcaagactctgtttcaaaaaacaacaaaaataacacagtgacctaag

SEQ ID NO: 492705 - DNA, 785 bp, Homo sapiens
  misc_feature (1)..(1): n is a, c, g, or t
  misc_feature (141)..(141): n is a, c, g, or t
  misc_feature (145)..(145): n is a, c, g, or t
  misc_feature (151)..(151): n is a, c, g, or t
  misc_feature (157)..(159): n is a, c, g, or t
  misc_feature (161)..(164): n is a, c, g, or t
  misc_feature (172)..(172): n is a, c, g, or t
  misc_feature (174)..(174): n is a, c, g, or t
  misc_feature (180)..(180): n is a, c, g, or t
  misc_feature (186)..(186): n is a, c, g, or t
  misc_feature (191)..(191): n is a, c, g, or t
  misc_feature (193)..(193): n is a, c, g, or t
  misc_feature (199)..(199): n is a, c, g, or t
  misc_feature (203)..(204): n is a, c, g, or t
  misc_feature (208)..(208): n is a, c, g, or t
  misc_feature (214)..(214): n is a, c, g, or t
  misc_feature (217)..(217): n is a, c, g, or t
  misc_feature (223)..(223): n is a, c, g, or t
  misc_feature (251)..(251): n is a, c, g, or t
  misc_feature (323)..(323): n is a, c, g, or t
  misc_feature (337)..(337): n is a, c, g, or t
  misc_feature (391)..(391): n is a, c, g, or t
  misc_feature (417)..(417): n is a, c, g, or t
  misc_feature (423)..(423): n is a, c, g, or t
  misc_feature (428)..(428): n is a, c, g, or t
  misc_feature (436)..(436): n is a, c, g, or t
  misc_feature (453)..(453): n is a, c, g, or t
  misc_feature (471)..(471): n is a, c, g, or t
  misc_feature (483)..(483): n is a, c, g, or t
  misc_feature (488)..(488): n is a, c, g, or t
  misc_feature (527)..(527): n is a, c, g, or t
  misc_feature (562)..(562): n is a, c, g, or t
  misc_feature (593)..(593): n is a, c, g, or t
  misc_feature (603)..(603): n is a, c, g, or t
  misc_feature (617)..(617): n is a, c, g, or t
  misc_feature (713)..(713): n is a, c, g, or t
  misc_feature (759)..(759): n is a, c, g, or t
naaaaagggaaaaaaatggatggtccattcgctttattgggtgcgtgtagtgttgttatgaaatctcctaaggcactggggggcacgtttgacactcatgaggtcagaacaggtctggtgggcgggggggggggggtcccngggnggtgantacccnnngnnnncccccccncnaaaagngaaaanggggngnggggcntggnnggcnagattntgntccccntggtccccccggggaaccccccaccagnggcctcggccccccgcggcggagcgcggggggctggcgggcctggccccctccctttgcccgttcggcctgntttggggtgtcttntggcccctcttcccacctgccacctgtggttgggggtgttttttaaaaaaaggngggggggggggttcgggggggtgggnggtggnttccnggggcccnggggccccccggctggntggggggggggctttttntccggggggggnggggnttggggggggcgggggggcctgggcccctgggggccttnttctttaattaattaattggctccatttttaattnggggtggggggctgggtcgggggcgggggtnttgtgcccgnggctggtgggggcngggtcgggcccgggtggttgggggggggtgggggggccggggggggggggggggggtgggttggctctcggcgggcgcggtcctggtgcggtggcnctgctggtcactgagctgtgggccctgcttggcgcctgtaaccgcnggtccgccgtgtccaacgactcggac

SEQ ID NO: 492706 - DNA, 820 bp, Homo sapiens
gttatataggtactgttcatcttattacatcgccgacctaacttccccggtgttggcccttgtaacagtcgcctgccatggctccctccggtaatcccctgttctcggcttgtccccccgggcttttattttgaattaaatcttcagtgccctgcaagttctcgtctgttgctgtgcaaacgtgtttaatgggcccccgcagagcattttatcgtgctcccaaaggttttttaccagcgcatagggcgttttcgcccctcgctaatatggggcccccgctgcgcccaagttttgatttacatgcccagagtgcgaatacacacatttctgggcaatagatgagtaaacaccgtcgcatactttagtgggcaaaaacaaggtcgcccggaaggttgcttttcttaagcatgcgcgtctcccaagctgatacgtctagcagattttgtcttgtcaaaataaggatatatgatggcttcttggtgatacacaaaatgtggaggaatgtgttgaggagcaccccttgtagcactggtgtataaaagtgttttgtgaaccctaagttcacaaatgttagatggggttgtaaatggcgctatgcacgtgacccccgcgtgtggggcaccacctggttgttcccgccaagatattgccgcgcgaggcgatggttcgtcgctgagtattttttccctggtgttacatgtacacaatacgggttggtccacacattgtgagcaattaggtgctctcgcatttccaccccgggggtcccccccgtacaacaggggccccaaaaaaaaaaccccccccaacacacaaaaca

SEQ ID NO: 492707 - DNA, 125 bp, Homo sapiens
cattttttttgcagcctggggggctatggggactttgtggccgcccatcctacagttggaaatccatccaaaggccatgttccaataaacaggaggttgggtatttggtcccgacctttttttta

SEQ ID NO: 492708 - DNA, 685 bp, Homo sapiens
  misc_feature (1)..(1): n is a, c, g, or t
  misc_feature (141)..(141): n is a, c, g, or t
  misc_feature (145)..(145): n is a, c, g, or t
  misc_feature (151)..(151): n is a, c, g, or t
  misc_feature (157)..(159): n is a, c, g, or t
  misc_feature (161)..(164): n is a, c, g, or t
  misc_feature (172)..(172): n is a, c, g, or t
  misc_feature (174)..(174): n is a, c, g, or t
  misc_feature (180)..(180): n is a, c, g, or t
  misc_feature (186)..(186): n is a, c, g, or t
  misc_feature (191)..(191): n is a, c, g, or t
  misc_feature (193)..(193): n is a, c, g, or t
  misc_feature (199)..(199): n is a, c, g, or t
  misc_feature (203)..(204): n is a, c, g, or t
  misc_feature (208)..(208): n is a, c, g, or t
  misc_feature (214)..(214): n is a, c, g, or t
  misc_feature (217)..(217): n is a, c, g, or t
  misc_feature (223)..(223): n is a, c, g, or t
  misc_feature (298)..(298): n is a, c, g, or t
  misc_feature (301)..(301): n is a, c, g, or t
  misc_feature (312)..(312): n is a, c, g, or t
  misc_feature (338)..(338): n is a, c, g, or t
  misc_feature (344)..(344): n is a, c, g, or t
  misc_feature (356)..(356): n is a, c, g, or t
  misc_feature (368)..(368): n is a, c, g, or t
  misc_feature (374)..(375): n is a, c, g, or t
  misc_feature (381)..(381): n is a, c, g, or t
  misc_feature (409)..(409): n is a, c, g, or t
  misc_feature (420)..(420): n is a, c, g, or t
  misc_feature (423)..(423): n is a, c, g, or t
  misc_feature (425)..(425): n is a, c, g, or t
  misc_feature (439)..(439): n is a, c, g, or t
  misc_feature (443)..(443): n is a, c, g, or t
  misc_feature (453)..(453): n is a, c, g, or t
  misc_feature (466)..(466): n is a, c, g, or t
  misc_feature (468)..(469): n is a, c, g, or t
  misc_feature (478)..(478): n is a, c, g, or t
  misc_feature (516)..(516): n is a, c, g, or t
  misc_feature (547)..(547): n is a, c, g, or t
  misc_feature (567)..(567): n is a, c, g, or t
  misc_feature (578)..(578): n is a, c, g, or t
  misc_feature (584)..(584): n is a, c, g, or t
  misc_feature (586)..(586): n is a, c, g, or t
  misc_feature (596)..(596): n is a, c, g, or t
  misc_feature (603)..(603): n is a, c, g, or t
  misc_feature (607)..(607): n is a, c, g, or t
  misc_feature (662)..(662): n is a, c, g, or t
naaaaagggaaaaaaatggatggtccattcgctttattgggtgcgtgtagtgttgttatgaaatctcctaaggcactggggggcacgtttgacactcatgaggtcagaacaggtctggtgggcgggggggggggggtcccngggnggtgantacccnnngnnnncccccccncnaaaagngaaaanggggngnggggcntggnnggcnagattntgntccccntggtcaaaaaagggaaaccccaaaaaggggcttgggccaacgggggaaaagcgcgaggggttggaaggcttggcnacntccaattgccngaaaagcttgtttaagggtgtaattnggcccnttttaaaaattnaaaattgtggangggggnnaatttnaaaaaaaggggggggggggggttaaggngggtaaggggngantnaagggggcaagganaaanaaaaggggantggggaaagggtnanntttaaaggnggggaagggtttggggggggaaggggagcttgggcccntgggggaaattttaaaaaaaaaaaaaaaaanaaaaaaaaaaaaaaaagggnaaggggttaantaaggngngggggttttntgccggnggtnggaaggggcggggtaagggcggggtattggggggaagggggggaaaaaagggaanaggggaaagggagtgggagggtt

SEQ ID NO: 492709 - DNA, 81 bp, Homo sapiens
cccagccctctcctgcctggcctggcctgggacacctcctctctgccaggaggcaataaaagccagcgccgggaaaaaaaa

SEQ ID NO: 492710 - DNA, 150 bp, Homo sapiens
ccggacggagggccggtgaggtgcggggtctggtgatgcgagctgcgcctctcggaaagatttcgcgctgcccatccagggccctttaataagtaatcggtagtggataactttccaagcggcaggaggatttaggaaacgccaagagac

SEQ ID NO: 492711 - DNA, 149 bp, Homo sapiens
tcgcgtactgcttctctatgtgcagtgtagtatcaccctggacagtgagtgcatgctttttcggtgagggcagatcccagcacctatgaattaccatagagtaatgatgtaacagtgcaagatttttttttttaagtaacataattgtc

SEQ ID NO: 492712 - DNA, 248 bp, Homo sapiens
gcagtgcctcagatgcttcgatgtgttcctgtttctcccgagttgctcctgttctatagatacctttcgtgcttggaaaaacctgtgggcgcagtttattaaaatgcctgacaactgcacttccagtcacccgggccttgcatataaataacggagcatacagtgagcacatctagctgatgatgaatacacctttttttccctcttccccctaaaaatggtaaatctgatcatatctacatgcatca

SEQ ID NO: 492713 - DNA, 171 bp, Homo sapiens
atacacggtcgaggctatacaatgtgggttgcattccacttttcccagtgcgcccaggtcctgggatctctaggccaccgccgtgcgtgccgcaccctctgctcaccagggaggccagaccaggaaccctgcagctcgcagagcaagcacggtcccacaagccttggggag

SEQ ID NO: 492714 - DNA, 1363 bp, Homo sapiens
tctggggacagggtctcactctctcacccaggcgggagtgcaggggcgccatctgggctcactgtgcagccttcgaaccctcctgggaacttcagggtgactccttcattacattcagccttccgtgagtatagcctcagaactatagcacacaccacgcgggcccagcataattttttttttatttttttttttttatgtggggaaaagagagggggttggcgccagagggtcgcccaagaggcgggactctccaaacacccgggggccacaaggcaacacccacaccccacccaaagccttccaaaagaggcgggggaatcaggagggggagagcccaaggtgccccgcgggcccccattgtgtggcgccttaactatacacgcgggggagacaccaagcaacaaaagacagaaaccacaactcacaagtgcgccccctctagtgcgcgcaccacctggtgggcacaacggagcgaacaaagggggcttaaccaccctcggggcatcacccccattgtgggcacaacgccgagaccccacagaagaccattgagagggcgctcaaacacacctgtgcgacgaacggagagccccacaacagggggggagaacacaccaaaaacgcgagaccccgcgagggtaaaacctcgcagccaaacaagctagaggcggagggacgagggcgccaaaaaccaccgaccactcatccaggaggggagggaaaagagcccaacataaagaggcaatagggagcggccccacacagaatcggaggggaaggaacaccagcgaatgggaccacacacacacaggagaggcgcaccccacataacaaaaagacgcccccccggggaccacaaaaacaggggggaacaacacagaccgcggggcgcgagagagaaaaaaaaataggaagagcccaaagagaccaaccacgcccgcactcatagtgagagagcgcgcacagatccgcaacaaaatataacagccccgacggggagcacaaccccccacaccaacaagcagggggcggcaacacacgaacggcggccgcaacaacgagcgccatcgtgagaccagcccaccagcgaaacaaacaaagaccccccgggaggggagagcacacacacaataaagcgacaaaaaagaggagtgcaacaaagagagaccggccctcacaatcaaacaaaacagagcaggagagcacgacccaacagagacaccacacacaacagcacacgtgagacgaacgaaacgaatcagtacacaccacgaccaaaccgggagaagcgacgacgcaggaaaaacacaaacaaagcagcggccgacgaacgaaaacaacacaagcaagaaggaagcca

SEQ ID NO: 492715 - DNA, 502 bp, Homo sapiens
cgagctcggtaccagtgctactccacaaagcagtatatgcagagaagtggcagtgtcgagctgttcccactcctgtaattaacccctaccagtcagctacctccttcatgttacattcatggtagctatcccacagactcagaatcgtgctgcatactatcctcctagccagattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcatcgttccacagtataaatatgctgcaggagttcgcaatcctcagcaacatcttaatgcacattccactggcctgtttgtggaggtagcactg

SEQ ID NO: 492716 - DNA, 358 bp, Homo sapiens
aaatgtccttcagtaggtgaatggataaggaaactcttgtacatctattccatgctgtactactcagcagtaaaaaggagcaaatggtgccaggtgcggtggctcacgcctgtaatcccagcactttgtggggctgaggcgggtggagcacgaggtcaggagtttgagaccagcctggccaatatggtgaaaccctgtctctactaaaaatgcaaaaattagccgggtgtggtggcacacgcctgtagtcccagctacttgggaggctgaggcaggagaatcacttgaacccaggaggtggaggttgcagtgagccaagattgcaccactgcactccatcctgggtgacagtgagact

SEQ ID NO: 492717 - DNA, 306 bp, Homo sapiens
acaggaggtccgattgtcaggctctggagatgtgttcataggctcccggacgtaagcgttgagatgacttgttaatgaatgtctcgaaaatggataatgagcctggtcacgagagaaaggtattcgtcccgggtctaggccttcaggaaaacagtggctctccatctccttgctggatttagtgtgtgccacaccagcatttcctcagtggcatcaccacttggcatgacagtccgtcactataagaccgctctcaagacgggttttccgtccaaatagtccccagctagttaacatgaggtaccc

SEQ ID NO: 492718 - DNA, 178 bp, Homo sapiens
tttgggggggggggaaaaaaaaaattccccctttttaaaaacgggtaaaaaacctgggttggggggtgggttccccccccaaattttttttttaccccctgggtcctgggcctttggggggggaagtttttttccccccaagggccccccaaaaattttttttttttcccctggtcta

SEQ ID NO: 492719 - DNA, 383 bp, Homo sapiens
ctcacaacacgcacagctccacactccgtcacacacacttcgcagactgcaaacaacctcgcggcacacacacgcacacacatgcacacacagcacacacgcaaacgcacagcacacacaaacgcacagcacacacgcacacacagcacacacacgagcacacagcacacaaacgcacagcacacgcacacacatccacacacagcacactaatacacagcacacacacaaatacacagcacacacatccacacacagcacacacacgcgaacacagcacacacgaacacagcacacacagcacacacacaaacacagcacacacatacacacagcacatgcacacactgcacacacttaaacacagcacacgcggccgcact

SEQ ID NO: 492720 - DNA, 320 bp, Homo sapiens
ctttaggggggggtttgggggaaaattaaaattttttcccccccctcccctttttccggtttttaagggcccccggttttttaataggagccaggttaacctccctcttggatttttttcccttttaggccaacttaggttttattttgggttggtttttaacccccctttcgaaaccaaactgtggaactggggttttttttggggaagggggtttttccccccttaaagggtttaaggaacggggaatttcccccattttttaattttggggggttcccaaacttaaaattatttaaaaaaaaacccccggtccttta

SEQ ID NO: 492721 - DNA, 1266 bp, Homo sapiens
ggcacgcgttgtgtccgggccgcgcggcgcatttccgcctctggcgaatggttcgtctgtagtgcacgccgcgggccagctgcgaccccggctgcgccccggtaccccggccatggacgaactgttctcgcctcatcgttcctcggtgaggagcgcagaccaggtcgctactgtagctccgtagtgtggcacgatcacttagaagccaagcaccatagcagcgcgtggccattgaccgcctatctcggacgtcagaagatgccgaaagggcgccgcttccgcgggtgctaagatatacttcaagcgtcagagagtggagcaacatagttacgcactcaaagaaccactggaccctactcattgaacgtagtcatgtggggcgtaccagccaggaacctagggtaaacaacgcctgcgtgcatatctctccctagggttcaacgcggaaagggaccgccgttctcgtcagcaccgaggcactcaaaccctgccacgcacaagcacatatagttacacagcaaagacggagacgtttgtcctaggacacattgcgctgtgcgtattacgagcgggcttggaagtcgtaccatggccctctcgagaagcgccatgattagccaataccacctagggccttttcccacaggatagccctttagtgggcacactcccgaccgtttgttggctcgcaaacgcaagaacgctagcgcaaccccatgtggagaaatgcaatacgcgcgctttaaattccgcaggttcaaacctagtggcgtaggagcaatttcccggaagggaaatcccccataggaaaaaaattccaaaagcccacacctacatttccaccaatcaagggttttacggcgttcaggttagcgaaacaattcaaggccgattaccaccgttaagagcaggcgacaccgggtcaacacgagaaacaccgctttttaaacacattttgacagttggattcgctaggaactcgatcgtttgggccccatcaacccaaaggcggatactgccaaaaccatgattatgaaccacagcgcaaaacacaccgagagttcccagaggtccaactggaaagccccccataccctagaattcttgggcaccgagaccgtcataggttctccccttttactactgtacagaattgacgctgaacatacctatgttggtgaacacccaccaatagtccgccttatctccgagaccccacaaacacaagcgtaatccccacctgacaataacccttgcacaagcaac

SEQ ID NO: 492722 - DNA, 1493 bp, Homo sapiens
tgtttggttatgggttgggttgtggtttggtttttttggaaacgggtgttctcgcgtgcattcccccaggcgtggagtgtgcaggtggcgcaattcttcgcctttccgtgcagtcctccgccctccgtgagtttcaagcgattcctccgggccatcagccctccacaaagtaatagccgtgggaacgtgacgagggccgcgcgccaacaaccacggcccacagatataattcaggtgggtacttcttatagtatagaaacagccggggttttacactcagtgttgtgcacccgagggcgtgggctctctacaaaatctcgcgtgagacttctcgaggggtgaatctccaccgcggcctttacagacctctccccaaagcgtgggcgtggggaaatataccacgcccggtgaacacgcggccggcgccccgtggggccataaaacttgtggtggtgttctccataacaaccagcgtgttatccatgctcgcccagggtctgcgcggggctcttatactaactgtaacatacgtgtgcccagcgcgcaagtgacacctcaagtggccctctccgtgagagcccttctcatacaaagcgtggacaagccgtgcgcgtgtatacccttaaccgagggaacacttcgttgaaaaaacagacaaaacaacaccgcgcgtgggagaagggccagcagaggggcccgttaaaaagatggggtccatgggggggatgtgcgcccaccgaaataagtcatccccaccgtgcgtgctatactgaggcccccagtggtgtcagcaccacgcaccaaacaacacccacccaaaaacgactcacaggtggcccacgcgtcctggcgtcggcgcgtgtggaccccaaggaccacaattcggtcccagcgagaccccccggtgggcaacaaaaccatatggaggtataccaacacacaacggcccctaccaaacaactcgcggggcgggacacacatcacacggggagacaaccccctgtgtgggactccaaacccctagagtgatttaaggcacaaggaaggacaaaaaagacacaccgcggtgaacatcgacaagggggcaccacattggcggccccaagaaataatacagcgtgctaccacaggcacttacaccacgagcgaaactatagctcccccccctagtaaaaagcgggcaccacagccctattacaaaagcttcctattaaaaacagaaggcggggaagcagcacaaaccagaaaccacgcacgcgagacaacccaccaccgaggatcgaaacgaggcccgacactcaacacaactggagaggaccgaccacaacccctcgggtgagcacgagggccaacacaacttctgctcgagggacgtccccccacacacagagggccggctccactaccaccatccggctagtcacgcccaccacacccaaagacacgatgagagagaccacacccaacaacaagagacacgtccgcgcacaacg

SEQ ID NO: 492723 - DNA, 266 bp, Homo sapiens
gcacaggatctaatggctggctgcacattcgcaatcaaatccatcacctgtgtttcctgcacttttataatgactgccattctaagggatctagaactagaaataccatttgacccagccatcccattactgggtatatacccaaatgactataaatcatgctgctataaagacacatgcacacgtatgtttattgcggcattgttcacaatagcaaagacttggaaccaacccaaatgtccaacaatgatagactggattaagaa

SEQ ID NO: 492724 - DNA, 388 bp, Homo sapiens
tcgctccgctattgggcacgccttagtctatcagatgttagaagtaggtataatctgagttgactagagatgttcattcaagataccagtatgcattaatcctggtgcaatgatatgtctaaatatcaaccccaagattctaaacagagtagtgtgaattggaagttaacttatgcacgcttaactatcttaacaagctttgagtgcaagagattgaagagttcaaatctgaccaagatgttgatgttggataagagaattctctgctccccacctctaagttgccagccctcctagagctacctgtggagcaacctgctcagatacatcaaacatggagacagcactcaaagtagaattataaagaagatcatgtccatgttaacat

SEQ ID NO: 492725 - DNA, 732 bp, Homo sapiens
gtgcatctctgcctggaatgaccaggagtatgaacacacggctgaggacccagcactactgtaccgtgtggagaccatgcctgggctgggctgggtgctcaggaggtccttgtacaaggaggagcttgagcccaagtggactacacacggaaaagctctgggattgggacatgtggatgcggtatgcctgagactaacgccggggccgagagtgcatctatccctgatcgttgtcccgtatcctatcctactttggcatcgtctggcctactaacatgaatggctactttcaccgaggcctacttcaagaagcacaaggttcaatcgacggttccagggtgtccagcgtcaggaattgtggactaggtcgtgaaggaaagaagcttatgaagctggaagttcacagggctggctcgagagaggcgtgaggtgctggaccacagcaagaacccattgtgaagacgtctttcctgcgcacgacacaggagggcgcactagctaatgtggcgtttattcgaatggaggaaagatgatgacgttcagcagctggagccaggttggcaagtgcctccgatatctgggatctggatgtgcgtggcaaccatcggggactgtggagattgtttcggaagaagaaccacttactggtggtgggggtccggcttccccctactcagtgaagaagccaacctcagtcacccaattttcctggagccagcccaaaggacgacg

SEQ ID NO: 492726 - DNA, 165 bp, Homo sapiens
tgcgtgttaggtatgaaagcactcggtgaaattgataacttctcagtaattgaacaaatggtaggtacgacaaatgaacatcaaccagattcagaaacagtcgatatttatcaacaacttgtaagtatctttatcaatattagtcgttctttaactgacacgtat

SEQ ID NO: 492727 - DNA, 142 bp, Homo sapiens
tcctcctcctcctcctccctccgccccccccggctcggccccgtctccttcggagaggccaagcccccgcccatctcctagaagggagcacaccccctcaaccctcagctcccgggcctccgcctccgcctccgcgcggccg

SEQ ID NO: 492728 - DNA, 295 bp, Homo sapiens
ctcgaggactaatctctccaggccattcaacgcctccgtcaacggctccgggccattcaacgcggaggcgttgaatggcctccagctccgtccaagttgctgcaaaaggtattatttcgtacctttttgtggctgagtagtattccatggtgtatatataccacattttctttatccactcattgcttgatgggcagttaggttggttccagatctttgcaattgtgagttgtgctgctccagatatcatctttaactcctttgccttctccaaatacatttccaagtcctggcc

SEQ ID NO: 492729 - DNA, 573 bp, Homo sapiens
gaaatatagaaagaaagagtcagtgaattgaagagagtatcagtagaagttaggcagaggacactgagaaaatggattacacagagtgaatagaacttcaggatcctgggagacaagtagcaggataaatcgagcgtattttttgagactagagtctcagagggaagagagaaattggtggagagtcaaaataagtttttagaaataactgctgaatacttcttatatttggcaaacaatataaatacacagttcaatgaaactcagcatagtccagagaagatgctcagcatatcataatccaactgctgtaatagcatagattgaaagaatccgtgagagtagccaggaaaaaaacccagaacattcggtatagggaagaacaattttgaaatacgggttatctcagacatatgataaacaatcatgtaggccaggatgcatgggaacagtacctttaaagcgctcataggagagaatcatccatccgaaattctatacccagtgccgaggctcctcaggctgcaggacagattcacacagattttgaaaaggggttcattatggctgaag

SEQ ID NO: 492730 - DNA, 191 bp, Homo sapiens
tgttaacactgggagagtgaagtggggggtacggcgaggttatctaggctgtctaaaagtcatccagaatagctattagctgggagtaaagctttgaatgtccttgagatgaggattatgatgcgactgtgagtgcgttcgtactttgagtttgctaggcagaatagtaatgaggatgtcagtccgtgggc

SEQ ID NO: 492731 - DNA, 848 bp, Homo sapiens
  misc_feature (1)..(1): n is a, c, g, or t
  misc_feature (12)..(12): n is a, c, g, or t
  misc_feature (32)..(33): n is a, c, g, or t
  misc_feature (44)..(44): n is a, c, g, or t
  misc_feature (61)..(61): n is a, c, g, or t
  misc_feature (65)..(65): n is a, c, g, or t
  misc_feature (82)..(82): n is a, c, g, or t
  misc_feature (97)..(97): n is a, c, g, or t
  misc_feature (113)..(113): n is a, c, g, or t
  misc_feature (117)..(117): n is a, c, g, or t
  misc_feature (126)..(126): n is a, c, g, or t
  misc_feature (136)..(136): n is a, c, g, or t
  misc_feature (175)..(175): n is a, c, g, or t
  misc_feature (195)..(195): n is a, c, g, or t
  misc_feature (207)..(207): n is a, c, g, or t
  misc_feature (210)..(210): n is a, c, g, or t
  misc_feature (214)..(214): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (232)..(232): n is a, c, g, or t
  misc_feature (245)..(245): n is a, c, g, or t
  misc_feature (255)..(255): n is a, c, g, or t
  misc_feature (276)..(276): n is a, c, g, or t
  misc_feature (293)..(293): n is a, c, g, or t
  misc_feature (301)..(301): n is a, c, g, or t
  misc_feature (310)..(310): n is a, c, g, or t
  misc_feature (313)..(313): n is a, c, g, or t
  misc_feature (321)..(321): n is a, c, g, or t
  misc_feature (325)..(325): n is a, c, g, or t
  misc_feature (331)..(331): n is a, c, g, or t
  misc_feature (335)..(335): n is a, c, g, or t
  misc_feature (345)..(346): n is a, c, g, or t
  misc_feature (349)..(349): n is a, c, g, or t
  misc_feature (356)..(356): n is a, c, g, or t
  misc_feature (379)..(379): n is a, c, g, or t
  misc_feature (382)..(382): n is a, c, g, or t
  misc_feature (384)..(384): n is a, c, g, or t
  misc_feature (398)..(398): n is a, c, g, or t
  misc_feature (408)..(408): n is a, c, g, or t
  misc_feature (418)..(418): n is a, c, g, or t
  misc_feature (423)..(423): n is a, c, g, or t
  misc_feature (427)..(427): n is a, c, g, or t
  misc_feature (461)..(461): n is a, c, g, or t
  misc_feature (493)..(493): n is a, c, g, or t
  misc_feature (499)..(499): n is a, c, g, or t
  misc_feature (580)..(580): n is a, c, g, or t
  misc_feature (589)..(589): n is a, c, g, or t
  misc_feature (591)..(591): n is a, c, g, or t
  misc_feature (596)..(596): n is a, c, g, or t
  misc_feature (709)..(709): n is a, c, g, or t
  misc_feature (735)..(735): n is a, c, g, or t
  misc_feature (750)..(750): n is a, c, g, or t
  misc_feature (775)..(775): n is a, c, g, or t
  misc_feature (800)..(800): n is a, c, g, or t
ncccaattaacntttttaaagggccccaaaannccgtgacaaanttttggccaagttgttnccantaaaaagaaccgatttnaaaaaccaaaaaccnaaaaccgccacacgcnaaanagaaaaccnaagtggcccncaaaacattccccctcccccccgaaggttttacgacgcnttgttatcattaaccagtcntttaccaccaanccnaaanggccnatnganacnaacngtcccgagaccgncccccccccnccgattaagagggggggggcngggattagggaaaacanccatttanccccccganccncccgggcngacntggtgncccncccacccccnnccnccccccngccccccgccttgatgacacccnccncnaccgcccgccccanaccacgaacngccaacgcgncccanaggnggaaagcccgagaagcccccaacacacatgggcntgccaggcaccatatcaacaatggcagcctcnccaganttcaagaatttagggccatcttccagctttttaccagaacggcgatcaatcttttccttcagctcagcaaacttgcatgcnatgtgagcngngtggnaatccaatacaggggcatagccggcgcttatttggcctggatggttcaggataatcacctgagccgtgaagccagccgcttccattggtgggtcatttttgctgttaccagcnacgttgccacgacgaacatccttganagaaacattcttganattgaagcccacattgtccccaggnagagcttcactcaaagcttcatggngcatttcgacagaatttacttccgttgttacgttgactggggcaaagg

SEQ ID NO: 492732 - DNA, 782 bp, Homo sapiens
tggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaaagaaaaggaaaaaaaattagctttatacctcttcctgtgtttcaaccgccatgaaatttctgaacactccaaattcagtggattaatccaaaacaaattttataaggtttaaaatattttcacttcttatagtaatagtatactttaaaaagcctcggggtatattatcttctaaacagctacaattcagggcagctactttacccaactatgtcctctagtggagaacaactaggcctattttcacggctgtgtagcctcagggcctaatctgggtgcccaaataacatatcgtagaattaccctgattgggtaaaaaccatgcgtttttgtttacaattgcaaaattctcaaaggcctgtatttatgtacttctggacatattatttcatttaattctcaggtattggctggtgggggtgacttagtacacttagtcccatttttaaaaccacattattggcggtttaacaaactcttccttttacagtcattttacaacatgggtacccaatggtatttaggctctagaacagttacatttg

SEQ ID NO: 492733 - DNA, 780 bp, Homo sapiens
ggttgagggaaagacgtttttgggccccaggggccctaggactcaaagtggaacccaaaagttcctttgggtttttcaaatattgcccattccccctaagagctttagggttcaccctctccgagtccaaaagaatgtacctggcgacaaaatcgcaaaaaggggtcccaccagtctggtatgggtggctccagccacaaggttggagatgggtctattaagtgggctcccctgaatttggagcaactgttcagaatgcagggaggaaagtgccaatccactccaggtccgtatatggatatccgaactatccgcatggtccacctctttattaccaggattgtcgggccttaggtaccctgattgcctactatctgaatgtagtgtagtggatagaatgacccatactatagccagcagtacaggtcaagaggtagagcctcttgagaatggcaggtgtaataatctactgtggagcagcggctagtgcaagtagtgattcaggatctatgtagcaatggttttggccatggtgataaagtctctttcgctcccgaatatagcctaaagaagtgtagcgaactcaaggagtctctgtgattggctggcgctaagtaagtcacctactgcatctaggatgccagcagtctggcttggtgaacacttgaggcatgggaggtaaggccctggtaaggaggatgacaggttccacatttaatgtcactttggattgttgttcatcagaggaggtttcttgaagcaggtgtatatagatactca

SEQ ID NO: 492734 - DNA, 459 bp, Homo sapiens
  misc_feature (198)..(198): n is a, c, g, or t
ccagctgtctaccatgcatttgcaacaggaggaagatgtaatgaatatgcagtattaagttgatttatgaacagtgctttgatatgccaaagggaaaactgtcccacttaaattagattaagtagggtggctaaaaataaataaaaacactggaaattctttctctcactttctcttgatgcaatgaagggaatatgncacttcagtatacagagttgttgttatatgatgcacaaaatattttgaagatttgaataaatggtaacctttaatttgggcctttataaaggctgggtatccggtaaaaatagacaaaatccaaatggaattttttggtgggttttggccctttaaggaatttttttccaaaaccaaaaaatggaataaccattgaaatggggaaatttttctaactgaatcaattgttacatgaaaaataaatttatataacccctttgt

SEQ ID NO: 492735 - DNA, 341 bp, Homo sapiens
  misc_feature (5)..(5): n is a, c, g, or t
  misc_feature (64)..(64): n is a, c, g, or t
  misc_feature (136)..(136): n is a, c, g, or t
  misc_feature (295)..(295): n is a, c, g, or t
  misc_feature (311)..(311): n is a, c, g, or t
taacnggtattcaactggggaacaattaaaggaagaccccatttatttatttttcgagatggantctcactctgttccccccaggctggagtgcggtggcgcggtcttggctcactgcggcctctgcctcccgggntcaagtaccgctcctgtggtgggattacaggtgcccacccacgatacccagctaattttcatatttttagtggcgatggggtttcaccatgttggctaggctggtcttaaactcctgacctcgggtgattcacctgccttggcctcccaaagtctgggnttataggcatgagccnccatgcccagccagtaagacccgtctataa

SEQ ID NO: 492736 - DNA, 879 bp, Homo sapiens
ctcctccagactcgcccagcaagcgagaacgccacaagcaactcgtgagcccacgtcggccgtcgggaaagcacggggcctttcccacccaccctcagccagcgccacacggcacccacgagactgggtgccccgagcggcgccacgctatggcatggatcagcgactgcaggatcccgccatgttccagggcaggacccgggcccggccacaccggcccccatggctatgggaaggcgtgggccacatggtcccctctggggcgtccccgagcactcccacgtcctcttgtcgtagcctcaccctctaacacgttcagcggatggaaagagtttgtataattatgtaaattattacgtgctttgaaatatgacggacgtgtgagctcacgtggcggccatgcatggattagtaggcgagaacgacgggggcccagcggctaccaccagcgcatgaaagcacggggtatcacgcagagaatccccacagatgctgcaggtgccagacaaggaacgggaccacagatgggacacaacagccatccccaacatcgcagccggactccaaggaaccacggaaggtagaggaggcgcttcgaggaacacactgagggactgtcacccaagcacaacagtacacaggaacgcgaacaactggatcgccaaagcaagaacagcatatcatcacaacacggggacaacacgacacatagttggatggtagtcctatgggaccaaaggcactacgattaaacgaactacccaaccaggacgttacaacgggacagaaaccacaacaacaaaaacagacaaacaacaaagaaaacgacgaggccgccccgccgcaccagacgcacaaataggccgcccacaccaacgg

SEQ ID NO: 492737 - DNA, 118 bp, Homo sapiens
acagacaaacacagatgcctggatgaattttacacagcaggcaacagtgaggaagaaggctgtgtagacaaaatatacaatcagacacatagacctaagacaagccaggagaccactg

SEQ ID NO: 492738 - DNA, 203 bp, Homo sapiens
tgcgctaagtgctgagattacaggcatgagccaccatgcccagctcaggttcctatattttatatcttctatttgtagaacaaggctctattaaactacccaatatggtatttatatagtcccacctatccagcaccaaaccatatacatactacataatataccgatctacaaataaacaatacaactatatggaggtagtt

SEQ ID NO: 492739 - DNA, 1405 bp, Homo sapiens
aagctcaataaatatagtacctgcacagggcacatagatgcaaacattcatggagccaagtcgatatactatgaacatagggacttaggccctaataccttctggcgataagtgcacatcaactagacaagtgacacttagacaaggcagagtctcgcacagacttggggaatccgccgtaaaacaagcacggaaggttacctaaaagaaccagctagacaagcaggctacaaccccgatactgagtgtaggcccaaacccttgcagtcagcgagcatagggcgtctgcactaagtgcttagaggcgcggaactagaagctcattaacctcggaacgacgcgtagggcttgcaataatgcacatcgcggtttgattcgctaactgacataggaaaacttcctatgaaaggtaaccataatctatttcagaccactaaataggaccagcagcaagtaacagcgctctggctatcagattcccactttgaaaagaagtagataacaactagtgttgaagtatcactacacaggctatgtggtaaaaccacggctactatacgcgcgggcgcaaacataaaatttgtgacacaaacacacacgcgttcgttactggaacagaggcaagtgacacaccagcaattttgccacactaagcctcatatacgtcgacggagaccctgaagagcagagacccatgacgcaagccccacatacgcacacgcaaacaactgactgtcattcctagggattaccatgaaaatctcccagcagtaaagggcggtcaaaagataagtattcgtcacaaaacaccaacgttaacttaaagcattgcaaaccgtggccgttcacagccaggctcccaagcataatgcgacgacctgtagggtacatactggtcgacacgcgcatacaatcgattggacaaggagacaataaaaggtggcatcgacgcgtacataacaccggcgtaaccacgccacttgcaatgatgcaaacacactatcagtacgccatgcacaggagcgagtacaaacagcccgacgccgaggtcacccgagactatacgagtcgacgcagctgtccaacacggtggacctgacaagatcaaaccgcaaggaaccgccaagaataacattgcaacgcaagacgacaacagagtgcacgaaaccaacggggtacaaatcaaatgtaccagacacaaaggaacaggaacgaagcacgacagagaacagccagggcaatgtgaactacaaaagaagggggaaaagggggagccaacaacaaagaagcgcaacaacgagggaccaccaccggaacgaacgcaacacacaccacgaacacagggagcgaccacacaagaaagagaatgaagaagaggacaagccacaacaccacccaagagaca

SEQ ID NO: 492740 - DNA, 874 bp, Homo sapiens
gcctctgccctttttgccctccttctccctggggcaatcttcgcccctttttcctctccttgtggcgaggcccaatcaagccgaccagttttggttcccccaaaagtgcatgggggcccttccaacggaccggggctcctattttcaagacgcctggctgttgttgctcgctcccgggcgggtatatccacagaagttccttcggtgcaccactccggtgcttcgtgtgagctctggatcatgggccccgcctccttccgggggttatgcacacctattcttcgcccgcgcagcagtggttcatgtgtctgcgtccctctcgtgtacccccaccccacgatgtgctggatgcacactgcacgccccggatctttctgcggatatggcatgaacgccttcgctccacacgccactctaatggctgatggaccctccctcttctcgggggagaaaaaagactttccttcgcacagacacttcatttgttccgggggccctctaccaatccgggggggtgcgaccgtggtactggcaggcacactccactccggccggattcccctcccctgggggatctcaacaagtacacatgcttgactcatagaccgccgcgcgctctgaagaacgtgagaattcatatcattggtgtcacaccacatggttctctgcgataagagattggtgttttcaagggtgagtcatttggccagctcccctgacactatgtgagactcgcgaataggggggggtacccacctgacagggcccctccgtgaaggagatggaatcccgaagtcccccctcggcggggcatcgtctgtttcgacgggtacgcgtgccccccccccaaaacggggcggacacacatgacgaa

SEQ ID NO: 492741 - DNA, 212 bp, Homo sapiens
agaactcattggtaatctacataacctctcataattaaacagataaaaatttgaagaaagagtattttgtcgtagaaacaagcgagaataagaatatctgagggataaactggcactataggatcattgtgttcagtgtcctaacattcaagaatcgtctacattacattgtttaaggaaaacaaattatcagaaacggtgtgaatacgtgg

SEQ ID NO: 492742 - DNA, 439 bp, Homo sapiens
  misc_feature (8)..(8): n is a, c, g, or t
  misc_feature (68)..(68): n is a, c, g, or t
  misc_feature (72)..(72): n is a, c, g, or t
  misc_feature (76)..(76): n is a, c, g, or t
  misc_feature (85)..(87): n is a, c, g, or t
  misc_feature (89)..(89): n is a, c, g, or t
  misc_feature (91)..(91): n is a, c, g, or t
  misc_feature (94)..(94): n is a, c, g, or t
  misc_feature (96)..(96): n is a, c, g, or t
  misc_feature (99)..(100): n is a, c, g, or t
  misc_feature (102)..(102): n is a, c, g, or t
  misc_feature (113)..(113): n is a, c, g, or t
  misc_feature (120)..(123): n is a, c, g, or t
  misc_feature (125)..(126): n is a, c, g, or t
  misc_feature (137)..(137): n is a, c, g, or t
  misc_feature (144)..(144): n is a, c, g, or t
  misc_feature (147)..(147): n is a, c, g, or t
  misc_feature (151)..(151): n is a, c, g, or t
  misc_feature (154)..(154): n is a, c, g, or t
  misc_feature (168)..(168): n is a, c, g, or t
  misc_feature (188)..(188): n is a, c, g, or t
  misc_feature (192)..(193): n is a, c, g, or t
  misc_feature (205)..(205): n is a, c, g, or t
  misc_feature (208)..(208): n is a, c, g, or t
  misc_feature (213)..(213): n is a, c, g, or t
  misc_feature (220)..(220): n is a, c, g, or t
  misc_feature (224)..(224): n is a, c, g, or t
  misc_feature (231)..(231): n is a, c, g, or t
  misc_feature (236)..(237): n is a, c, g, or t
  misc_feature (240)..(240): n is a, c, g, or t
  misc_feature (244)..(244): n is a, c, g, or t
  misc_feature (252)..(252): n is a, c, g, or t
  misc_feature (259)..(259): n is a, c, g, or t
  misc_feature (271)..(271): n is a, c, g, or t
  misc_feature (273)..(273): n is a, c, g, or t
  misc_feature (364)..(364): n is a, c, g, or t
  misc_feature (435)..(435): n is a, c, g, or t
tacttgangagggggtgtcactcctgcccgcaatggaatgttcagaacgcgggacctccttgggttcnggantttnaagaccccnnnancntcnangtnngntttcggctttntggaccnnnngnntcctcttgatntgccttnggntccntantgaccctggtctcnccctgatgcgaattgggatntttnnatcgcgtggcgntcnccctngtgcagntttngagattnttatnntcngtcnttgctgcngcatganttaagatttctnanccccagcatcgccctggtttgatttaggatatttagactccggcttccctttggtgcgattcaggattcttagactccgccgttgccgtgncgcgatttatggttttttgatgatgccctggcaaatgctctggttcgatggagtagtggtagtacccctgnatct

SEQ ID NO: 492743 - DNA, 222 bp, Homo sapiens
  misc_feature (40)..(40): n is a, c, g, or t
atcctcagcatggtgtgcatacatgtgtgtgcacatgctngagtgtgcacatggctgtgtgtgtgtgcatgtgtgaggtgcatgctctgatggcctgggtttctgctgttattggcagtgctttggtctggatctgcttccctgctccccattctgtccctcccatctcacccagcatctccgggtgtgggctccgagcccgggcacatgcatgcacccagg

SEQ ID NO: 492744 - DNA, 760 bp, Homo sapiens
cctggcccgcatccggatttattcttttgtttttttttgtatttttgctttttgctgtctatcgtttgtaatgggctgatggaaagaaggaaaaaagttttttgcccttgtgttggcgcgggcaattcggaaaaagcttattttaagacttacgcctctgcgcgtaataaaacaccgcgtattcaacactgttataacagggggaaaaaatgcctcataaaattggctttcgagacaccaaaaaacacccggcggctttttttgatggcctccgacagctttaaaaatgctcttgcatcaagaaaaaaaccgtttgctttttttaaaaaaggggtcttttctaatagaaaccttcaaacctctcgagacgaagagaacgaaatttttgaggaggtttatgccccttgtgtttgttccttccggccaattgtgcgaaagggggggccttttcttttttttgcgccctgtcccccttagaagaaaagggttataaagaccgttcttgttttttccggggataaaatctttttcctcggcacaaaagttttttttggtggtggaagggggggttacccccggttttagcccttgggggtgcccggagattgcgtttttattctgaaaggaccccttgttgggcctcgcttttgtggaaaactcgcggaggtagggctttccccgcctttttatactagtaatggcgcgagggggggtttcaatagttttgtggacctccccccgggtaaaataacgggggtcg

SEQ ID NO: 492745 - DNA, 242 bp, Homo sapiens
cccccgttgctctcgtcatgtgtgccatggagaccgctctttgtcacccaggggtacctcctgcggggacctcatccaccgtgatgtcccacggcgctctcttccgtccacctggggttcatcctgagctcctcctcctcctatgtgtcatcctcagagctcctcctccctcgtgagtgtcccatggggctcctcctccccccatgtgtcatcctcagacactcctacaccgaagaccccat

SEQ ID NO: 492746 - DNA, 165 bp, Homo sapiens
tagagtaggtatctctaggtagtattctactcttaactgctgacccataaaaatttgagttgccaaatatatctctggtcagttattcattccaggcgctatatatcaatgcctactggtatttctacttggatatctctacttggatatctccatgtcctgcgt

SEQ ID NO: 492747 - DNA, 310 bp, Homo sapiens
ggtcacatcctcatcgccgatcttcatacccgagcggcaaggctctgaggccgactggcccaggtccagggtcttggtgctattttctcctgcggccgggtttgatgtctagggcggtgataccaagctccttcaactctgggccacatcctgggagcaacatagcagcatatggcgaggattcatctcggtctgcctttaccttcatccaacagtcaaaggcacatcgcttctgcaaaaagtcactgcatggcaaagttcatgagggtgcaactatggcgaacaaatcatctttcttagcactgggtcg

SEQ ID NO: 492748 - DNA, 168 bp, Homo sapiens
aagctccaacaagatatcaaaatataccacaattaattgggattcatcccagggatacaagagtggttcacacacacaaatcacagacattacattttttaatctttattttgaaaggtggataaaactgaatttgggatttggcagattttgttttgtggtcccacg

SEQ ID NO: 492749 - DNA, 170 bp, Homo sapiens
agtcttaataccataataaatgtatggtcggagggaaacagcaagccagatggtcaccatgccctggccagggtaggcactcagctgacaaatgaaattcatttcaaggaactaccctaatggaaacccaggggaaaggttaaaaacagaagggggatcctactagagtc

SEQ ID NO: 492750 - DNA, 181 bp, Homo sapiens
aacacggcgtgtaggagtattgggcatggctagatatggctggctggctgggaatgctgagggttgtaggggatgtaggaagaataggggtgcagccaccagaggagggcagcagcgcggggctgatgcgtggcttgctctgaagcatgggggccaaacacgggctgtgcaggggtagtgg

SEQ ID NO: 492751 - DNA, 276 bp, Homo sapiens
ggtcctgcatactgggcgtatgcttgatcagggattagttgaagggtagtcattaacagtgtagatagatctttcagagaaactttttttgagacaggctctcactctattgcccaggatggagtgcagtggcgtgtcgtgatcttggctcactgcaacctctgcctcccaggcccaagcgattctcctgcgtcagcctcccaagtagctgggactacaagcacgcaccaccacccctggctgattgtttttttgtttggagagatagggtttcgc

SEQ ID NO: 492752 - DNA, 103 bp, Homo sapiens
acaatgaagagagcaaaaaatgctagttaaacagaagagacgaagatcaaacagaacaaagcagatgcatgaagattactggtttcaatgtggagatggtgga

SEQ ID NO: 492753 - DNA, 930 bp, Homo sapiens
tctaagtacatatgcagtgatcaagacatggcgcattcatactaatatacatttaaagtggtataattcttggttgatcctgttcgaaattttgatgtcatctagcgccagtgtaatcttaaaggtttgatgctttccacatgatcagtcatgttgtcttttggtaagatacagtgtttacttcgactcgattgtttaacggccatcgtggtgtatacgtattaatcgacggataagtctctgtagtcctaataatccattttaggccagtttccccatctcgcagcatccatgtggtttcagaggtctcgccgcttctacgtacaattatgatgtggtgggtgcacttgtgcctagtgagaaagcatagaccaattggttttaatagcatcgttatgatactgagggaccaagcttttggtcaccgaatagcaggaatgaaggtcctagttaagaatgatcaagagttccaatgagaactgatcatattggttaagaagtgtgtcttagtacctatgttgtcccttaactgggcagcttatttctaagtaggatctggttttgacacagttgacttctaataaacgttatactgggggtctcacaaatcttgtgactagtaaattcaacctttgggtgatcctgtgaacagtttcccgtctggcttcctgcctctagatgtagagttgtgttatgttggcatgcgccacgcgtgtggcacaataactatgtatttcgagtcctggtttgggtaatggaagcgtgaatgagtggcataatatttcccctgaattggaacttttctaacgcgggggaacccgggattaccggaacatggccacgttcccgcgaactaattcgacaaattgcggaaatgggtcgccgacgcaacaaatataatcagaacagtgggggcccaaaaattttcct

SEQ ID NO: 492754 - DNA, 125 bp, Homo sapiens
agggaggatacgtgaagacagcggatattggaaataatataagtgtggataagaccacagactcatatgtgctgggagctggcaggacctaggccaggctgctggggtaccggagctcgaatacg

SEQ ID NO: 492755 - DNA, 267 bp, Homo sapiens
  misc_feature (14)..(14): n is a, c, g, or t
  misc_feature (43)..(43): n is a, c, g, or t
  misc_feature (45)..(45): n is a, c, g, or t
  misc_feature (61)..(61): n is a, c, g, or t
gagtggcttacaancacttcatcttcctaatagcattcatgtncnaccctatcagtatganagatctttccttggtcagtgacaagagaagtaaaagcataatcatgtcatatctgcatgctctacctatagtatatagcacacataatctaaggatattatctttaaaaaaatgatatgattatatgatccatctccacattggattggtattaacgtagtaattaaccactgtgtctaattagaaactaacaaaaccattggctc

SEQ ID NO: 492756 - DNA, 151 bp, Homo sapiens
ctctcgtgacagactcggcgacctactgccctgcctgtcatgtatgggtcctcggcgtgtgcagtgtggacattgggcgtgtgcagtatgggcactcggcgtgtgcagtttggcggctcggcgtgtgcagtatgggctttcggcgtgtgca

SEQ ID NO: 492757 - DNA, 989 bp, Homo sapiens
  misc_feature (691)..(691): n is a, c, g, or t
tactggagtgaccaccaagaaagtgtgtgactgtgtgactggagaatacactcgccgaggaagtcaacctctgcttgtataactccatgtggccactggtaggaccagtgccacctagtgacaacgaaggcggcagaagtgttcccaactcccaagtgggcattggagaaagtatttcccgaggaatacgaaaggcgaacaggagaaattgaaccacggagatccaaattgcacggtaccaaagctatgtgtgttatagttccacccgaaaagaaaaagatatggtgaaatatgagatgccacaaatacgaaagtgatgtttggatctcgaataacaaagttcaaatttgagaacccattatggttggaattccatacgattaaaaagtataatccagtggtagcaaaaaatttttgggttaagcaattttaaagcaaagcgagagaggaaaacaattgtaggtgagcgactagacacattacagggggggtcagtaggaagaaggaggtagtccaaagccaataatgcaggagtaagataggcgaggcaaattcaaaacagaatttgagaaggaaaaaagaagtaccgacttttgtgaggggacacagagttttcatggttgaagatatttggcacattaacgaagaggagagtgagagattaaaatttcaagaaattttgaagcgaagntatggtgatcaccaattataaacatatgtgtgtggacaagaaatgattgttttgcccgcaggagtaaaaaaattaaggagaaaggattatttgatgtgtaatagtgtagagaagtattaggcacaacagtggagaagatatgtgcaaacaattactacgattgagtgcggataggaggagcaccgactttatactcaatgaggaggagggaccataagcaacaatgatagttaacaatttgttgggacgaagttgaaagggatgtgagagacatttgtggtaataaacgacgtagaaa

SEQ ID NO: 492758 - DNA, 121 bp, Homo sapiens
ccgatttttgcagacgtggtcgcagaggtctgcggcctacagcaacgtgtcaacccgaaggtgtgggacttctacactgaggagacgctggcctgagggccctcccttatgacttgggaac

SEQ ID NO: 492759 - DNA, 162 bp, Homo sapiens
  misc_feature (20)..(20): n is a, c, g, or t
  misc_feature (106)..(107): n is a, c, g, or t
  misc_feature (158)..(158): n is a, c, g, or t
  misc_feature (160)..(160): n is a, c, g, or t
ttgccttgcgggccttccancaccatcatgaaatccaccttggccccaatggatggattattgcgatccacccacaacacccgcaccacggcaccgaccatgaaannaaggaggcttgccgcgcataggtgctgtcactggcaccgaacatgtcgatnanca

SEQ ID NO: 492760 - DNA, 547 bp, Homo sapiens
  misc_feature (35)..(35): n is a, c, g, or t
  misc_feature (107)..(107): n is a, c, g, or t
  misc_feature (117)..(117): n is a, c, g, or t
  misc_feature (127)..(127): n is a, c, g, or t
  misc_feature (138)..(138): n is a, c, g, or t
  misc_feature (141)..(141): n is a, c, g, or t
taaagaaaatttctctttttggtgtccctcaatantttagcagatgttcattggggggaaattcttattacttacatgaatgagttgtgaatttaggggcaaggaanaaaaaaaaanttcaattttntggtttaaaanaanaaaattggcaagagtacattaagttatttttttaaaaattcaactcgaacagaagggaagtgcatgtgcgttgtttccaagggtcttagacattgcttttatctcacgtgactagttattcactttttttacaccttgggttctcaaaacaaagtgatcttggttttggctcacgggcaaaaccgggtttgacaacggggggcgtggcgctttattataatataatttttttcctataagggtttccttaacaataagtggtgaaattcctaaatttataggcatattgtttagagtaaatctctggaaattcaggttacttcattgtggtgaattttatccctcaatatcatggaatttgggttgtttaaaaattggttctattccaaattttgggatcaacttg

SEQ ID NO: 492761 - DNA, 739 bp, Homo sapiens
tccacgcttaatccatttaatttttctggtttaaaaaccctttgtggtacccacaggtgggacccggagttccgtgtgcagggaaactcgggggggggtctggacgagggggtcagggaactccggatagggagaggactgggtagaatacaggtctcctcccagaggtcgggggtcagggtacgctggtagggtctaaagaattgggcttcaaagggggcgcctgggcagaagtgcgcccagggtgggcagtgcagccccgggctgaggtgtacgcagtacatcagatacacagccatacatgagagcagttcctaagcgcacaggtcgcgagaagacagattggccagcgtggccccggggttgcgcaggggatgagagggctgtaccaggcacaaggagccggcaggggcctggtcacctcggcaagggagacatgtgggggggctggccaggtctggtcccccaagtagcctcttggcgcagggggacagagggagaagctgggccagggatagatgggccccaagggattgggggggggccacctcttgggagacactgtaacaccaagaaccgagcggggccatggtagtcccccgatgagcaacaaaggcctggaaaccgggagcgcgggccggcaggggtctgctcaggcaacggggaataatctcaaaacctacatcttggagaagagagccccgggaaggaatcaaggatctctgatcacctaaagggc

SEQ ID NO: 492762 - DNA, 371 bp, Homo sapiens
tgctgggattacaggtgtgaaccaccctgtccggccacaatacccagctaatttttgtagttttagtagagacagggtttcattgtattggccaggctggtcttaaactcgcggcctcagatgatctgcctgcctgggcctcccaaagtgcttggcttaaatggtgagccaccatgcctggcatgcctggactttttttttttttcccagatggaatctcactgtgtcaccctggctggagtccagtagcatgatccaagctcactgcagccaccacctcccaggtcaagcggttctcctgcctcagcctaccaagtagctgggattacaggcgcgccccaccgcccagccaattttttatattgatggta

SEQ ID NO: 492763 - DNA, 2385 bp, Homo sapiens
agcaaggtctaatgggatgctgtcttcaagagacccatctctcatcccatgagacccataatgacacccataagctcaaaataaagacatggagaaaaatctaccaagcaaatggaaaacagaaaaaagcaagggttgtaatctcatttcagacaaaacagactttaaaccaacaaagaccaaaaaagacaaagaagggcactacataatggtaaagggttcatttcaacaagaagacttatcctaaataatatatgcacacaatacaggagcacccagactcataaagcaagttcttagagaccttcagagaggcttacactcccacacaataaaaaaagaaaaaggcctgggtatagtggctcatgcctgtaatcccaacactgtgggaggccaagacaggaggattgcttgagcctaggccttcaagagcagcctgggtaacacagcaggacctcacctcatctcttaaaactcccacacaatacggggagactttaatacccaactgacggtactagacagaccatcagagcagaaaattaacaatgatattccggacctgaacacaacactgggccaaatgtacctgatagacatctagagaactctccacccaaagatcaacagaatatgcattcttctcattaccacatgggacatactctaatatcaaccacacaattggacataaaacaatcctcagaaaatgcaaaagaaggaaaattataccaaccactctcttagaccacagcacaataaaaatagaaatcaagacaaaatcactcaaaaccatacaattatatggaaattaaccaacctactcctggatgacttttgggtaaataatgaaattaaggtagatatcaagaagttctttgaaacgaacaaaaacaaagacacaacataccagaatctctgggacacagctaaggcagtgttaagagggaaatttatcacactaaacacccacatcaaaaagataggtcaatggccaggcacggtggctcatgcctataatccaagcattttgggaggccaaggagagtggattgcttcaggctagcagtttgagaccaccctagccaacatggcaaaacctcttctctactaaaaatgcaaaatttagctgggtatggcagtgtgtgcctgtagtcccagctattcggaaggctgaggcacaaggaggtggaggtggcagtgagccaagattgtgccactgcactgcagcctgggtgacagagcaagactcttgtttaaaaaaaaaaagaaagatctcaaattaacaacctaacttcataggagaaagaactagaaaagcaagagcaaaccattcccaaagctagcagaaaaaaagaaataatcagagctgaaaactgaaggagactgagacaggaaaaaccattcaaaagattaacaaatctaggagttggttttttgaaaaagttggtaagatggaccgctagctagaataatgaagaagagaaaaaatccaagtaaacacaattagaaacaacaaagcgggtgttgccactgacccctcagaaatacaaataactagcagatactactatgaacacctctatgcacacaaactagaaaatctagaagaaatggataaattcctgaacacatacaccctcgcaagactgaaaccaggaggaacttgaatccctgaacagaccaataacaagctctgagattgaattagtaatgtatagcctagcaaccaagaaaggcccaggaccaggtgaattcacagccaaattctaccagatgtacaaagaagagctggtaccatttctactgaaactgttccaaataactgaggagaaaggactcctccccaactcattctttgaggccagcatcatcctgataccaaaacctggcagagataacagaaaaaactaggccagtatccttgatgtttattaatgcagaaatccttaagaaaataactagcaaaccaaatccagcagtatatcaaatagctaatccaccatggtcaagtaggctttatccctgggatgcaaggttggttcagcatacgcaaatcaataaatgtgattcatcacataaaaaagaactaaagacagccaggtgtggtggctcatgcctgtaatcccagcactttggtaggccaaggtgggtggatcacctgaggtcaggagttcgagaccagcctgaccaacatggtgaaaccccatctctactaaaaatacaaaaattagccgggcatggtcgtgggcacctgtaatcccagctacttgggaggctgaggcaggagaattgcttgaacctgggaggcagaggttgcagtgagccgagatggcgccactgcattccagcctgggcatcagagcatcagagcaagactatgtc

SEQ ID NO: 492764 - DNA, 225 bp, Homo sapiens
  misc_feature (13)..(15): n is a, c, g, or t
atccctgccctgnnnctgagccttgaaggccggcctgcgtctgaatggttgcctgccagtacccgagcctattcacagccaggccattcaccttcgattagcactgattgcccaatgcacctccctccccagctcgaggtcattcttcaattaggacgacgaacctagacaggtttaatagcgaatctaatggtgaagtctgacctggatgccctcacgttggca

SEQ ID NO: 492765 - DNA, 153 bp, Homo sapiens
atggtctgactctagagtgatcccccaagcagttaactacatgactcagcctccaagtatggtgggactacatgtgtgccctgctaccaacaccctggctaacttttttgcatattttatgtaattgacatgtggtattcacccattgtttgg

SEQ ID NO: 492766 - DNA, 401 bp, Homo sapiens
  misc_feature (344)..(344): n is a, c, g, or t
gctagaaggttcgatgcctctggaaagcatgtgaaactcatctcccttttgtttccctgaatgcatttttgttcttttaacagatctgtccctgtgggtggtgtctaaaaaatcggaccccctggtttttgtgttagattgagctgggcagctgccatcagcttctttatatgcaaattaggcccgacccctctgtggttcctggttggtggctaattaaatgaggggagggagggatgtcccccccaaagtaggccctccccttggctttggccaggccaaacccttcccatcgtttacatggttctgtgtaattttaaagtttatgtgtataaaacgaaacngtttctgtgaaactgtatattttgtaaataaatatattgctcctttgaggttcatga

SEQ ID NO: 492767 - DNA, 265 bp, Homo sapiens
caggtgctcactaaacacgggttatgattttcatcaacaagcacaggtgctcactaaacacgggttatgattttcatcaacaagcacaggtgctcactaaacacgggttatgattttcatcaacaagcacaggtgctcactaaacacgggttatgattttcatcaacaagcacaggtgctcactaaacacgggttatgattttcatcaacaagacaggtgctcactaaacacgggttatgatgttcatcaacaagcacaggtgct

SEQ ID NO: 492768 - DNA, 189 bp, Homo sapiens
aacgggtgatgcggttgaagaggatccagaccttttgatactcttccgaggaagaactaaggatgagcttctgcgacgggcaaacgctagcaatagcattaccatctacgtgctgaatataaatcacccccttcgcaaggcttattgtgagcactacagccgcagaagcacacaagccacatagagagg

SEQ ID NO: 492769 - DNA, 451 bp, Homo sapiens
tcacactcaacaaacaatgttatttaatttctaagtgtctggagatctgttatgatttttagtttctttctttcaattgtagttagagaacacattctgatttcattttttctttaaattttcattatttcttaaaattttaaatagagatgtggtctcactatgctgcccaggtaggtctcaaattcctggactcaatcctcccacctcaacctcccaaagtgctgggataacaggcttgagccactgtggttggcctgatttcaaattttttacatttttttaagttttattttatattccaggatatggcctatttgggtgaatgttccatgggcttgaaaaaaatgttcattctgttgttgctgtgtgcagtgttctataaatttcagatagctttcgttaattaatggtgttacgttcttctatatcctagctgacactagctgat

SEQ ID NO: 492770 - DNA, 429 bp, Homo sapiens
  misc_feature (159)..(159): n is a, c, g, or t
  misc_feature (182)..(182): n is a, c, g, or t
tgtttccctttgtctagtgtatgtgctgccaagtgagcaccattttatttgtagcatcagtattactgcatcctacttgtgagaagaagcctctttaatacacaggttcctaagagggactcttaccatgttagtatctttttgatgaggtgaattgangaagaaggtgctaaaaataggtntatacaggctatctgacaaaacagtcaggtaagtctctgtgaattcaaatgccgggggatgctggtgcaccagctgccagacacaatctaggaaaagcaggaacacaggaacctgcatgaaaacaagatacgttacttggtgggcagagcccagagcaagccatcctgagttcagggggcagccacctcaacagctgtggaataagcacttctgaggacttcattctctggaacaccgggtccttaa

SEQ ID NO: 492771 - DNA, 177 bp, Homo sapiens
tacttagtgacatacatgttatcccttgaaagcatttctgaccttgaccttctgttcatccctttaaatatctgtagccactgggaattctttggacatcagtgattgctctcagtcgcacttgttggctaacttagtctctacatccttggccctcacaatcatgggacactgcgt

SEQ ID NO: 492772 - DNA, 234 bp, Homo sapiens
tataccaccctatccccacaattccaacatttcaaaaacattatatataatgggatactttagtcacaaggtgtcacctttgctgagtcaaccaaatatttataatgctcctgttcaaagatggctactggatgtaaacggtaattacccagtattgctggcattttaccggaagccactggagcatattacattttcccatttcggtattatggtggtatccgggggtacgag

SEQ ID NO: 492773 - DNA, 118 bp, Homo sapiens
catatccccatccccctgcactctagctatcctccccccatgtcctcgcctgtatgtcctgcgtctatcccaccctcctcccctctccctcacaccctcttccctcacaatgccagac

SEQ ID NO: 492774 - DNA, 409 bp, Homo sapiens
tacagagtgaatggccgatcaaggacttctcggctatttgtcccgagctcaaggcgatcttctcggaactcagggctgggttctcattccaaaagccgtgggggcttctgcattttgatccggttgactatccgatcgcaaaggaagaactggctgggttccaaaaggctgccatgcaaagcggcgtgagtttctgctttctctccacgtgggagcagcggcatgaagacaaggatctgttggagatgttcaagtagtgccaacccgatacttcgttctaggccaagcagattcgtggttgggcacattcactcggtacacattcactctgtacgtacagagtgaatgtgtatgtgtagcattagacaaaattatttaaagtcaataaattgttattcgaggattccat

SEQ ID NO: 492775 - DNA, 126 bp, Homo sapiens
  misc_feature (8)..(8): n is a, c, g, or t
agctcggnaccccgccgaagtcgagggcatccgggaaagccacgacgctatatccggcgaaaggattctcgtcggccccgatacccgccgcgaggagagctgcaggcccgtggcacaacgtgataa

SEQ ID NO: 492776 - DNA, 154 bp, Homo sapiens
aatacctggggtaggcatatcagatgagcactgcataataatatcacctactgggagcaatatacacaaactctggagtgaccaagtgtacctaatgagcccagagtgcctacactgaacccttctacgattcttctactcacccggaaaggca

SEQ ID NO: 492777 - DNA, 334 bp, Homo sapiens
  misc_feature (1)..(1): n is a, c, g, or t
ncagactgaggcaggaggatcacttgaagccaggagatcaagaccagccttgtcacaatgtgaacccccggtctacagaggataattatcataataattttttaaaaagaaaagagggtgccctacaaggagagggatacttgggaaaagagaacagagagcagccagtacaaaggccctaaggtagagggggccagtgcttctgcagggccgagacctaggagggagtagctgagacgagggatggggcagaccaggaagggcctgcgatcccagtaaacactagattccagtctgtgagatgggcagccatcagtaggatacagtagggaga

SEQ ID NO: 492778 - DNA, 402 bp, Homo sapiens
ggtgcgcgcacatagtgtatggtactggtaggtgctcattagatatagaatgactgaatcaataaaagccggatgccctggctcatgcctgtaatcccagcagtttgggaggctgaggtgggcagatcacttaaggtcaggagttagagatcagtctggccaacatggtgaaaccctgtctctaccaaaaatacaaaaattagccgggcatggtggcccatgcctatagtcccagctacttgggaagctgaggcaggagaatggcgtgaacccgggaggcagagcttgcagtgagccaagatcacaccactgcactccagcctgggtgacagagcaagactctgtctttaaaaaaaaaagaaaacaaaagaattaagcttaaaatacatttttacttagtga

SEQ ID NO: 492779 - DNA, 159 bp, Homo sapiens
cgacaccatagaatgcgtgggccatttgtatgtcttctttgagaaatgtctgtcatatccttggcacattttaaaatggggttgttttcttaccattgagttgtgtaagttccttatatatttgggatattagcttcatcaaatgtatggtgtgaaaat

SEQ ID NO: 492780 - DNA, 1554 bp, Homo sapiens
gcacagcctcccttccttctttctccctccgcactcccgagacaccagccgcgctctgagctgccccacagggatccctcacacccgccgaccagcagcccatattggagggaggaagtaagggacagaggagagtgaaggggagcctggaccgactacccagacagagccggatgaatgggtttgtggtgaccagcacgaacaacaaaaaaaaaagagaagcagagagagaaaaaaagacagaagaaacaaaaagaaagcccagacacaacaaccagacaaagactaaaacacaaagagacgaaaacgacaaagaaacaaaccgaaacaaaaaaaaaaagataggaacacagcacaacacacaagatgagcacgacacaaacaatatcacaaagagagagagagaagagaacaccaaaggaaggagagaccgaagacaccaaaagagagtaacatgtaaagccaacaaaaaataaagaacccacgagagaaacaaggggcaaaataatgaggataagagggcagaaaagtataagacacaaacaagcacaacgagcgaaacaacagaaacgaacaaccgagaacaaaaaaagggagaccaacaaaaaaaaaaagtaacataagccggagaaaagagaaaaaaaaagaacaagaaggaggatttgcaagaacatgcaagagcgccagcagagacgaagacagcgcaggacggggcgcacagcaagacgggcacagacgcaacacatagcacgtgaggtcggcaaacacgcacagaacgcaaactgaccagagggagcaagaacgacaggagcggcaagaaacaaggcaacaccacacagactcaacacgaccaacaggacgagaaacgatagacacggcgacagaagagcacaaccaacgagagaagacacaacgcgcgacaccaaaaaggaaagcgaacgaacaccaatacacacagcaaccaacacaacgacaacacaagtcatcaacgggaaccacatcaatggcggaaacagaacacacccaacgacagaacaatgagaaccacactagaacgaaaaagacaaaaagaaacaaaagcgccacagcgacagaaacacaaatataaaattaactcatgacactctcaacgatcattaaaacatagataatagaatctacagtaaacaacaaacatacaccaacaaaacaaccaacataccagaacaacataacctagaacattacagacgccaagacggccctcacccacacgacaccacacaaaactacacggtgagaatacgctggacccagaaaagctacgcacgggaacgaccagatgatgctgagaagaaacgacagcaaacagagccatggaagacggcacgcaaagaaagacagacctaccagagcgaaagcacaaagacagaaaccataagtgaaacacagaacaagaacaacaatcagagacgacaatcactagtagtacagagccaaacacacacagaagagaccgacagacacacgcagcgaccactacacgagaaagagcagacacgctgactgaacgcg

SEQ ID NO: 492781 - DNA, 411 bp, Homo sapiens
  misc_feature (39)..(39): n is a, c, g, or t
tggcctttactggatacagctatcacgcgcgtacgtggnagaacgtgctgagaatccactatgatagggaaacatttcattcccaaagaaaaaaaaatttctcttctgccgggtaataggtagttctgaacgttagatatatatatatccatggggtcaaaaggtacctaagtataatgattgcgagtggaaaaataggggacagaaatcaggtattggcagtttttccattttcatttgtgtgtagaatttttaatataaaatgcggagacgtaaagcatataatgcaagttaaaatgtttcagtgaacaagtttacagcggttcaactttataatatttataaataaacctgttaaatatttctggacaatgccagcatttggataattttaaaaacaagtaaatatct

SEQ ID NO: 492782 - DNA, 359 bp, Homo sapiens
  misc_feature (82)..(83): n is a, c, g, or t
  misc_feature (105)..(105): n is a, c, g, or t
  misc_feature (209)..(209): n is a, c, g, or t
  misc_feature (252)..(253): n is a, c, g, or t
cgtcatctactctaccatctttgcaggcacactcatcacagcgctaagctcgcacgtgattttttaccccgtgagtcaggcnnctagaacataaacagtgctagncttttattccagttctaaccaaaaaaataaaccctcgttccacagaagctgccatcaagtatttcctcacgcaagcaccgcatccataagtccttctaactagncgtaggtccgtcgtttccaagcaaagtagtaactccttcccgnngacacatgcaaccgataaccagatactaccaatcaatactcatcattaataatcataatggctatagcaataacaacttagcgaactacgcccccacatgtctcga

SEQ ID NO: 492783 - DNA, 455 bp, Homo sapiens
cattgcagaaagaaaaggcagtccaatgataattttagagttgttttgtaggatgcaaagaaattggatagtggccactcatacgttgtggtgagatataaatagtagagccactgtggaaaatattcttggcagtttcttataaaactaaacatacatttaacataaactggcatttgacacttgcagttatccctgagaagttaaaacttaacattcacaaatgttacatagcccttcattataatagccaacccggacaactgatgtccttcaaaaagagtgaatggtttagtatgtcccaccatggaatataaatagtaatatgaaggaacaactctatacatgacaaatgcatggacctcaaggaattatgcttgggtggtttggggggcaatctaagttttacaccgtatatttgctttgtaacattttaataataagaaataaatggg

SEQ ID NO: 492784 - DNA, 346 bp, Homo sapiens
agtgcatggcacttcctccattggtgctggtgcttcgagaaggcctagtgcacccctgctgagtgcccacgtcaatcatgcctgtgagcgaggggcgtggctggccgcctgagacctgagctgctgtgaaagcccctgcatcaatcagccagggagtaactgggcgggtttagtggcccctagtgcccactcctcatgcagcagtgtgctggggcgacagctcgtctcccctctcttaagtcacccgtgtcctcaccatgccccactgttgggcctatagtagcacgttagtgagtacctagggcggctcaactcctcccacagcaccagtccacaattgccccga

SEQ ID NO: 492785 - DNA, 199 bp, Homo sapiens
atatcctcatacttcaaggcacatgttccaaagtactataccaaaaatattccttgcttactgtagccagaagtatcctttctggctccatgtgtatagtccctgccttttttttttattgttttattggatacctatagccttcggcttggaaatagggtacctcacaaataactcttctttggaagggaaaagggcc

SEQ ID NO: 492786 - DNA, 675 bp, Homo sapiens
  misc_feature (558)..(558): n is a, c, g, or t
gttggtacttcctagagacttgttatattgttgtgagcaaaatgccaatagtgatacagactatgaagtccaggctgaggttgtctcagatggagatgaagaacttattgggaaccgaagcaaaggtcacttttgttatgtgctagcaaagaagttggaggcattatgctcctgccccagagatctgtggaacattgaacttgagagaaatgatttagggtatctggcagaataaatttctaagcagcaaagtgttcaagatgtaacctggccgcttctaacagcatatggtcctatgcatgggcaaagagatgatctgaaacaggaacttatatttaaaagggaagcagagcataaaagtttagaaaatttgcatcctgaccatgtggtaaaaaagaaaaactaattgtctggggagaattcaagctggctgcagaaatttgcataagaggacctcgatgttaatagccatgacaatggggaaaaatcatcccaggcatctcagagacctttacggcagtcccttccatatttgcccatggacctaggacggatgtntttggggccaagcccagggcttcagctgcctacatattctcaggacactggtccctgtgtccaactggtttagcttcaacgttggctgggccccagatgggttaagccgctgatcgg

SEQ ID NO: 492787 - DNA, 578 bp, Homo sapiens
  misc_feature (404)..(404): n is a, c, g, or t
  misc_feature (413)..(413): n is a, c, g, or t
  misc_feature (488)..(488): n is a, c, g, or t
  misc_feature (525)..(525): n is a, c, g, or t
  misc_feature (531)..(531): n is a, c, g, or t
  misc_feature (569)..(569): n is a, c, g, or t
aggtaagccaaaagcaattcttttcagctttggaacatacttaaggcttctgcgcaggctcgctctcatcagatttctaacctttctaaataacaaggccatactgtgaagactgtaaactctggaagtgactaaaaatgtggtcaggcttctgccttgcacctgtcagtccttaaacctttttggaacaccagactccaggctcagcataaccatgctttcaaagctgtcactggaagacagaaagtgaagattttcttttaagagtccatctagtgtgaattcgaaattcagatatcttcttttttaactgctgtagtgtcagtaaaacacttggcagataataggttcccaggagttctcaaaataagtctgagtgattggggtaatcggctgctcctttngtccctggnctttgtgacttagggaatacctcgttctcttcccctggatcccatgccctgttccaactggggccctgttaaggntgtgtgttcttcccgcaggttggctgggagagcgatnacgttntacaaatttgttctgtgacccagattgccctcttcttncatgggctt

SEQ ID NO: 492788 - DNA, 122 bp, Homo sapiens
  misc_feature (116)..(116): n is a, c, g, or t
gccagcgccgaggacaccaagaaggttttggacagcgtgggcatcgaggcggacaacaaccagctcaacaaggccattagtgagctgaatgaaaaaaacattgaagacgttattgnccagga

SEQ ID NO: 492789 - DNA, 536 bp, Homo sapiens
  misc_feature (245)..(245): n is a, c, g, or t
  misc_feature (263)..(263): n is a, c, g, or t
aatgaactggatagaactgtaaagttaaataacagtagatagacaggtccagtatataataagctaatgaaggaaggcacccccctggataggactcataaccttaatgtgaaggagagccatcttactgatgaggttgaaaacaattcttatttgatttgatacaacagagggctcttcactaactaataggggaaaaccaattgcattcagatgcacatggccaggtcgaatgtataaaatanaatgtgtactctggaaancagtctgcccttgatctcctggaaattgattatctcagggatgccaagatgacaggaaatgttaactgactcccagtgtgacaaggtctacgggacttagaacagggataaaggcatttacagataaagtaaaaagaaacttggaaatcaaaatataaaaagttgtgaatatggatattggcaccaacaataatagtggagaaaaggatggagaataaaaggtaaatggggctgggcgtaatggctcacgtctgtaatcccagcctgatgttg

SEQ ID NO: 492790 - DNA, 347 bp, Homo sapiens
  misc_feature (16)..(16): n is a, c, g, or t
  misc_feature (25)..(25): n is a, c, g, or t
  misc_feature (35)..(36): n is a, c, g, or t
  misc_feature (44)..(44): n is a, c, g, or t
  misc_feature (55)..(55): n is a, c, g, or t
  misc_feature (72)..(72): n is a, c, g, or t
  misc_feature (78)..(78): n is a, c, g, or t
  misc_feature (95)..(95): n is a, c, g, or t
  misc_feature (106)..(106): n is a, c, g, or t
  misc_feature (115)..(115): n is a, c, g, or t
  misc_feature (151)..(151): n is a, c, g, or t
  misc_feature (156)..(156): n is a, c, g, or t
  misc_feature (159)..(160): n is a, c, g, or t
  misc_feature (164)..(165): n is a, c, g, or t
  misc_feature (167)..(167): n is a, c, g, or t
  misc_feature (173)..(173): n is a, c, g, or t
  misc_feature (177)..(177): n is a, c, g, or t
  misc_feature (180)..(180): n is a, c, g, or t
  misc_feature (240)..(240): n is a, c, g, or t
  misc_feature (243)..(243): n is a, c, g, or t
  misc_feature (267)..(267): n is a, c, g, or t
  misc_feature (287)..(287): n is a, c, g, or t
  misc_feature (301)..(301): n is a, c, g, or t
  misc_feature (310)..(310): n is a, c, g, or t
  misc_feature (344)..(344): n is a, c, g, or t
aggcatccccgtgccnatgtccccnggtggtggcnncagatccngtggccggccnggcggacgggaccgggngatacntgtatattacacagtcnggatttcagangatttcaanggtaatcgatttaaaaaagaatattctatacaagcnttttnaannggtnnanggcttnaaangcntgtgttgtgcgcgttggggatgggaggaggggctgaggagcggctcagtgtcacctcccncanccaccggccctgacccgtaatccngacaccgatggaagtcgacntttcatatctttcncgggaaatnaactctgttttaaattggaataaatttgttccgnaat

SEQ ID NO: 492791 - DNA, 548 bp, Homo sapiens
  misc_feature (9)..(9): n is a, c, g, or t
  misc_feature (24)..(24): n is a, c, g, or t
  misc_feature (44)..(44): n is a, c, g, or t
  misc_feature (51)..(51): n is a, c, g, or t
  misc_feature (147)..(147): n is a, c, g, or t
  misc_feature (151)..(151): n is a, c, g, or t
  misc_feature (211)..(211): n is a, c, g, or t
  misc_feature (222)..(223): n is a, c, g, or t
tatgtaccntcaaggccaaagagnaaagcattgaattccaaccngggcaanagaattattattattattttttaagagataggaaatcattttattggttcagggtggagaacagttgggcgatcatagctcactgtaattttgaanaagnggaattcaagtgttccttcctaccttcagccttttaggtagtgggaattaggggtgtgtnccaccaaaacnnggtaatttttctattttttttcaatagatgggtcttgctgtgctgcccaggctggtcttgaactcctgagctcaagcaatccccttgcctcagcttcccaaagtatggggattacgggcgtgagccattgtgcctggcccaaaatttttcaaatatcatccttttaagcttcaaatgttaccaacattggcgaatgcaaccagaggagacataacacataaaacatggggggtttatccacaaggagaattcactatcttgctggtgttaggatctgtccttccagggaggatacgccatgagtcagaagtagatgccactcagc

SEQ ID NO: 492792 - DNA, 670 bp, Homo sapiens
  misc_feature (450)..(450): n is a, c, g, or t
  misc_feature (459)..(459): n is a, c, g, or t
agcggacggggagcgccttccggagagacgcagtcggatggcaacccgggatgggtcgctggtgccagaacgtcgcgcgcgggcagcgcccccggacgtctggcccctcccgcgccggtgccctgctgctgtcctgcttctgttgctgaggtctgcaggttgctggggcgcagggagaagccccggagggcgctgtccactggcatgatccgctgccgacacatgagcgtccagtgtgtccccgaaggactcacctgtccttccagaccgtgcgctcgctctatctcatggcagacctccgatccacgcacagtagcactgtcctctcgaacacacgccaatgtgaaacccaatataccagttttcatgacaggcaaagatcagacccagtatcgctgcactgtggaccttttctctatcggacgcagagactcgccataccctcagggnaaccgcagnaagctcgtggtctcgtgcgagtggagcctggaatgggtcagcagtgtcgggctcgaatggacatcactacatctagtgccggtcacgcattcattgcctctccatgtgggtgtctgacctcgtggcccactgggcctgcatctgggacgtgactgtatatctacttcagatgaggagtggggagatccagtagggattgatccagtatgat

SEQ ID NO: 492793 - DNA, 127 bp, Homo sapiens
ccaggacgtggtcatgcctataatcccagcactttgagaggctaaggcaggaggatcgcttgagcccaggagttctgggctgtagtgcgctatgccgatcgggtgtccgcactaagttcggcatcaa

SEQ ID NO: 492794 - DNA, 230 bp, Homo sapiens
  misc_feature (53)..(53): n is a, c, g, or t
atcgattatattccaagtctctctggacacaaatgaacagtactacagagganaaccctccaagaacaccaggagactgggcatgggggctcaggcctgtcatcctagcactttgagaggctgaggtgggaggattgcttgagtccaagagcctaagaccagcctgggcaacatggcaagaccttctccctactgtaaaaaaagaacagcagaaaattattttaagcttg

SEQ ID NO: 492795 - DNA, 679 bp, Homo sapiens
  misc_feature (360)..(360): n is a, c, g, or t
  misc_feature (669)..(669): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatggtgcgtgcgggcgcggatctcctcccctggtcctccgcaccgtccccgagtcgttctccgctctggcagaacgcgagcgccgtccggttcccgctcccgctggcccagcagccccgggctggactcggcgtagggtccgcacgggatgggctggggctncgcgcccgct

SEQ ID NO: 492796 - DNA, 1315 bp, Homo sapiens
ggacgcgtaggtcgaaccacgcgatcggagcagtgcccgagcgcggtttcatcttaaggttctgcagggcaaggctgtctgggacatggcttggccatggatccagctctcagagctgcaggatgatctagaccttggacatgacaccagcgaggcatctgaaccagctgaagctggacatccatcgcatgcacaagaactgggccctcgcgatgcaacatgacatgacattccccaaagtcaagatgacctccaaaacgcagaatcccacggaactatgtcacaacacactgaacgtgggcatgaccacatacatctgcacatcagaaccgggacaccacgatcgctggcacggtggcacggcagatgcacaacgtatgcggacgagcaagatccatcagatgtaatcacgtgcactgatcgaaactgacccactccaagacacacacacgctacgaacaacatgacacagactccatgagaggatacctggacacgcacaacaccccccagagcgagcaagctacccgatgagaacacacggctgcaccacacaacaccaacacaggaacatcaagcacaccacacggacactgaaccacagcgcaacaaccacagaccacaaccaccaacagacaggacaacacagacaacactgccatacaacgaaacaaataaaagcacacgaacaaagatacacaaagaaagcaaacaatacaaacgagacacacaggcaacaaatccagaagccaatcaccaacacacagtaggcaccgaacaacaacaacaacacagcaacacacccccacaataaccacaacaccccaataaatcacaagaattataccaaccgaaataccagggacatcaaaacgaaaaaacatatacacatgacagaaacatccaccaagaaaacacaacgacagaacacacaccgacacactataaccacgaaaggaacgcaaacaaaaagagagcaaaacaaccaaagagaccaacacagagacaccacacacacaccacaacacgacacaaccagtacagctgaacaaactatcatcacacacaccaaaaaaacaaatcaaccaccacaccaacaaacacaaacaaacaatcaacccaatcaaataactatactatgcaaacacgaacaacacaaccatacaaaacaaccacaccatcacacaaacaccaaaccaacaacaccaacaacacaactataaacacgaaagacacaataaaataatcaaacaataaaacacaataaaacacaacacaccaacaacacacccaacaacaaacaacaaaaacataa

SEQ ID NO: 492797 - DNA, 656 bp, Homo sapiens
  misc_feature (16)..(16): n is a, c, g, or t
ccggggccagcggcgntggggtcggcgctggggtcgtcgtccgggccgggtgggctgcggcgcgcggcaggcgctctggcctggcctggccgccgctgagcagtcggggccggtgggtggcctcgaacgccgggacagaccgacagacggactggccggcggtcccgcgcccccgagcggagcgggcgggacggaaacgtccgggcaagttggggtcggcagggttggaagcccagcgaggctagaggccagtcccaaagtttccaggcatcagggctgcagcccaggagcctcaaggcggcccggcgggcgactggacggccggacaggtcaggtgtctccatgctggcctccccgcctcagggcttcatcccactccgtgggcctgatctccctggggcacctgggatgtccatctgcgttagctggagctactccatggcctgtggcgtgccacacacagcggcatttcggtgtcattaggcacagctggaggtgcaaggaggagggcagcctcatgtccagttccatgtaacttgcttcttctgaataaaggcaatttgctaactttctcgctaaaaggatttggtttctatggcttttaaagcttctccgataaaatacttgcaacaagggaactctctcctcctacactc

SEQ ID NO: 492798 - DNA, 694 bp, Homo sapiens
gaggacccccaacgcgcgtcacacatatatatgataaggggctgtatctggaatatataaataactcttataacacaacaataaggagaaaaataaatcaatttaaaaatgggctaacggtttgaatagacatttctccaaagaagatatgcaaatggctaataagcacatgaaaaaatactcaacattattattcattagggaaatgcaagtcaaaatcacaatgagattccagtttacaatcactaggatggctacaataaaaagatggacaagaacaagtgtcggtgaggatgtagagaaactggtagaaatttaaattgttggtgggaatgtaaatggtgcacctgctgtgaaaaacagtttggcagtacctcaaaaagttaaacgtagagtgaccatatgacccaggaatgccactcctaggtatttacccaagagaaatgaaaacgtacatacacacaaaaacttgtacaccaatgttcatagcaacattatttgtaatagccaaaaagtggaaacaacccaaatgtctaccaactgatgaatgggaaataaaatgtggtctgtccacgcaatggaacattattagactctaaaaagaaatgaagtactcacacatgccacaacatggatgagccttgaaaacttgctaagtgaaagaagccggtgcaaagccccatatgtctgctgc

SEQ ID NO: 492799 - DNA, 229 bp, Homo sapiens
tagctctacgactcccgtaccctacactttgcctcgtgttcacgtgcggcacgggcatgcgcgcctgcggctccggctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 492800 - DNA, 3599 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 492801 - DNA, 3490 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggacaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 492802 - DNA, 141 bp, Homo sapiens
gtgcgtatagtccgcctggataccagaagcaccagacgaattcccttagcaccagcacaattcccttagcaccagcacgaataccttagcacagcacgaatacccttagcaccagcacaaagcaccagcacgaataccctt

SEQ ID NO: 492803 - DNA, 881 bp, Homo sapiens
  misc_feature (17)..(17): n is a, c, g, or t
gcgaagaagaaaagaanactaccctcctccgtcgctggttctaccagtgtcgttttatatctcttttgtacgtacctttgggcctgttttctaagtcttttagcgtaacatctgccgcgccctcatatcagttcccggttttgtatctccaggtaaccttcgatatagtgctttataactgcattgtgtcctgtacaataggtggcatgtgcacgaccaacgggcttttcttagtgaacccccccgcccgcctcctggtatttgtacattaagccccaacatcttgctccttcctcgttttaccagcttaccttttctcccccaagatgtcccccttgcaagcaaataaaaacggcggatcacccagaaggacttcccccactttcttgtgccctccctcaacaattctttatctcattattccccgtctatctgaatcactcatatattttaagcgccacacaattaccctttgtttgtcagaccacctcatataatcactcggcactctataggaacccacttccaaaaccctcctccgataatatattgattagaatcactcgggaacaaagaactcaaaatttcataatgccccgagggctccaccaacctcctcttaccaatctttccccctcctggaagtgaattctccctccccaccaccttggtggctgtcccaatagcagccctcaccttgtaacatttttttacccaccacccttcgatttcttcaaaactcatggacacccccgcccctccttttaaaaccgtacaatcatgcctttttcatataaaagactccccctctttcaagaaaataacattttgggacacacagttgtccccgtttggaaaacaaaaaaacgccccacaaaaca

SEQ ID NO: 492804 - DNA, 3641 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccacggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 492805 - DNA, 3354 bp, Homo sapiens
  misc_feature (16)..(16): n is a, c, g, or t
ccggggccagcggcgntggggtcggcgctggggtcgtcgtccgggccgggtgggctgcggcgcgcggcaggcgctctggcctggcctggccgccgctgagcagtcggggccggtgggtggcctcgaacgccgggacagaccgacagacggactggccggcggtcccgcgcccccgagcggagcgggcgggacggaaacgtccgggcaagttggggtcggcagggttggaagcccagcgaggctagaggccagtcccaaagtttccaggcatcagggctgcagcccaggagcctcaaggcggcccggcgggcgactggacggccggacaggtcccgagcagcccggcccaccacggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgtacaagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 492806 - DNA, 81 bp, Homo sapiens
gctgaggacactgccgtgtattactgtgcgaggctgagttcagctacatctgtacccccgttcgacttctggggccaggga

SEQ ID NO: 492807 - DNA, 3291 bp, Homo sapiens
  misc_feature (16)..(16): n is a, c, g, or t
ccggggccagcggcgntggggtcggcgctggggtcgtcgtccgggccgggtgggctgcggcgcgcggcaggcgctctggcctggcctggccgccgctgagcagtcggggccggtgggtggcctcgaacgccgggacagaccgacagacggactggccggcggtcccgcgcccccgagcggagcgggcgggacggaaacgtccgggcaagttggggtcggcagggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 492808 - DNA, 245 bp, Homo sapiens
  misc_feature (191)..(191): n is a, c, g, or t
  misc_feature (226)..(226): n is a, c, g, or t
  misc_feature (238)..(238): n is a, c, g, or t
atgaatgagagtgatctgggtatacggattgtgtatccggacacttagactgaagtatatcagctgaaggagctttgggctgagactatgggtttattagatatagaattaagtcatctgcaacggagacgtagtttgacttcccgtcttcctatttgaataccctgttatttctctcgtcttgcctgacntgccctggcccaggacttccaggtactatgttganataggagtggtngggagac

SEQ ID NO: 492809 - DNA, 852 bp, Homo sapiens
gagtgaggcgtcgtccgtactggaggctagctcttgtcgcggcgcggcgagataacatcgtttttccaatctgtccgggttgccgccacccaagaagagccagaatgtcaggatgcgtgaacagccagtttgaggatgaccccttcttctctgagtccattctggcactctcgagaaaatatgcgaagatgataagaagttttgctgaacccttgtggaaagagattgctcagtatctctgatggtagagggagagctcataatcgtacgaggacataatgatggtgaagatgcttgtgatcatacagatgtcagttctttccagacaattggaccaaatggtgtcaaatatgagaaattatatgcagaatttagaaagaaagttcggtcaactttcagtggatccaaatgggctttcatttgtgtcttcctcagttatgattattccaaaaataggagatgaacgcgcaaaggtttttcaggctcaaatcaaactcgtcgaaggtcaggaggaataaaggaaaccaggaaaagcaatgagagattctgacagtggactaggagaaaaatggtattggtcatcatatcatgaccgagctcatgtcatttacaaagtcaagacacagaagactgtcgatgcagaggtcacccggagttcatccatatgaatgaagcgaatgctcatgctgatgaggagtggcaaacgagggtggaattcaaaccgggggacaaattaggaaaactagatggaggtgggctggaatctgtggccggagataagagggaacttcaaggcgcatggatgagagccatggtggacacaaggttgtagaaaaaggtttgaaaaaaaag

SEQ ID NO: 492810 - DNA, 3383 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcagggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 492811 - DNA, 3692 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctgtgagtgtggggtgggcacacagctgcagccggcctcttgctgtgctgcctgggggcagtcccaggtcccagaccaacctccctgctccacagagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 492812 - DNA, 343 bp, Homo sapiens
gaaccatagccattaactaacccaaggtcctaccttctcttccctatacacagccaaaattctatttcatgcaaaaacattttggcagtttgtcagttcctgaaatctctggctctgttatccaggttccccaacccctcccaggcctcttctcaacacagcaagttggctcttatcattgccactatattaggtcccccaaagtaactcctcacatggggttcattaaaatcttcaaggatatagccagctcctgatggaaggtgggagttcgtgtatactgcttgcccaaaccaggcctttccaaaaattgggtattaaaaaaaaaaccaagataataaaa

SEQ ID NO: 492813 - DNA, 898 bp, Homo sapiens
atcttaaagccaccattgcgttcctcattgtgaactgtcttctcatattttaagtcaagtctataagatcatttttaacctaagtccaacttgttgactccttaaaataagcacccatgaaagccagccagcccttcctccttccctcaccaccctccgtctcttcgtccctcaccaccctccgtctcttcggctgcctgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaaccttggtggcactgggaagctctggcctgagagttaaacacccatgctgaatggtacagtgtgcattctctccagctgaaaactttcttcaactttcctaaattcttactaaattcagaggaatcaggataaagatcacttagagaaagggtgcttatggacatagcctgagtttcctttaacctctctccaatgggtgctttaactagcttctacatggcaagctgtttcagtttgcaaaatcactgcccagcatgtttgaggtcagttggcaccttaaaacacctgttctccagccttggacagtggagagaatctgtaaagtgtgaacccctctaaagatatcgttcaaatgatcagattcgggtccagttatcttgttgagtttccctaaga

SEQ ID NO: 492814 - DNA, 167 bp, Homo sapiens
aagcttcttgcttcacgtcgcgcgtcaggatcttcagcattggatagggagcggctgcacgaactgctgcttcgatactagctttcatgtcgggatcagaagaattaacaatcacagacataactgcaccactatcattgagtgtgacccgagctgtagctttttga

SEQ ID NO: 492815 - DNA, 277 bp, Homo sapiens
tagcgacggttgtggttgtggcgatagcgtatggctgggtcactttgctgtacagcagaaattgacaaaacattgtaagttaactattctttaattcttttaaaagaaaattatgcaaacggaatgttttagagttgatggcacctattactcataacatagaagtattatactagacaatgcatttgagctttcagttagtgggacacttggatttcattcattcccagattcacataaatctcaccaaacttcacataagccattgtcatcattc

SEQ ID NO: 492816 - DNA, 732 bp, Homo sapiens
  misc_feature (29)..(29): n is a, c, g, or t
  misc_feature (61)..(61): n is a, c, g, or t
  misc_feature (90)..(90): n is a, c, g, or t
  misc_feature (177)..(177): n is a, c, g, or t
  misc_feature (218)..(218): n is a, c, g, or t
  misc_feature (220)..(220): n is a, c, g, or t
  misc_feature (341)..(341): n is a, c, g, or t
  misc_feature (365)..(365): n is a, c, g, or t
  misc_feature (369)..(369): n is a, c, g, or t
  misc_feature (386)..(386): n is a, c, g, or t
  misc_feature (410)..(410): n is a, c, g, or t
  misc_feature (425)..(425): n is a, c, g, or t
  misc_feature (443)..(443): n is a, c, g, or t
  misc_feature (487)..(487): n is a, c, g, or t
  misc_feature (489)..(489): n is a, c, g, or t
  misc_feature (495)..(495): n is a, c, g, or t
  misc_feature (497)..(497): n is a, c, g, or t
  misc_feature (501)..(501): n is a, c, g, or t
  misc_feature (521)..(521): n is a, c, g, or t
  misc_feature (546)..(546): n is a, c, g, or t
  misc_feature (591)..(591): n is a, c, g, or t
  misc_feature (604)..(604): n is a, c, g, or t
  misc_feature (622)..(622): n is a, c, g, or t
  misc_feature (629)..(629): n is a, c, g, or t
  misc_feature (631)..(632): n is a, c, g, or t
  misc_feature (634)..(634): n is a, c, g, or t
  misc_feature (636)..(636): n is a, c, g, or t
  misc_feature (638)..(638): n is a, c, g, or t
  misc_feature (647)..(647): n is a, c, g, or t
  misc_feature (659)..(659): n is a, c, g, or t
  misc_feature (684)..(684): n is a, c, g, or t
atcaccaccaaagatcccatattcaacantcaaactgcaacataaacaacagaatttattntcagtgacagtacttactcggtggcatcnccttactctacaatacctgcccctactactactcctcctgctccagcttccacttctattccacggagaaaaaaattgatttgtgtnacagaagtttttatggaaactagcaccatgtctacagaaantnaatcatttgttgaaaataaagtagcattcaagaatgaagctgctgggtttggaggtgtctccacggctctgctagtgcttgctctcctcttctttggtgctgtagctggtcttggattttnttatgtcaaaaggtatgtgaaggncttnccttttacaaacaagantcagcagaaggaaatgatcgaaancaaagtagtaaaggnggagaaggtcaatgatanaaaccctaatgaggaatcaaagaaaactgataaaaacccagaananttcaanantccnagcaaaaatattgtgtgatncctggaagctgtaagtttagatganatagaaatgaggagaaacatctgaggctggtttctttttatgttncttaccctgcccnagctggggttatcaaaanggctaangnncnananaagaaagtncacccttggttnctaactggaatcagctcaggactgncattggactatggagtgcaccaaagagaatgcccttctccttattgta

SEQ ID NO: 492817 - DNA, 782 bp, Homo sapiens
ggcgcccagacaggaggcccgactctgtgtcttctccgccgagagtgcacgtcagaagttggaccaaggaaggcgggcactgtccgatctcgacctcatgctgccgatgccagccgtggaccgtgcagagggttatccgcacctcatccagcttccctcgtgagctgttcatgcaactgcgcgatgcgcatctccaggaggctcctacggtcagtcgtgctccatggggcaccatgaagcccatctctgggattgccatggccaagaatgaatcaccagaaaagggccctcgccgttcctttgcgggtccagccttgttgggtccccatgactctggccgggcgtgggactgatcccaacatcgctcaggtcccggggcaccccttcccaaacctttgcccagcttgacagttcttgagacttggactactgcttggttgcgcaagttgccggggagggaaacccctttgcgcaggtcgactatgtaccagaccccaacgtccaccagggcactcaccaggatccccgtgataagggcgatgcatgcgactgggcgcgcgacgcaacctcggagagacgagggcgacgccgtcgagcactgcaaccacaaccaggcactcgcccacctcgcaccgcaccggcatccggaaatgacggctcacaaaaccacgcgacacataacgaaagacccccaccgccagccacgccccgcgcaaccacccaccactccgcacacaagcacaaacacgaaaatcccacacacgccgcacgccgcacacgcc

SEQ ID NO: 492818 - DNA, 838 bp, Homo sapiens
gcccttcccgggggcggcagcggctggtcgcgggcggctctgcatggtgcgggggcgtggagccctgggatcagatgcgaccgagtcgcgcggagtcgtcgcgcggagcatcggtcttggatgctgtcctgtccgcttgtggtcctgttccgggatggtccggaagaatccttggcgtgaagatggcgcgtcacgacgcaggcgacccgatggtaccctggacggttgcagtcatgaatggctcgtctaatggtcatggaagctgctgagacaaggagaaggtccttgcatgagtgtgtcgcggagagtgcatggagagtagcagtgagaatgaactgcaaaggctgtattacccttgaagtgtatggtatacgacgtggttaggacacaacttgggaacacgtgcaccgtacgcccgaaaagcaaaagtccgactagaagagttcttttctatgccctcgttcaatcatagtgagatggtaggttccccgatggcgtaacgaggggacatagacctgggccattgaatcgggcaccatgcagttttggagagtgctttcaaagcagcgtggggatttgctcctacaaaaggagggaaaatcacagcattggtgaaagtaaccgacatggggctttgccgtttctttgcgtaggcacttgttggtgaagtagctttcattatgtaaccaaaacacgatggggcgagacccaaaagttcccagtagtaatccggcgtaccagggattggcatccctgtaacttggcatccagttcccctcgaaggcaaaggggtctcctgcgcccgaaagttctcgcgaaccgacacggtgttactggg

SEQ ID NO: 492819 - DNA, 181 bp, Homo sapiens
cgtcgacgcaaatgaaaaatgttacaactactggatattctgtctgtgtatgtgttgtgtgtgatgtttatataaaagagctctaattaactagcttaaagaaaaataagcacttaaatcagatattttgtcagaaaaactaaaactaatgagctagtttagttcatataactttcgtaat

SEQ ID NO: 492820 - DNA, 967 bp, Homo sapiens
tggagccctccggaaacctctgactggccagccccactacttctgcacccagatgcaacctcgcagtccatgctcccagggccccgacactgcacccagaacttcaccccctgcaggaggaagccagaggcccccaggagtcaccacagaaaatgtcagagtgaggtcagtggcggagccacagtgaggaggaagaggagaagcgaggcggcaacgcacggacaaagcgcacgcaggtgggcagcatggtaggccccagggaagcacgaagcgaggcaggcagcacggcacgacgcaagcagccacaggaccgagcacctgacgctgcgcaaccgtgaactctgctcgccccctttgattccgcttgttgttcccccccttggaaggtgcggccctgaaggtggactgttaccggggtgcaagagggaaattgtctataactccaagaggcatcacttttcatggcccccacaccttggttcagaacagttggcaaaccatcccaaaggccacacatacggacacccatttgcgaagccgaccgtggggaggacttcccagcaagcatccagggacgggcacgcacttgacgaataaacaggcccgtgacggggcacccaaagggacccaacaaggatcggcccccgaaagtgcacccaccggctgcgtccagaactcctagcctcaccctggccagagcccccccaattcccttccaaggatccatagaagctgttcataccattaccattcctttgcccccttggaaccctgagcacaaatacaccaggtatcgccataatatagaggatacgcatagcacccatttgatttcgccccacacagacaagattcgtacccaaaggaacacactagacattagcaccggtgttggacccccaaatatccaaccaaaacatggtgaggcgtacagagaacacagcgtctggggggaaactgcgccatg

SEQ ID NO: 492821 - DNA, 494 bp, Homo sapiens
caggaagagagagtcctgcagaaagacgtgctacatcaggagccccctgctgagccccatccccagaaccacagggatccttggggtgggtttgctttaacatagtgtatttcctcagtgtgaataggccctgattttatggagcccatgagccaccagccttcttctgggtctgcttccctttgattttctaacaactccccttgagagaactgaggtgactaccctgtcactgtgtccaagaccagagataagctgtaggtttgtgatgctaaatctgtagtgagagaatggtgcttagcataattttgtgtttggttttctgtttggagttttgctcttagatgttttggttttcttattgatatgctatttgttcttattatttttcaaaaattgctagcatcattcactgtttatactgacttctgtttttaatgcccattaagagaatgttttatgaataataaacttttgtaactcttcaaaaaaaa

SEQ ID NO: 492822 - DNA, 683 bp, Homo sapiens
atattatcatatgtattggttgagcactcctgggacgtctctatgcaatactactatatcgctcacatctcatatcctccctactatgccctagagaggaatacgtactagcgctgattggcattatagcgtactctcataaccctcaacacccagtccctcttagccaatattgtgcctattgccatagtagtctttgtccgactgcgcaagctagcgcgtggagcctagcacctactaagtctcaagtctccaacacatatggcctagactaggtacattaacctaaacctagtccaatgctacaaagctatatcgtacccaagaatgatattactaccactgacatgactttccaaaaaacacataatttcgaatcaactcaacgccaacaccgacaagccttaattatatagctatctatccctcgtacgtatctttttaacgcagaatcgaactaatctaatcttattgtatgcttcgttcacacacaaagcattgtcgatccagagcgcgactaaacgagagcccgcacacttgcctatagtacttagtcgtcactcttgactttcgtgaaccactctcgtagtacttcgagtcaagtcaaatgggacacttgtatcacagttgaacccaattgatcacgaatgaccaccataccgtcgtgaatactattgctcact

SEQ ID NO: 492823 - DNA, 133 bp, Homo sapiens
  misc_feature (2)..(2): n is a, c, g, or t
tnttagcaagtaaataaaagcagtttagtatatcggccggattcatataatccagaatctaaccaaaatatgataataaaattcagtaaaatggttgaccacattaataaaggtggctatggaaacttctaaa

SEQ ID NO: 492824 - DNA, 350 bp, Homo sapiens
ctgttactcgtctctacagtatccccctctgtatccctgagcacctgtgccacggagggttgctcgatagccattattccagaatcttgcgactggtggtggtgtctgtcagacacacacaggtcgccagtgatctctcacacccacctcatgctccagaaccatcgcctttgtgtactgctgtcctagtctcagtacccggtacacacctctcctacgttttgtccatgaggatttacctttcaccctcgactgatccgtgaaagcaccgcttcaagttctctcagcattatggatctgttttcactgttttctataactgacggatgtcaggtgcgcgtttcctgata

SEQ ID NO: 492825 - DNA, 231 bp, Homo sapiens
tcgctgctcatttccaaatagctgggattataggcacgcaccaccacgcctggctactttattttgtattttagtagagatggagtctcacacatgttgcccaggctggtcttgaactcctgagctcaggcagttcacccatctggcctcccaaagtgttgggattacaggcgtgaggcaccacgcccagccaagaaggatgtttttttggtcactgtggacggatgcttg

SEQ ID NO: 492826 - DNA, 176 bp, Homo sapiens
agccccgttatacgtatatcactgcatcattatcttcatcatcacatggacccatctgcttcattgtcactgtcgctgctgtcctggcttgttgccatggttgccccaggaagccacctttgaagaagttgttgccgtaagtgtctcgttgtagttagggtactcttcgttgtcat

SEQ ID NO: 492827 - DNA, 648 bp, Homo sapiens
tgggaaccgcgctggaggaaggcgctgcgcggcgaggagaccaaggggtctgtggaaatcatgagacccggacttgaactgacgccctgggtactctgcagttgcctaggctagagtcagtcagctgcagtgtgtgacgggacacgtgatgtgaccgtaggaatgcaggcactgaccgactacaagaagctgcgggccttctttgtggcggaggaggagcatttcctgccggaggctgagaaggaggaggggctccctgaggacgagctggctgaccccactgagcggttcaggtcactgctgcaggcggtctcggagctggagaagaagcatcgcaacctgggcctcagcatgctgctgcagtgcatgtgcgccaacccgtggcagtcccagatctggatggcaggaggatgtgatcctcatctccatgggaagtgtcagcgtgtggctgccagggaagcgtggcacgtgcgcctggccttgggtccatctacatagttgcgtgtctcaacaatgtccatttatccttcaccctgaggcgttgtccgggggctgcaaacacctcccggtagaggctggcactgaggacccttcccacctgtgcccgtaccttcctgaacgtcctaggcacagcccatcctccatgag

SEQ ID NO: 492828 - DNA, 139 bp, Homo sapiens
cagacgggtcggactgggatgttctgacatctcacacctctcggtacttcgtgcttcacaggcatcactaatgtccggtgagggactttcatgtgcgggcagggtgcagcgagtcggcgtcttcgctcttgggttctgc

SEQ ID NO: 492829 - DNA, 239 bp, Homo sapiens
tacccaaagacttttttttattattacatggcccgggattgatgggaagggacagatgtagtgggcaaccatggttagcatgggatgcccatcccaatggccatgaatgggccaaaggggccgcccctctgcataatggttttcccaaggccgcccatcagtttttgaccccgcattccgatcctgaaacaggaaaaggagccgaaaagcgccccggccgccatgcccacggcccaacc

SEQ ID NO: 492830 - DNA, 140 bp, Homo sapiens
tccatctcagccttccaaagtgctaggattacaggtgtgagccaccacgcctgacctagttaagactttgattggacacccccccgccacacacacacacacacacacacacacacacacacacacaggggtagcgagcg

SEQ ID NO: 492831 - DNA, 210 bp, Homo sapiens
ccgaatgggttgcttgtcccaaacccaccagttatccagtgtattatttggaccaggaaatagttgttgtgggtgccacagctgagagtcagattgtctgggtgctttaaattgatcgattcagaggtgggtgctggcaataccattgttttgtgttaattgaaacgcagaatagatacccgtttggtaataaaaatcccttgctgttta

SEQ ID NO: 492832 - DNA, 282 bp, Homo sapiens
taaattcgcggcccgtcgacggagtgcttgagctcaggagcttggggctagctgggcagcgtggcaaaaccctatttctaataaaagatacaaaaattagccaggtgtggtggtgtgtgcctgtaattccagctattcaggaggttgaggtgggagaatcacttgagcctgggaggcagaggttgcagttgcagtgagctgagaacgtgccactgcagtccagcgttgggcaacagagccagactgtctcaaaaaaagaggggggaaagaaaaaagtcgacg

SEQ ID NO: 492833 - DNA, 172 bp, Homo sapiens
caaactatatatcaatgataagcaaatgggtaaatgacaataatgagtgatcctggtacaggtggtataagtgttctttatatgttttatttgtacactttgtaagttttaaagtatttctaagtaaacagtaatatgcacaattaaataatatatatatataaaaaaaaaa

SEQ ID NO: 492834 - DNA, 536 bp, Homo sapiens
tgggaaaagtctcgctctgtggcccatctggattgcagtggcccaatctgggctcatgaaacctctgggtcccggtcaagtggttcttctgccttcagccttcccgagttagcgtgggatacacgggtgcacgcaccccccacgcccagcttaatttgcggatatggtacagtaacagagtgggattttcaccatattgggcttcaggcgtggctctgaactcctgtgacctcaagttgatccaccacacctcagcctcccaaagttcacgggccaggagcgtgctttttattaaggaggaaaaattcccccacgggagaaacttctttttttaccctttttcataggcgtgccttaaaagagataattttccctcaaacctcccggttgctgcagtggtgctgacgacttccattaaacttacgagaaattgtattacaacccttaaatcttaggggtttactcacctttgtggcaaactcttaccctttttcaggggggctaatctgggagcatcagcgttttcacgcagagag

SEQ ID NO: 492835 - DNA, 724 bp, Homo sapiens
atactcgtggaacttgataaatgaagccatatctgagaatgtagctactcaaaaggaagtctgtcattactaaggtatctctaaataaacacattatgtaaggaagtgcccacaacatagttatcacatgtgcagactccttaggcaaactcaaactagcatctcaattgcagcagccacataacaatagatggatcacccaaataacttttgtttttaacaccagctatcccagtaaggctatccatgcatgtgtgctcaacattttcatttcaactttgcacatcttgcaaccactgcaagctgtgttcagggattcaaactcataattctgttcttaacaagcaaaatttatctgcaaatgtgcaagttctgcagcatcattcagctcaatgaattagtcgtctggggttacttccttgtttctcaagtcatacagcaatgtgcaagaatcatttgcaaaactccaatgcaaatcaattctcagctgccaacatgttgcacctccttatcatatattcttttatccacctttcgatctatttgatatatatgtatgtggttgcctaccactctgcgtatatttcatcagattggtgtcgcctaaactttattcccattggttcagcactcctcgctcagtctattattcgaacctcgtccaaatctattcacctggggtcctaccagcaccgcacccttcacaacaattctcacagctgag

SEQ ID NO: 492836 - DNA, 409 bp, Homo sapiens
tgttgggggcaaaccacttcgacctggatttgagtccccacgatggacgccacttgctgagaccagctaggtcagggagaccctaacccagcagtactagaggaattaaagacacacatacagaaatatagaggtgtgagttgggaaatcaggggtctcacagccttcagagctgagagccctgaacagagatttacccatgtatttattaacagcaaaccagtcattagcattgtttctatagatgttaaattaactaatagtatcccttatgggaaacgaagggatgggtcaaattaaaggaacaggctgggctagttaactgcagcaggagcacgtccttaagccaccctgggcgggccaagtgttccttgccctcatccccgtaaatagacaagcttctagcttg

SEQ ID NO: 492837 - DNA, 150 bp, Homo sapiens
tttggtaaacaatgcccatcaaattccgaaagtatttgagatgaacgtatggagtggttagtcattgctacatggctggacctgcagtgcggctaaagttattttaggcctattataaagctatggtcaggttatatacctagggtatac

SEQ ID NO: 492838 - DNA, 1347 bp, Homo sapiens
taaaaaaattgtgcattccaataattaaaatcatttgaacaaaaaaaaaaaaaaaaaaaaaaaaaaaaaaaaaaaaaaaaaaaaaaaaaaaaaaaaaaaaaaaaaaaaggaggggggggaggataaaaaacgacgtggttgttttattaattgagtgagaattattttttgttgaaaagatgtttttagaatgtgtgtgtgtgagagaagaataatatatgaaaataatatgtcgtgggaggagagaaattatgttataaaaagaaaagttgtgtttttcaccataaatcctctatattatattgaaggtgaatgacacacaaaagaagataataaggggagagaaaagaggggtgtatatatataagtgagtagtttatatataaaatataatatgtttgggggagaaaaaaaaaaaagggtggaggcagagaaaaaaagagaggtgtgtgtatatatagagtaagagaaatatgatattataaatgaatgattattactctccctgtattgtggaagaaaaaatttttctgtgggggagaaatagaaggactatatataaaaaaatatggtgggagcaaataaacaatacaaaaaaaaaaaacaaaaaaaaaaagagggggggagcggcggcaactataaaaagatatatctcctccaaagagaggggggagcaaccaaaaaaaaaattgagaacgaagcaaccacagcgtagtataatatcataggagaaaaaaaagaggggggcgccaccacaaaaaaaaaagggagaataacaataaaaataaagaggagagagacagaagagggcgcggccggcaggatgaaataaacaacagacggagcaaaaaaagggaagagaaaaaaaaggtagacaaacacggagaagaaaactttcatgaggaagaaaaaaacaactaatcaatctcagaaggagaggaggaataaaaaaatatataggaggaagcaaaaatcatctccgacagaaaggatatatatagagaatgatgcaggagagaagatataaaaaaaaaattatgaagggggattatataggtgagtaaaaacaaacacagagaagtataatttatgaaggagacgaagaaaaggaatatgtatggtcatcaataagaatgataattaaatttgagaaaaatcatttaaaacgaggagggaaatcagaatacatatactaaacagagagaggagacaggaaaagaaagagataatagagaaggaggagaggagaaaaaaaaaagaaagaaggaagagcagtaggagagacagaagataaaaaagagagaagaagaaagaaggaagaagtataagaagaaagaaatataggaa

SEQ ID NO: 492839 - DNA, 390 bp, Homo sapiens
ttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcaagcaaacccccttagagttgtaagcccttaagagggataggaattgctcactcagggagctcagtttttgagacgtgagtcttgccaatgctcccggccgaataaagcccttcctttcttt

SEQ ID NO: 492840 - DNA, 121 bp, Homo sapiens
gcgtcgacaatttattaagaactatcgggccacacgtcagcagtaacatcaatattattagaaagtctatcagaatagaaatgagggtggccaaccaaggggatttattcttcaggagctc

SEQ ID NO: 492841 - DNA, 142 bp, Homo sapiens
tacatgatacattttttttttccaggaaacagaaacaggtcttgggtcgggtattaatatcaaacgcatttaactttaaaactgatcccaataagcatggcccttacacagttcatgaccaatatttagttatatgaaaatg

SEQ ID NO: 492842 - DNA, 1244 bp, Homo sapiens
tgcagtggctcatgcttgtaatcccagcacttgtgggaggccaaggagggagggtcacttgagtccaggggttcgagagcagcctgggcaagatagggagaccccgtctttacaaataatttttaaaagttagctgggtgtggtggtgcacacctgtgcaccaaagctaccttgagaggccgaggtggggagggatcgctttgaacctgggaggctcgaggctgcagtgcgccatgatcgtatcactggcactcaagcctggcgaacagagcgagacccggtcccaaaagaaacgaaggacacggacacgaaccgacaggtatatcaagggtgagcttcctattataagatatggcgccaatgtgaaaacctggggctgtgtttgaattgtgcagccaaggagagacggcagcaagaaggataggtgggaaaaagcagaaaattttagggtttgactcaatgacgtgtatggggcgtgaatttggggaagcacttcttcttccaatctcctcctcttagtaaaatggtcaagcatcctggaagggctccaaggtctggaaggggtagggtccattataaaatcaaggaagagggggcccatcttgtcgccagggtggggagatcccggttaaacacacaaacaaacaacaacttcgcgcgcgccgcacagagatttacaccctccgtggggggcccattaatacaccggcactggccaagaacgggacaaagggggggcccaaaaaccgggagggcggaaacacaatgtggcatggcaaccagcaactacctccgctccgcggcacaacacagacacgcacgagcccacgacgcccaacgacaccacactacacaacgagagcaaccaccgagacccacaccacacaagacgatgcacgagcaaacacagcacaacgcacacacacggcgcaacaacgaagaaagagtagggagcaagcaggcggaagagcgaggcagagagcgagagtgagcgccgagggagacgccgccaggctagcagagcaccggcaagagaggcgaagtgcagaaggacagacgacaaggcagcaacagaggaggactggcagcggcgcaggcgatcgagcagcgggcaccagacgaggcgcgaatgggccatcgcaccagccagcgaggacacacgcagccagagcgaagccaccgaaagaccgggcagagcacgagtaaggggcgacagcgccaggcgacggcaggaaacaggcacg

SEQ ID NO: 492843 - DNA, 591 bp, Homo sapiens
  misc_feature (506)..(506): n is a, c, g, or t
ggcattcctgaagctgacagcattcggcccgagaggtctcgttccggggccttagctgggctcgcgctactctgtttttctggcctggaggctatccagcgtactccaaagattcaggtttactcacgtcatccagcagagaagggaaagtcaaatttcctgaattgctatgagtctgggtttcatccatccgacattgaagttgacttactgaagaatggagagagaatggaggggaccattcagacttgcctttcagcagggactggtctttctatctctggaactacactgaattcacccccactgtagttaagggggatcgagacatgtaagcagcatcatggaggtttgaagatgccgcatttggattgaatgaattccaaatcctgctggctggctgtttattgatatgctcatacacttacactttatgcacacaatgcagggttataataccgttaacatggacatgatcttctttacaattctactttgagtgctgnctccatgtttgatgtatctgaccaggttgctccacaggtagctctaggaggcctgcccttagagctggtgagccgacggtctctt

SEQ ID NO: 492844 - DNA, 591 bp, Homo sapiens
ggagaaagacgcacccaggggctggggaattgtcacaggtataaactctagaattggggaatgtagagtcctgtattggcaaagccggttggtttttgcgccctaggctatataaaaaaccgtggaatggaatgttgtcttgatttggtctaaatttggatatatatgaggtctctgaatatatccaaaatggattttggttgatagatttataatggaacccttttctaggtcctgaataaatatagcctgctttccctagatgcctttgtgtaggaaggatatacctttccctattactctcatcagctgaagaatatggactattggggtaccccaaatatgtggccttccatttggtggtttggtgccagcttagtggtttgtaatggaggttttggaaatggaaccggtggaatatctaaggtcaggcccctagtaacaggggtttggtaaatcctttcagaatccttgaagccgtcttaaagggtcttttgcagatgggaccaatttggaccatttgaatataggattttgaggtctagtaggactgagattggccccaaccaattaaaaactattccatttttg

SEQ ID NO: 492845 - DNA, 331 bp, Homo sapiens
cgctctagagtatccccgtcgcgtgtgctaccgacaggaaggctcagcatgactcacctacagcaacccgcccaaccgataaacctcgcgcacaaagcctcgctcatcgatcagcaatggagcccaagagtggttgccgaaatgaacgactaccagttcaaggtggtgcgtatcgagggtgaattcatttggcattcgcaccccgaaaccgatgaagcgttcctggtgcttgaaggcacgctgcgtatcgacctgccggagggcccggtgtatgtgaagccgggtgagttgtatgtggtgccgcgtggcattgagcacaggacagcacacg

SEQ ID NO: 492846 - DNA, 402 bp, Homo sapiens
gtgtgagtaccattgtaaattaaaatatcgttgactcaaaaatgacttacaggttgggcacagtggctcacgcctgtaatcccagtactttgggaggccgaggcaggtggatcactttgacgtcaggagttcgagaccagtctggccaacacggcgaaaccctgtctctacaaaaaatacaaaaattatctgggcatagaggcacgtctctgtagtcccagctacttgggaggctgaggcaggagaatcacttgaatccaggaggtggaggttgcagtaagccgagatcacaccactgtactccagcttgggcaacacagcgagactccgtttcaaaaaaaaaaacaaaattgacttacaaaaagaaaaggacttactttttcaacttacggtgggtagtca

SEQ ID NO: 492847 - DNA, 635 bp, Homo sapiens
tagtaaaaaggggggttccccttgtgggccaggctggtctcaaactcccgacctcggggtgactccacctggcctcgggcgcttcccaaaggtgtggggattacagggcggtagacgccaccgggcgcctgggccttcagtttcttccataggccgttcttgtcacccaaattatgctgcctacccagaggggcggggttagacctaggctgaaatatccacttgggtttctaagtggatgtgggcctccctttcccccattttcgcctttccgcagaaatatcgcttcaagtttccatttcccgaggggagcctcgtgggggagggggcggccattcgggcctccgtccccagtgggccaccttggaacacttcggcgggcttgggggacatattccacactcgtttcccctgtgagcccagattgtgcccccaacacatcctttcactggggggttcttatagcaggtttatcacagataattccactaaacgtccgttcactttaccctcgtggatgccacgctggaaaatattcccaatatctaagccctccttgaaatgtctggggggtaccatactttttacagaaccctttttgggcctttttaaaacaacaacaaaaaaaagagggg

SEQ ID NO: 492848 - DNA, 273 bp, Homo sapiens
gggatggaacagttctctatcttcattgtgcgtggtggctagaggaatttacttttattttactttacttttatttttcttgagacagactttcactcttattgcccaggctggagtgcaatggcacgatctcggctcaccacaacttccgcctcctggattcaagcgattctcctgcctcagcctcccgagtagctgagattacaggcatgcaccaccacgcccggctaattttgtattttttgtagacgatgggcgtttcctccgccactt

SEQ ID NO: 492849 - DNA, 734 bp, Homo sapiens
aagggtgcctccatcggcctggaactacaaaatgcccttgaccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggacttggggtgattcgtccggctccttagcactttatgcaggtgagcccatgaagttagtggtccattacttccttacagcactgcatctttcatcttcacaactgtctcctggccctgtgcgactccgctgcgacactggcacagctcttcgtggcgttctcaattctctccgtgagcgagtcggggcctgagaaggcatttcatcaggaggtctccttctgcacgtccatgacatgagcttttcggaggccaaggaagtagaggagggtgagagatgccggtcactgccacaggcacctccgtgacccggacccatccagacacgtcgcaggcttgggctccgcgacggagaagtctgagctgtgaagggaaagcccgcagtgactggtctgaggtcgcccttgactctccag

SEQ ID NO: 492850 - DNA, 219 bp, Homo sapiens
  misc_feature (17)..(17): n is a, c, g, or t
  misc_feature (115)..(115): n is a, c, g, or t
  misc_feature (132)..(132): n is a, c, g, or t
aattaaagaaaaacttnttaaacataggccagtgattttcatttatcaactggaaaatttactcctttttaaaacaattttaataataccaagatttgactttcctccaaagttntaagaaagccccccatntataatataatataatatataatggtaataaataaaaaaaaaaggcaaccctgctcaggtatcatccaaaacatgatcacattcaga

SEQ ID NO: 492851 - DNA, 296 bp, Homo sapiens
  misc_feature (293)..(293): n is a, c, g, or t
attatccccacatatgcagaaggaagggtggagaagcatcggaccaagatcacatcccttttttttttcggagagggagggggagtctcacggtgtaaccccagctagtctggaactccgggcctcagggatccaccggcctcagccccccaagtagctgggattacaagtgctagccacggaaccgggccagaatcacatcattttgaaatgggctgaactaaggatttaaacccattgtctggattaaacattcccaaggatggtttgccatgggtaaggtctggtgtcanatc

SEQ ID NO: 492852 - DNA, 434 bp, Homo sapiens
gcagagcgcgcagaaacacttgcggcagcagatgcagccgcacaggcaagtcgaagcgctgtcgccgatcaggctgcagcgattggcgactgcgcagcggacattggctgaaacggctgcggccagagccttccaggccaatgcgctggcgcagatccaggcggttcaggcgcagcttctcgcagatcgaactcttgagcagcaacgtcttcgtgcacagattaccgatgtaggtcgtcagcaatccttggctcgcctggctgaaatccgtttggcggaggcagcagtcaccaatcaacagacatcagctcagtcggcacataatcaatcgttgagcgcggaagttatcgctcagtcccgcgtaactgccgcaaacgtggcataggtagcctcgcgagcagctgacacggctgcagtctcagcacaaagtgcag

SEQ ID NO: 492853 - DNA, 928 bp, Homo sapiens
gaccacgcgtccgcatgcctgtagttccagctacttgggaggctgaggtgggaggattgcttgagcctgggaagtagaggctgcagtgaactataactgtgctagtggccgggcgcagtggctcacgcctataatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcacaaaaaagaaaaatagctaaaatatgattgtaccactgcactccagcctgggtgacagagtgagaccctgtctctaaaaaaaaaacaaggaaaatcgacggaacaaagaatgtcagcatgtcagcgttcctccaaggagtggttgggtcaacgaagacagggtggtctcctaaacaaacggctccccacggtgcgagaggcagaggccctttaatctggccgagttttgggagggcctgggggctttcctgcactacttcctggaccatctgggcctgccacgcactaccaacgcccagaagggaacgatctccgtgcatcggggcaagagacgggccagagggaagctggcgggcctcaggggataaaggcccggggggcatgggggcgcggcccatcaaattacccgaaaagaagaagcggaagggcctccagagagcaacacgcgttttaggagaccccgacaaaccaatgggggaacaacaccccgaggataaggccgggagcacacatgtagaaccgctccgcagagacgactcgg

SEQ ID NO: 492854 - DNA, 773 bp, Homo sapiens
gcaaaggagtaggtggtgggatctcaccgtggctccgattagccttttctctgccttggttgctgtgatcttcagcgggaatctcgaaatggcgttggcgggtaaggctggaaagggactccgtgcaaagagccaagacaacaggcggttacccgctcgcagagagccggcttgcaaggtccccagtggggccgctatacatcgacatctaaagatctaggacagacccagtcatggagcgtgtggtgcgcgactgccgctgtgtacaggcgcagccatcctgggagtaccctcaccgcagaggtacttgacctggcaggaaatgcgtcaaaagaccttaaaggtaccagcgtattaacccctcgtcaggttgcaacttgcaaatccgtggagatgcccgaattggattcttctcatcaaggctacaattggcctggtggtggtgtcattccacgacatccagaaatctctgatggggacagaaaggaccagcagaacgacttgtcctagaggatgcctggaatgcccttgtaatctcaggacctctaaatactctaacgagctgtccaaggggtaggtgactcccagtggactgtatctctgctgaaaaacacaatttgccttgtgtaactcctatttgagcaagttgcacgtttaattgagcttccaagcaagccaatatctgcaattcgagtcttaacccatttagtgttctgtgcgtcaaagaagttatgatctgcagactggttagactcgcggcggttccaaacgtg

SEQ ID NO: 492855 - DNA, 146 bp, Homo sapiens
ccagcatagaatgactacatacttccgggggttgagatgatatctatctcattttagttttggtttgcatttctctgatggtcaatgatgttgagcaccttttcaccttttcatatgtgtgtttgacattcgtatatcttctttgg

SEQ ID NO: 492856 - DNA, 238 bp, Homo sapiens
caattttcattttttttttttaaaaatttggggggttgggtttaaaacccaaatttcggggagcccccagcctttcccccaaggggccctttttggcccaaaagggcgggtaagggggttttttttaaattaaaaggtttaaaaaaaatttttaataaaaccgggccaaaaggggccggccttttgggatttggaagggggggcccctaaaaaaacggaaaggggtttttttttggca

SEQ ID NO: 492857 - DNA, 807 bp, Homo sapiens
agatgccatcagagctttgtgaatcagctggggtgttctcactggataaacaacacatagcaggtgtgcattcattacaaatatatagtatctgccaatggtggagcctacgtttaaagagtgagtatgtcttgtatctaaggtggatacgagcgtactgttgtaaactgcaagatttttacttgctgagagaatctgttttagagtatagtggttggcctccatgattatttataggttttataaattttagaatcaatttctctttaaggtggctcagagtttttcaagcatcttgtgcacagtaaaattgagtagaagttcatttgtgccttctcttgtgttctttatccaaatttggaagtttatagcttacatatggtaactgcatcctgttcggacactatatgtctaaattttgaaactgtgtggtgtgcgctaagaagtaggaataacaacgtgaaagctaattaaggtcacaaactgcggtgaaacccttaaaagtccacatcttctgatattgtgaaccgtacccctggccagtattagtttgctttcgtggagtttttccttactttaaactgacagtggacctttgtaaattgtgcacacgctcatgatctacaaatgggcctctaactggaatgaatcctaattgcctctcatgttttaacccttgcacaactcaacatttcagtggaccttaggatcgagctagtgcagacacttgtggcttccttgttcaattgtggcctacaagttgaatgggatggccctcggagagggacaacttggggggagtaagct

SEQ ID NO: 492858 - DNA, 129 bp, Homo sapiens
cagcgctgagggcgagagagtcggtcggtgtctccggccataatgacccaggctgagatgggtgatacggagaacgaataggagaagggcggcgagaaagaagaaggagcagcgcgtctaaaagcggcc

SEQ ID NO: 492859 - DNA, 548 bp, Homo sapiens
gtgttctgcggatcctcgagttgaactgtgtttgggaggaggcatgcacgctggtgcatgttgaagagcctcacacggagacccgtacgaccgtacttacctgagacacaggatctgggatttggtggtggtaaactcagcaggtgtggctgaggtaggagtaacagtccctgaccccatcaccgagtgcaaggcaggggccttctgcctgtctgaagatgctggacttggtatctcttccactgcctctctccgagccttccagcccttctttgtggagctcacaatgccttactctgtgattcgtggagaggccttcacactcaaggccacggtccaaaactaccttcccaaatgcatccgggtcagtgtgcagctggacgcctctcccgccttcctagctgtcccagtggagaaggcacaagcgcctcactgcatctgtgcaactgggcggccacctgtgtccttgggcagtaaccccaaagtcattcggccatgtgaatctcactgtgagcgcagaggcactagagtctcaagagctgtgtggg

SEQ ID NO: 492860 - DNA, 261 bp, Homo sapiens
tattgtgaagagtaagtcatccatggctgtaacacaccagcatcgccagatggggtgcgggaatgtaggcaatttatgtaacctttgcagcagcagctgctgtgaccgcaaggggtgatactggggtgattgagcatttttaagtgtaagtattcacatcatgatatgtctgtagctgtgttttatcatctgaggttgttcatttgggggacagaaggatcaggcatgatctccttaaaccccatattccgtttcattaat

SEQ ID NO: 492861 - DNA, 111 bp, Homo sapiens
acggactacggactgactggcgggcacggactacgttacgaccggtttctactttcctgagcgtctgagatgttagtattagttacgtttgtgtgagtgttaggaaaaggg

SEQ ID NO: 492862 - DNA, 904 bp, Homo sapiens
gattaaatctcagtaatgtgctgctcgcatagatgacatgtcgtaataggaaaagttacttgtagatctttagaccttgggtggtcacttaggctgtggagagtcactaccctatgttggcgatcttactagattgggagggacctttgccgtgtacaggtgatgggactttctgtgaccttgactctcgacgtatgcgaagtagagggtttcatgtagttaatcgtgacatgtcaagaattgggaagagtgtaaccttttcttgttctttggaagcattcactctttgagggtccctcaggaacttaagactagtagatgtccacttgggggggggaaatccgctgaatagactatccgatcgaattgctgttgagcttgcacgagtgggcgccaaggggaaacgataaaacaaacagcgtcaggctttattgggttctacccagaaacgaataactcgggagagtgtcagcgataccgtttttttttaagaagacatccaatcttagtcggaagccggactgagggttggatgcgtcaccagaggggcgttaccaccgttcgcttttcattgcctctggagaaggataccctttttatagaattggtttctccaacccaatttgggtctttggttttttggccgccagtgcgtaaaacccgtgttgaacgacgggtgtggtggggcctaatgtcactgatggggtgcctcaaaaagggttcccataaggaaatgttaaccttcgacagtatggcagacttttgggtcatgtccaccctggactccatggaattatcccgaaacagtgaattgtgtcaaacgggtttagccaagtggctcattctactaacctggggaattactacgaaaggggtcccaaaaacgtcggacataggattcaag

SEQ ID NO: 492863 - DNA, 255 bp, Homo sapiens
  misc_feature (90)..(90): n is a, c, g, or t
  misc_feature (158)..(158): n is a, c, g, or t
  misc_feature (213)..(213): n is a, c, g, or t
  misc_feature (224)..(224): n is a, c, g, or t
caatgccccacttttaataatggatagaacaaccaggcagataatcaataagagaacagatgacttatacaaccctacagaccaattggnattaacagacgtacagaatattctactccacaacagcagaacacatattcttctcaagggcatatggnacatcctctgggacagataacacgttaggccacatgacaagtcttaacaaatttnagaagactganaccataccaagcatcttttccaatcacaagg

SEQ ID NO: 492864 - DNA, 265 bp, Homo sapiens
atggcctcagtctccatggtctgcttgtggccacctcatcatgaactgtcggccacagttctttaccacagattccatgacctccagggcatacaaggcgacgtgtgggttctgtcgttgactttcttcttgatgggattcacagcatattttgctctgaaaaggaaacattgataaaagcagagaaaaacgggaaaaaaatagtctcagcaactaagatgagaaaagctcatcttagtagctgaggaccatcgttggggtaccg

SEQ ID NO: 492865 - DNA, 199 bp, Homo sapiens
cggctgacttatttaaggtatatctccttctttgtatctttgaagagggagtctcgctctgtcacccaggcacaatctcggctctcactgcaacctgcaactccgggcttcaagtgactctcctgtgtcagcctccgggggagctggcaccacaggcacatgccaccatgcgtggctaatatccgcatgctgagcagag

SEQ ID NO: 492866 - DNA, 117 bp, Homo sapiens
tgtcccacaagtgacttgatcaactattcaatgcattttaggaagattgctctggccacatgtagtagagaagcatgtacgaggctgtcacgattatccacggtgaaagctgatgac

SEQ ID NO: 492867 - DNA, 420 bp, Homo sapiens
  misc_feature (64)..(64): n is a, c, g, or t
  misc_feature (108)..(108): n is a, c, g, or t
  misc_feature (121)..(121): n is a, c, g, or t
  misc_feature (170)..(170): n is a, c, g, or t
  misc_feature (176)..(177): n is a, c, g, or t
  misc_feature (181)..(181): n is a, c, g, or t
  misc_feature (191)..(191): n is a, c, g, or t
  misc_feature (197)..(197): n is a, c, g, or t
  misc_feature (200)..(200): n is a, c, g, or t
  misc_feature (215)..(215): n is a, c, g, or t
  misc_feature (219)..(219): n is a, c, g, or t
  misc_feature (221)..(222): n is a, c, g, or t
agcggatctccttcgacggtgtctgcatgtgcttcttcccaagaaattttcagaaactgaaccnacactatttcataccgatgctagtgctcctgaagtcctgtagcnaagaccctctcanatgtttatgaaatgaacagacaggccagatgcagtggctcacggctgtnatcccnncacnttgggaggcngaggcnggnggatcacgaggtcangagntnnagaccagcctgggcaacatggcgaaaccccatctctactaaaaatacaaaaatttgacaggtgtggtgatgcgtaccacctgtaattccagctacttgggaggctgaggcatgagaatcacttgaacccaggatgcagaggtggactctcttctgatgaagaggaggggaccagctctcaagcagaacaccgtcgaag

SEQ ID NO: 492868 - DNA, 413 bp, Homo sapiens
  misc_feature (64)..(64): n is a, c, g, or t
  misc_feature (108)..(108): n is a, c, g, or t
  misc_feature (121)..(121): n is a, c, g, or t
  misc_feature (170)..(170): n is a, c, g, or t
  misc_feature (176)..(177): n is a, c, g, or t
  misc_feature (181)..(181): n is a, c, g, or t
  misc_feature (191)..(191): n is a, c, g, or t
  misc_feature (197)..(197): n is a, c, g, or t
  misc_feature (200)..(200): n is a, c, g, or t
  misc_feature (215)..(215): n is a, c, g, or t
  misc_feature (219)..(219): n is a, c, g, or t
  misc_feature (221)..(222): n is a, c, g, or t
agcggatctccttcgacggtgtctgcatgtgcttcttcccaagaaattttcagaaactgaaccnacactatttcataccgatgctagtgctcctgaagtcctgtagcnaagaccctctcanatgtttatgaaatgaacagacaggccagatgcagtggctcacggctgtnatcccnncacnttgggaggcngaggcnggnggatcacgaggtcangagntnnagaccagccaaccccgtctctactaaaaataccaaaatcagccgagtgtactggtgtatgcctgtcatcccagccactcgggatgctgacgccagagaatcacttgaacctgggaggccgaggttgcagtgagctgagatcatgcccttgcactcctgtctgggctatccagagcgaaattccgtctcgac

SEQ ID NO: 492869 - DNA, 125 bp, Homo sapiens
cactaagcacgagacgacagcagtagagccttctctgtcagtgtggacatgaaactcttgtacagtatgctgcttcaatctgactggtatagcaggacagttaattccgtgggcctctagtaatt

SEQ ID NO: 492870 - DNA, 160 bp, Homo sapiens
  misc_feature (3)..(3): n is a, c, g, or t
cgngctgtcacgccggggtcgcgggttcgagtcccgtccactccgccatataaataccaaagccgcatttatttcgataaatgcggctttttgctttgtagctcagatgccgatttttgtgcaacccaaacctcattcaagaggctttggggttgtcgct

SEQ ID NO: 492871 - DNA, 152 bp, Homo sapiens
tgagaggatcccctcccaatgatgagaaactgtctctgtctagctcctcaagacttctttcatgtatgggagaaatacgcccctagcttgtttaaatcattgttaatttggttttctacaataaacactcaatgcctccttctgatcaattc

SEQ ID NO: 492872 - DNA, 391 bp, Homo sapiens
atgccaataacctccaccctgaagctcaagcgctccggggttaaaggcacggtattggtggccgatgattcgctgcgcattgatgtggaacttggcctgctgatgtcggccatgagtggcacgatcaagtccgaaatcgaaaaggccctggataaggccctggcttgatacggctgtgcttagggtgccgattctaattttaaaccttactttgtgcccaagccctcaactcttgcgggccgtccgccacccaattctgtgtgaggtgcaccatggccaaagttattttgaagaaaaaaatcgacgttcagaccactcccctgagtgaggttaaaagctacgcccgcaagatctggctggcgggtcttggcgcctaggaggttattggcat

SEQ ID NO: 492873 - DNA, 231 bp, Homo sapiens
ttctgcacctgtagtcccagctagttgtgaggctgacgcagaagaattgcttaaacccgagaggcgcggacttgcagtgagcagagatcgcgccactgcacaccagccagactagcaactgctggcagaactacctggacttccaccgctgtcccaaggcaatgaatgctcattttgcccaaagctttctgtttggggctttgaaaagtgagccctgactgggtgtggtgg

SEQ ID NO: 492874 - DNA, 785 bp, Homo sapiens
  misc_feature (162)..(162): n is a, c, g, or t
atgtgtcgggaacatcgcggtagggtgggatccttctcgatcgagccgatgatctcggtactcgaggacggccaccgttgctggaatgccttcgggggcagcggactcctcagaggcataggtacagccgctcaccgctacagcgacgacggccagagaagngccggcggcgtgacgcagagatttcatgtgacgttccttcgcaggtgcggtgtcggtcaacaccacatggtacataattatgcatacgagagcataatctcaagttgggggtgtgggggtagggctaaggggctatgtgtagatggggatctctgtggccagttgtacgaatggacaatgtgctgcagacgaaggaatgtaatatcgaagaaattgttgtgtttgggctatgagaattataataatatgcgttggatgtggtgagtaaccgaattaagagtggcgtgtagaattgataatggagaggctgtgatgaaatgacttgcgggtgtcgtcggggctactgtggtattgacattcggaatggctgttggtgcgtttgcttctactagtggaaatatagggatcgatacggggcaaaatgtcagttttcatggtcgatacacctatggagtggcgcatcggggctgggctggcaaggcggttgagggtcaccggaaccttggcgtcactggttctaactcaggtcatgtcaatgtcccgcagcaagggtactcgtggaggagaattggtcaccgtaacattggccgcaaggtgggtgtcacttctgatgttgagccctg

SEQ ID NO: 492875 - DNA, 525 bp, Homo sapiens
  misc_feature (471)..(471): n is a, c, g, or t
ccttccctgacccaaaacatgtcaccaagttcaaattattcttaacccttaactacttccagaattcacctacttctgtccatccaaactcctcctgacttagttctgcctataataaaacttcagtaaggtaaggtaataatcacacaagttgtttttcgtcacctgatctaactcattccaatctataatccattcagtcagaaaagccatcttactaataaagtgcaaattgaatattcagtcccttgcttaaacttatcttatgaattacaagttccttagaaagacagcataagttccctatttcaccaacctcatcttccagcctttcttcttatgaaccctagattttagctgaatcaagacttcctggatcagtgtcaatcattcaatggctcttcagtttcatatatcttgttcccactacttgaaatacttttgctatgagatcttattcccatccaccanaaaaatgcttactttaccttttgaagctcagcccaggcattttaactctaggaa

SEQ ID NO: 492876 - DNA, 658 bp, Homo sapiens
  misc_feature (36)..(36): n is a, c, g, or t
  misc_feature (71)..(71): n is a, c, g, or t
  misc_feature (97)..(97): n is a, c, g, or t
tcatgcctaccctttttttggaagtttccagccgcnatttgaaatgaaatgacaaggtgtatatttgatcnattttcattcccaccattgcattacnacctctaacttaaatgggtaaccctaaggcatatcaaagaagcagattgcatgataaacggaaatagaaaaaaagaacctacatttattttgctttagcatccttactctcaccttttatgagattgagagtggacttacatttccttttttacattttcgtatacttatttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaataaaaaa

SEQ ID NO: 492877 - DNA, 742 bp, Homo sapiens
cccccccccgttttatggggcgggcggtatttcccggaaacaattcatattggttttttggtccttaaaatatgtttcaaaacgcgggggcgcgccgtttccggtatttgttccccgggccgcccctttttttgggaggcccttttttaccccctgtttcccaggccttgtgtcctctaaattttcctttgggatttcccgggggccgcccaaccggggcgcccccaggcccccctgtgttttgggtcccctccttctttgggggcaaggagagagagggggccccctccccccttccctcttaaaaaggggccccctttgagaccggggggccccccttttttttcggccacaccccccggccttttttccctaagaggtgtgggggggaaaaagaaaacccttaaggttggcccgggggggtttttttaacaacccccggcccccccccctcccttttaaaaaaaaaaccccccccggggggggggggggggggtgccccagggggcccctttttttttttcccccccccttttaaggggggggttttcgggggggccccccaaacccagggccccgcccccccccccttttttaaaggggggcccccccccggggggcccggggggggtggccccccttttttttcccccctgcccgggggggggggggggttttttgaaaataaaacccccccccccttccgggcccccccccaataaacccttttttttggggggga

SEQ ID NO: 492878 - DNA, 590 bp, Homo sapiens
gtcacttttgcagaaaagcatttactgactgttgacttggccaaatccctgtgctgtgtttcctagcacggtaaatcaactgtatccagtagtgggacagatgcagcatgaaagaagaaagttacaattgctttatctgatgctgtcactcatgcctggtgttgagaggcgcacattttaaaaagtctaatagctccgacatatctaggaaacagatgggaaacaaatgaagcattgatggattcgcaaattccagttctttgatatttgtctgcccaggaatgggtgggacagagaaatgtaagggaataatgaggatacgggtggggaaaggcttgcaatttttcccgttcttctttggatatggactgaaggaaggatgtggggaggaggtgtttatcttttgcttgtactctgaacttttccaaagttactgattccttgggatataaaactgtaatcaagagtctctaatggataactgcaattatgcattgagtcattcaacaaatacacattaatactgactaaattaagctcgaatggaacttcagggcaaaagaacagagaaaataaaataccactagaga

SEQ ID NO: 492879 - DNA, 403 bp, Homo sapiens
  misc_feature (7)..(7): n is a, c, g, or t
tgagganacccaaccctgccacccacagctaccaacttaagtaacgctgaaaccctttcctttaaatccagcttaccgtcagatgaactagggatacttgggaaattatgattaaagccctacgttcaaagtcaagtaatagactatttttaaaaatacatggtaaggagaaaaaagtgtctatgttgaacaactgagaaacacttaagcgaggttacaaatgactaataactatgcacaacaatcttttccaggatcaactttttcctttgcaaaaaaaaatcatttacagacattcaacaagttaattctgttataaatgataggccatatgtatgttccaacctgcttccttttagtactaggacagtgtagtaccggcacttcagtaagtgttaacttt

SEQ ID NO: 492880 - DNA, 1062 bp, Homo sapiens
gccgacacccgagccggaggcgggcgggggcgccaaggcgaagatgggggactagagcgtggtgggatcacgatgaggatggtcatggatgatgcacacgacgaggaagcaccccaaggatcgaccacggtcagatctctgtccgctgggcggacgatcgaggcccggggtggcaatcgcatggaagcaagctaccgagtagaggcagaacggaggacaactagggacacgggcgacttagaccagcgcagtgacaccgtcgcaatggatgtgctcgtacgctgccatgaggaatccgtgataggagcctggaggtggccggagggacgtgcaacgggaagggagccttgcgaagacgcgctgtgaagcgccgcaggaatggcgagcgatgagcatggcactccagtgagcgaagccgggaaggctgggaaagcggtaagtgcatgggaggggcgtgagtggccggcatgaaggacacggcagacaagaacgcactgacacgcgtggtacaaagggtggtgcaccctaggggcgtacaacgccaacaacaggaacggcggcatttgcaaggactaaagacagtccactggggtcagacatgttagcccacaaagttccgcggcgacatgtcaccgcgtgagagccagcgtgacattccacgacaggggcaagggtgggacagcggggaacgacaacgcagaaagagagcgaaaggagagcccacatctcgtaattggaaaggcaaacactataccagttagagaaaagagagaggatataccaaagtagcaatggttctttgggaccaaaattggcatgtgcgggcgacagcacgtgtgtggtaaatatgaatcctagtaggagcaaaagaacgagtaagacccgttgcatatcaagcacctgagtcgagtacaccaaccattgaggattgcttggacgaaagggaacagaaaataagacgccagacgatgaaaccgtgagaagctcaaaatatgtgggtagtacaggagagtgttagtgaaccgttaaagaagggtgttggggaaagaggaagggaaaact

SEQ ID NO: 492881 - DNA, 367 bp, Homo sapiens
gtaccacgaaaaaagcgtgaagatctaagatatcgctggagacttagtagccttctgatattccccgcagagacagacacttccatatcagagtgagagtgtggaatacgcgaaccaatatatgtgcgtgagcctctcttctttgtgattcaaatcctgcccgcttcttacacgtacatctcctagcatacgaatgtataatgcagtctgatcagaactgtcataggaaatagctccacgcctctgagagagctgccggggattggggcagccgaagagagcggagctggagctgaagctgatggctcctcggcggctgaggacgtgctgggggaccggcctgtccaggggcagtaccggcagctgg

SEQ ID NO: 492882 - DNA, 848 bp, Homo sapiens
aaaatacaaaaattagccgggcatggtggcacgtgcctgtagtcccagctacccgggaagctgaggcagagcaatcgcttgaacccgggagacggaggctgaagtgagccgagatcgcgccactccactcccgcctgggcaacagagtgagactccgtctcagagaaaaaagaaagaaaaaaatcggggcaggctggggtgcaggggcctcaccctggtaaattccccagcactttgggcgagggccaagggcggggttgaactcacggagggccaggagtccaagaccaaagcccggtcccaaatgatgttgaaaccccggtctcttactaaacttacaaaatttagtggccgtggtgtcaggcgtctgtaatccccagttaactcaggagtctggagagcagaggatttaggtttgaccccgaggaggcacaagtgttggcatgtgacgccaaggatcggtggccactggcacttcccagtctgtggtggacacaaggcgagattcaagtctccaagaaaaaaaaattcagctggcgcctatgtgtgggatttgagctggcaagccgtggttaaaccaggagggctgaccctcgcggccctctccctttggcgcccagggaggggtccgggctaccacgtcccgcctttggttgatttcgccctggcctctttagtcgtggggccgcgagaacgcaaccgctgtgttcaaaaagggacatttctgggctctccggggtgtttccggcccaacccttcgctggacgggactgttgtttcacccttcgtgcttcggggaacagggttgaccgccaatatgggggttggctcgcgcccgatggagtccg

SEQ ID NO: 492883 - DNA, 1460 bp, Homo sapiens
  misc_feature (491)..(491): n is a, c, g, or t
  misc_feature (790)..(790): n is a, c, g, or t
acacggaagttcacctattgtaccacgactggaacttccgtccattgcttccattttagaatggatatgaacgctggcagaacttctcgagtgagtctctacagacctctaagagctatcaaagagagatcagggattgccaactgcctatctacaactggcgaccttgctacacgttgatatgccagtgacagcgcgtttccctcctaataagtgataagagatgatggatgaatacttcagtcatttgtcccaggctcagccatccagaagtctagctctgggctggacaagaaacagggtactaatattgagcggaacgagattgaagaactaaagcttagtggcgctggactcggaagacggtgctagatgctaggtcgccctgctagagcgtccggacgtgtgtagtccttgtggatcaactacttttacgcaagaatagtatatctcagccatggagtacgcctcgcttgaaggatcgcttggantcgatctggggacaagccagaccacaaggcatgctgtaggagtgacacatttaacacgccataataccacgggcagctcgtgccatgatcactcaatgaacatgtgacctgtctcctgtgagattagatcttaccggagaatctcacatccctctgagaattacaaccctcacgaagctgagcacatactgtctgtcgaccccttggaaaatcatagttcttcctctccaacatgggcaccccccttaagggccacccatagagtggttcccaagcctatggaatttcgagctccgtcnttgtggcggaagggaagtgaggcaagagacaggcttatctcagtccaatgtaaacccactgtgtaaggaaaaccgcaaaattgggtcctccagggcctcccttcggcttagaggccccaccacggcgttctgggtggcgaagtttcggtccaccgtatggggcacaaccctccatctggcattcgattgtctcccacactttagctagccctctgtctcaccgcggcgccgttaccatagtaggggcggattgcccaaacggaggttgtgagcattgcccttcccccgttgggacgctctttgtgtcttcccctaccccgtgggaatgtgttcccgtcgcggggggttacttttgaacccaggcggtgtagggaccccctggcttgccgaatgcatacctagcaccccgaagggacaatataaaggtgttgtgaattgcgccaacgactttcagtttgagaccctccagtcagacaaacgaaaagtgtgggctgatttacaacagtgtccgccaagtagagctgtagggcgacccccatgggatccgtaggcgataacttaccaaatggggcttgcgccctggagaacgacatctcggagagcgatagaaacgccgtcttacacacccacaacaccctctgtgtgtggcgtacactatcacggctataaa

SEQ ID NO: 492884 - DNA, 116 bp, Homo sapiens
caggctggactcaatggtgatagcagggtcttcagatggtggggggcacactcgcatggcgctgcatgcagctctgcaatgcggttccatgtcatccagtcgtgctcatggctcat

SEQ ID NO: 492885 - DNA, 462 bp, Homo sapiens
caggaggatcacttgagaccaggagttcaagatgagtctggacaacatattgagaccctgtctctacaaaaataattagccaggtgtggtggcacatgcctgtagtcctaactactcaggaggctgagacaagaggatctcttgagcccaggtgtttgaagtagcagtgagccatgattgtgccactttgctccacctgggtgacagagttagaccctgtctccaaaaagaagaaaaaaaatttcttaaatttaaatggaaaaaacataccagaacctatgggatacagcaaaagcagtgctaagagggaagtttagagcaataaacacctacatcaaaaaaaagtagaaagatttcaaataacctaatgatggaccttaaggaactagaaaggcaggacaaaacaaaccaaaattagtaaaagaggaataatgagacagagagaaataaaaaatgagattg

SEQ ID NO: 492886 - DNA, 366 bp, Homo sapiens
gtctacttgcctggcctgactgactgtattatagatgacctgaggtgtgcgtgcgtgtgcgcacgcgctcatatgtatatatgcaactgttgaagctttttctgttgtgtgcatacagtttcaaggctcaccactttgcactggaagaccagtaaggggatcataccaggagaagctgatcctttctcccaagtcaacaatgatctgtagttctttgttcaagggtaagaccccatgaaaaatgtccccttccctgtgctacacaggaagatgcttattaaaaatagaaatcgtgggctggtgagatggctcaccgggtaagagtactgactgctctcccgaaggttctgagttcagatcccagca

SEQ ID NO: 492887 - DNA, 104 bp, Homo sapiens
gggcacaaaagcaaaagactcggaccctatttggtaggggaaaaaaaatttgaaatgtttttaattattttgattgctggaataaagcatgtggaaatgcccca

SEQ ID NO: 492888 - DNA, 137 bp, Homo sapiens
  misc_feature (46)..(46): n is a, c, g, or t
  misc_feature (80)..(80): n is a, c, g, or t
gcacttgcggttatcataccttccaaaatcattttctattctttangatttctttcctgtgagacccttaaatttgtttngttttattttattttatttgagacagagtttcgcttttgccactccagcctggagag

SEQ ID NO: 492889 - DNA, 478 bp, Homo sapiens
  misc_feature (119)..(119): n is a, c, g, or t
  misc_feature (313)..(313): n is a, c, g, or t
  misc_feature (367)..(367): n is a, c, g, or t
  misc_feature (397)..(397): n is a, c, g, or t
  misc_feature (402)..(402): n is a, c, g, or t
  misc_feature (423)..(423): n is a, c, g, or t
  misc_feature (437)..(437): n is a, c, g, or t
  misc_feature (454)..(454): n is a, c, g, or t
  misc_feature (468)..(468): n is a, c, g, or t
tgtttttttctcttgcctgactgcgctgtgggtacttccagtactatgttgaataacagtggtaaaagtgggcatcctcatcttgttccagtccttagaggaaaagctttcaacttttncccattaagtatgctgttagctgtgggtttgtcatagaagacctttattatgttgaggtatgttctttctatgcctagtttgttgaggattttcatcatgaagtgatgctgaattgtattgaatgcagaaatccttgacaaaatactaggcaaatcaaatctaacagggacatcggaaaaggataattacaccnttaatcagggtgggggttttatcccggggggaatgccaagggatggatttccanccattaccaccaaattccaatggaattgtnggttntattccccggttaaaccgganttttggggacccanaacccttttggttcccnccttggttagggtngccggggggg

SEQ ID NO: 492890 - DNA, 205 bp, Homo sapiens
cgcgacgaacgcagtgagctatactcatgccactgccctccagcctgggcgataagaatgagaccctcccgcactgtatagatagatgagatatgatagatagcatagatagtatgcgagttgattggaggtgcccacccatgggagtcacgatcagataagatcgaatccgactgtattaccatgagataagataagaggagta

SEQ ID NO: 492891 - DNA, 107 bp, Homo sapiens
ggacaaggacaaaggcaaggcattctaattcagaattcttggacatcacggtctactacagggatgcccttaatgctctgccttaaggaatggaacaacgcttttca

SEQ ID NO: 492892 - DNA, 258 bp, Homo sapiens
tggacaaggtgttgctctgctgccctggctggaatgcagtggtgcaatcctagctcactgcagcctcgaactcctgggctcaagtgatcctcctgcctcagccatctgagtagctgatactatagctgtgcactagcatacctggctaatttttaaatttttagtagagacgggggtctcactatattgttcaggctggaagatacctttttacaagttttattctataaaaaagtcaaacatctcccaaaatccctt

SEQ ID NO: 492893 - DNA, 845 bp, Homo sapiens
  misc_feature (564)..(564): n is a, c, g, or t
  misc_feature (584)..(584): n is a, c, g, or t
atcttcaaaaataagttaattggatatattgtcatatcaaactacaaagtgtacaaagttaagtttagcccttttctagaaagtgatctttaaaattaaaaatgctcctcttttaaattcaccaaatttatgtgtgggaaggcaacaaactgatttggtaagtgccactgcaatattccctttcaagtgtggcctaaatttcaatcttaagggtgggatggctgttgtgtgctctgtgtgagaaatgatgtaggcttctactaatttaaaaagagagtgaaaaatatacataagcctataaaaaaagatttgtgcaattgtgaaagcctgttaattttttatgtagacatacctacacacgaaagggttaaattcacagcttactagttcctgtgcttccagtatttcaattggtctcctcccctcattattattattactactagtactattattttgcacatagttaactgcccttcaatatgatgcttaaacaaagtgctgttctgtggtatcgtatctctaaataatcatatttaattttttaaaacaaggttgcagttnctaattgttcgtcctgtgtnttgtggtgtgtaataaagcagttttctttcatggttattatacattagtgctgtaaatatcttgtatatgtctggaatgtgtgaaagttgataattagttaaccctgttgaagcaatgtttggtattttataactagaattacaaaaaaaaaaaaattattggggggcgcgagaattaaacttggggcggcaggaagaaagataggtagaaggagggtgaacaaacggggagggaacaggggttgtaaaagcaaagagaga

SEQ ID NO: 492894 - DNA, 784 bp, Homo sapiens
  misc_feature (564)..(564): n is a, c, g, or t
  misc_feature (584)..(584): n is a, c, g, or t
atcttcaaaaataagttaattggatatattgtcatatcaaactacaaagtgtacaaagttaagtttagcccttttctagaaagtgatctttaaaattaaaaatgctcctcttttaaattcaccaaatttatgtgtgggaaggcaacaaactgatttggtaagtgccactgcaatattccctttcaagtgtggcctaaatttcaatcttaagggtgggatggctgttgtgtgctctgtgtgagaaatgatgtaggcttctactaatttaaaaagagagtgaaaaatatacataagcctataaaaaaagatttgtgcaattgtgaaagcctgttaattttttatgtagacatacctacacacgaaagggttaaattcacagcttactagttcctgtgcttccagtatttcaattggtctcctcccctcattattattattactactagtactattattttgcacatagttaactgcccttcaatatgatgcttaaacaaagtgctgttctgtggtatcgtatctctaaataatcatatttaattttttaaaacaaggttgcagttnctaattgttcgtcctgtgtnttgctttattacacaccagcaaagaacacaggaacgaaacagatagaaactgcaacttgtagctggtgtgtatacagcggttcttttcatggttatttaatacattagctgccgtgtaacataattcttgttatcacatgctctggcaatgtgttgtagaagtgtagttagattagttttagaacccttgtttgacagcc

SEQ ID NO: 492895 - DNA, 706 bp, Homo sapiens
  misc_feature (649)..(649): n is a, c, g, or t
tagcagatacttggccacctttaaactggttggaagaagctatataaaggttatttttttaaggaagaagaccattttacttatgaggttcagaaatctatgatttcctacaaccagtaggatcttacattttaaaatggccagaaaaaaaaattaaggccctctttttttctctttcctttttttgaggggaggagaccttatcttttaaagctgggaaaggtatatagagagagattaagccactttaatatttcacttaaattggccttaaattagctgcactttatagagactcagaaaaggccttttctttaaaggataggccttttctgttggtaaatatttaaatgaaggaaggcattgtgcatatggtgtggaaggtaggaagatgggttttgaacaggatatgaccaaaggactaattaaaaatggctgatctggtgtaggtggcagttgaaactacatccatgtctccataaggcatccttcaaaggcccaggcgctgccaggggtgttgcctggaagctggaggaaccgatttcaggaagtagacactgaagacattactgactccaggcatgcttatgggagtaggaatctggttcttggtcctaattcccttagttaatcccaccctgggaaatcncagaggcttggggatttttccaatttttaggccctatttcaggggttaatgagctta

SEQ ID NO: 492896 - DNA, 530 bp, Homo sapiens
aatggctgagcgtttagctgacaaatatgaggaagctaagagaaaaacaggaggatatcatgaacaggatgaaaaaactacttcacagttttcactcgtgagctcccagttctctactgatagtgagcgagacatgaagaagagaattacagctgatacctgatcaacttcgacattttgggcaagtgccatcgaaacaggttactatgaaaaaggattatcaactagcaaaagatggaggaaggtgttgagtcttccaataaacctcaccattattctctaggtgccgtaccagcgagaagtgcattcatgtccatccgtgtaaggaggagggtgagacacatagatgggaaatgtggtgaatgctaaatcaatgatatccgcaatcatgtagacttctgacaccaccaggagctgactcacaggcctgaactgaacaccattgaaggcttaaacccatattgtaacacagcaggtagaattatctaagtttgataagaaggtgtttgatgagatacatgagaaaatga

SEQ ID NO: 492897 - DNA, 1298 bp, Homo sapiens
  misc_feature (190)..(190): n is a, c, g, or t
  misc_feature (975)..(975): n is a, c, g, or t
  misc_feature (1298)..(1298): n is a, c, g, or t
tggctaagtgtagacagacaggcatggctgagcgaaggccagatgattgtgggcttcctgctgcagaactgcaaaatggactacaggaaggggcatccgcaatgtcggtttgcactagagagcgtgcgctctcctgggactcttcgagccacatgtagatatcgtcgtcatatcgcaatagtcatcatgnctgactttaaataataacgatactcttaggataagaccgatcgctgattaacatgttgtgagaacgagatctgaactctacacatgggacatcgagcaactattagacccaagtgcacgtggtgtcataaggatgcagaaaatcgcatgtgtaccagataagttctccactttgtttgaactcgagattgcgtatgacagagagttgatacttttaacataggtagccgtataagtgcgagaaaacaccatgatcaccgttcgctagactagagatgataattcatccggatatgagataaacctgtgccatgtcgcacatgaaatcgagcagcaagctcaattccaattcggacaaggtctatatccgccaaggtataattaaacagaagggatcaactaataaggtctgattgattgagggaatcagaaggtgcactatcgtgggtgacgcatcacaagggaacacaaagggagatacacaacacaacttcatgaccccaagaggagaagatcccatatggactattcccccaatggcaagacggatccctattacaccagagctaaagggagacacctttcgttcaagcaaccccacgaagacaattgtttggaaacccgagacgcgttatgtctggtagggacacacagaaaggggcaaacatccttcggaaaccagtacggtggacacgttggcgtggcccttggaatataggaagaaggcctttatacattactttgggagagggccctttgctggactcacgtgggagagggatcacngctttttgtacatataaaggccatattgtgtggcattgaagaaaccaaatagtgtagagcctttgagaagtggtccgccttcattgaatggatgaacccattttgtgcacatgaggaacgaggtgagttctcaagacaattagtgttgcagaacgattatatgaacactacacggcgtgcagcaccactgagccacaaaactcatccgggctcaccatctttcagaatggacaatgtgttgagcttagaaaaacgcactgcatcgaggagtgggcaaccgatccgacaaaaagaatggagcataaccaaatggaagacacgtn

SEQ ID NO: 492898 - DNA, 798 bp, Homo sapiens
ccacctcggtgtctttgagcaggtgctgcctgccatcctgcccccaccagtgaggctgggctgagcctcccgctgcgtggcccccgggcgcggcgctcggcttccccacacgatgtggacctgtgcctggtgtcaccctgtgaatttgagcatctgcaaggctggtgtgtccaatggcacctgtgcacctgctgtccccctgtgcagctctgaatgacatgcagtgccctggtcacagtgaactgggcatggtgtggcttgtgggtgtgcctgatggagactgccacccacatcggtcagctgagtccctgcccaccctgtctgactctggatccctgtgccccttgcccccggtgctggcagactcagacgaagacacagagggcttttggagtccctcgccacgaccctttgcctgaccccctcaaggtccccccacacactgacttgacccatccagacatctgcattggtggaccccgagatgctgccccccaagacagcactggcaaacgtgagaacgtcagccagacaccctggaagcccctgtgccctgccccaactcacgcgctgctgaccaccaaagccactccagattgctgctgccgaataaccaaagtggcttgctggtttgggaccgtgtcaagctgacactcagtgcccgggatttgagcccagtagagaagggagccgggcaccccttcagaaagtcttcaaccccaagatgcaatcgagggcgatgtggtaacaagcacagccggggtttatgcacccaccagtccggctactggacgtgca

SEQ ID NO: 492899 - DNA, 552 bp, Homo sapiens
  misc_feature (1)..(1): n is a, c, g, or t
  misc_feature (61)..(61): n is a, c, g, or t
  misc_feature (125)..(125): n is a, c, g, or t
  misc_feature (305)..(305): n is a, c, g, or t
  misc_feature (325)..(325): n is a, c, g, or t
  misc_feature (336)..(336): n is a, c, g, or t
  misc_feature (340)..(340): n is a, c, g, or t
  misc_feature (343)..(343): n is a, c, g, or t
  misc_feature (352)..(352): n is a, c, g, or t
  misc_feature (375)..(375): n is a, c, g, or t
  misc_feature (379)..(379): n is a, c, g, or t
  misc_feature (399)..(399): n is a, c, g, or t
  misc_feature (418)..(418): n is a, c, g, or t
  misc_feature (435)..(435): n is a, c, g, or t
  misc_feature (441)..(441): n is a, c, g, or t
  misc_feature (450)..(450): n is a, c, g, or t
  misc_feature (452)..(452): n is a, c, g, or t
  misc_feature (469)..(469): n is a, c, g, or t
  misc_feature (516)..(516): n is a, c, g, or t
nagatttaaaaatgagacttttcaagcaagcactgcctatagcatagtctcatattttganaatttaaacctatagttttaattatatataaagaactattttaaaaaatcacacccacaagtanaaagactggtaatctgtttacaaagtgcagcgtcagtactgtcaaactcatctcatacaaaagattatgtgtggtttctcgggctttaaaactcccctgtgtttccattttaaatgcttttaacattgagtcatcctgcatacatgaaaagcctgtgtaatgaagccgtgggtcctttancacctgctattaattaattncaacattagtnagtntgngacctgggnagtaaattgtcatcatctgattnatgnggtcagatttatctgaatanaaatttctgcacctggttnatggagttcagtgaatncccaancacaaactnantagctttttgtatattnaatttcttgtaatgctttgtgcaatggtccatttcaaataaacttgnacgattttattatcctccctctttttctcatccaag

SEQ ID NO: 492900 - DNA, 199 bp, Homo sapiens
tcacgtggtagaacacttctatacacattttatgaggcagcattactctgataccaaatccagaaaaagatactacaatgaaaactacaggccagtatctctgatgaatatagcaaaacacacacacacacacacacacacacacacacacacacacacaacactcacacccatcccgagacaccacgcacacccagtc

SEQ ID NO: 492901 - DNA, 1416 bp, Homo sapiens
  misc_feature (219)..(219): n is a, c, g, or t
  misc_feature (355)..(355): n is a, c, g, or t
  misc_feature (614)..(614): n is a, c, g, or t
  misc_feature (910)..(910): n is a, c, g, or t
agcatagtgactcacaccgtgtaatcccacgtcactttgggaaactcgaggagctcaacaggacctgatcgggccatgacagtgagcgcatctgtctgagctacatctcccgtgtgtccacaattcgaggaggtcaccggaggcagcatgctgggatagtgaagcgatagactctcagactagagtggtcttccttcgattagcgagaggttccgaacnattacaggtctggctcgatccgttcaaacatagccaggatacaggacgtgactggacattgcaacgtcaacctgcaaagaactaacaattgaatacggagccttcgtgtggccgagtggctcgtccgagccccgtncagttgtagcccgaagtgggtgggggatagtacgagcagcacgcatctatcattcccttctcgcgtccactagactttggccatgagtctctaagtaccttagagggtagcaccaagataagtaggcggtcaatgcgtggactatcactcaatctagggaatccaaccattcacaagttctagacatggttgaatattgcccccgcggatgcaaccgggctcgtttgtgcatccagtggattgtggctccctagttacngatgaaagggaaaaacacgtactctgtgtggggacttgaaagctacagcagcgatatgaaccggggctaaatcccataaattgagacgtgcaactctcgtaccaaagggcttcgatccagggaaagtggaaccttttgcagtatcttttggcatagccttagggaaccaataggtcccgtatatcaacaacggaaagtctcctaaagcaaatgtgcggcggttgccatggggccccaaagggcacacagaggtaattcgctgtccgacttggttggcaacgacttgaaattttctntcagacaggattctaaaatatacacacacgtgagaagctatggaaggtagtttgactcgcgtacactcagtctgggaggtgccaccacaaatcccaaattatatgggccatccggaagaggcgccggttctttggattcacgcctacgttgggctattacacaatttggcacaattccgtttcgccgaatgcacactcgaaaagaaagttcgattcataacagggtggggcccatttgccgttttaagggggacttcacgaaagacgggaaaaacacacttccctaagtgtaaaggcccttccgttccgcgaggatgggacaccacgcaacacaacagagtggagagcggttccccataggaacgcgacataggatagggccgagaagcattccgatgcgccacccaaaaggaagggataccagataggaccccaaccacagaatgcttgaacgctttgcttgacggagagcgtccacccacggacaatttggagaaccccaccgg

SEQ ID NO: 492902 - DNA, 801 bp, Homo sapiens
cttctttttacctatttcaaattgtagttagatatatctgataaaattctgaatttcttttctgttatcttgaattacttagagttatctaaaaagagctatttgaattctctgtctgaaaggtcacatatctctgtttctcctggattgatccctggttgtcttatttacttcatttagtgaggtcatgttttcctggatggtcttgatgttaattggtgtctaagcattgaaatgttaggtatttattgtagtcttcacagtctggacttgtttgtgcccatcctccttgggaaggttttcaggtatttgaaagaactagggtattgtggtctaagccatagctgcgtgagggggcacctcaagcctagtcaaggttgtggttcttgtagacttgtagaggtactgccttggtggtcttggatacaaccctgaagaattctctgtattatgaggcagagactcttgttctttagccttactttttcccaaacaaatgaagtctctctgtgctgagctgcctagggctgcaggtagagtgacatactacccccctggccctcactactgggactgtgctgggtcagacctgaagccagcacagcactaggtcttgcccatggcttcctgtaaccactacctgggtaccaccatgttcactcaagtccctagggctctaccatatagccaaggtggtgaagcagccaggtgggtgtctaaccttcagggcaggagagtaccccaagacccggggtgggtaccagagactgggcatgaggagctagggactgcagacgaaga

SEQ ID NO: 492903 - DNA, 349 bp, Homo sapiens
cgatagaatcgagctcggtaccgactgcatctgtgcctctacaaggttaacacttcggctaaatagctttgaaattacagcttcaccaggactttacattcagcactaagaaaatagacatcttaggccgggcgcggtgctcacacctataatcccagcactttgggaggccgaggtgggtggatcactaggtcaggagttcgaggctattctgactaacatggtgaaacgccatctctactaaaaatacaaaaaattagccgggcatggtggcacgcgcctgtagtcccagctactcgggaggctgaggcgggagagtcacctgaaccagggaggcatagattgcagt

SEQ ID NO: 492904 - DNA, 2182 bp, Homo sapiens
gttaagaaaatgtgccaagattacctcagtaattctggtctgtgttctcaggagaccctggaaataaacaatgtgtcttctgtggcttcagcgtcacctagtgcaggctgccattcaacaaacgcattgtcaacagtcaaccaaaagaaacccattggccaccataccctgaggactaaccctgacacagatgcccttccagatgccctcagtagtctaactgattccatcgccccagccttgggggagaagcactgctgcctatgcactccatttacaggtgaactgtcacccctacaactcagcttgcaaccagccctggccaccaccagtttccccacactgagctgaatattggacatgcccatcttagacattccagcccattctgaaattccacatcgattcacccgacaaagtctgaagttccagggcaatttatctggaaaagctcacctggaatcatgtgtcatttcaaccaacaactgtcgaagaggacgtggcatcaaaaccaaggttatcaattatttataagggttgtgtggtggttggtccaagcatctctccttcatgccatcactcctttcaagagctgcctctattttctaatttagcacaggaatttagatgcccctaaataagtaggcatccagtatctgcccacaccagttttagtgagagtacatatggagacactgccaccacccctgctctcctactgcataccccaccatgccaaagcatggtggctcacacctgtaatcccagtgctttgggaggccaaagaggaggaacacttgaggccagaagtatgagaccagcctgggcaacatagtgagacctcatttctataaataagttaaaaaaacaaaaaaatagggcacagtggtgcacatgtgtggtcccagttactcagcaggctgaggctggaagatcacttgagcccaggagtttgaggctgcagtgagctaggattatgccactgcactctagcctgggcaacagagagagaccccatctctaaaaagagggagaagaaggaaggaggaggaagaagaggaagaggaggaggagaaatactgctctttctcaggcccaaggtaaaaaggtttttggtctcatgttgaccagaaagacattgatatttaattaagcaatataaaaaggctcattgttaggattaaagagtaagtaaaatcaatattgagataggaggatggaggacaccaactgagttccgatcccaatgaagaggagaaaaagctacaactatctaggtgaaatatctacttatcctagaagaagccttttgacagcaacataaaattcatacctataggtttttaattcctatggatgccgtagcaaataacaaaaacttggatggcgtaaagtaacagatgtttactcttttccagtattggagaccaggaatctgagatcaaggtgtgggcaggggtgcgctccccctggaggttctaggagaggatccttcctgcctcttccagctcctggtggccccaggtgtccctgggcttgtggccacatcactacattctctgcctccatctccacgtgaccttttcctctgtgtctgtgtctcctcttctgtctcttagaaggacactggtcattggatttaaaggccacctgggtaatttatagtgatctaatctcaagaatctttccttaattacatgcaaatactctttatccaaattagtttgcattcacaaattctggagcttagtacttggacatatattttggggggttgatggttggaggggcttttattcaactcagtacatcttaataaggaattaatgccccccaacttgccttacaagtcatatattaaaaacaatgttggcctggcacagtggctcatgcctgtaatctcaacactttgggaagccaagggaggaggatcacttgagcccaggagttggagaccagcctggataacaaagggagacccagtttctacaaaatatttaaaaattagccaggcatgatggtgcatgcctgtggtcctagctattcagggaactgaggtgggaggatcacttgagcctggaagttcaagacagcagtgagctatgctcacaccactgcactccatcctgggcaacagagctggactctgtctcaaaaaacataacactaaaacatcaaaatt

SEQ ID NO: 492905 - DNA, 716 bp, Homo sapiens
gtctcgctctgttacccaagctggagtgcagtggtacaatctcatctcactgcaacctccgcctcctgggttcaagtgattctcctgcctcagcctcccaagtagctgggattacaggtgtgtgccaccacgcctggctaattttgtatttttagcagggacggggtttcactatgttggccaggctggtcttgaactcctgacctcaagtgatccgcccaactcgcactcccgaagtgctgggattacaggcgtgaaccaccgtgcccagcctgtgtgttgcttattgacacctgagaaagtcgacataaggcaattccgtcattgtgtgaacatcacagggtgcacttacacagacctagatggcacagcctaccacacacctaggccacatggtgtaacctattgctcctacgctaccaacctgtacagcttgttaccccactaaatactgtaggcaactgtaacaaaatggtaagtgattgtgtatctaaacacttctttatcattattattataccttaagttctagggtacatgtgcacaatgtgcaggtttgttacgtaagtatacatgtgccatgttggttgctgtacccattaactcgtcatttacattaggtatatctcctattgctattcctccccctccccaccatgacagaccccagtgtgagtatctgccgggtcccaggtcatggaatccactatgagaaa

SEQ ID NO: 492906 - DNA, 170 bp, Homo sapiens
tgcggcacggcggtcagtggtcttggtgtgctggcctcgtgagacgaaggccccagaagtgacgcagccctctattggcccgaatcttctggagtcgctccaggtcttcacggcgcttgttgtccagaccattggctaggcactggctgtattttccatccctctcggcg

SEQ ID NO: 492907 - DNA, 195 bp, Homo sapiens
ctagcgtaaaaggaaaatacagaaggatcgtcttagtggccagagttaaacacacatacatctgcccaaatcttcccagagaggtgccaaaggacaggttgtctatagccagagaaaaaaagagttttgtttggctgcgagatagagagcccagtctcccagcggtgttctggacagtttttccttaagggccag

SEQ ID NO: 492908 - DNA, 325 bp, Homo sapiens
aaaatgtagaggaaatagaaatgtatttaagggcacagaaataaatgctatctacatgcaaatcatggagagattcaaaaatagaaaagaagttaacagtgcctaaatcctagagttgatcacatgtagtgtaagaataaatgtatgaaaactcattaaattgtagtatcagacttgctcaaggagttaaaagatagagattagtgaaagacgcagagaagtttaccatagaagataaatctgaataattatccatcacaacgtaaaatccaattcagacttcagtaaaaaacacctataagagtgaaaaggcagggaggaagaa

SEQ ID NO: 492909 - DNA, 594 bp, Homo sapiens
tccaatttgtccaactacttcatcctctgtacatactttaccatgtccaggtgtactgtcacgcaagtagttatcccgtatgattgactgcctgctcaattatcacctcatccagctccgtcttctttagaacactgtatcatggatctgatgttacccagccgtcattgtctctgtcatacgtgctgaagatcatgccgttgtgaatggtcatggtcctgatgtctcccatcatctgagatgctccatccatgagggcattacgaactgttcctctatacttgttcactaagatctggtatgtgttggcttcattctgtacagtgattcctccatagtgagcctttactatgtctccattccagtcctccatgtctatcaaaagttctgtgggtcccatcctggtaagctggctacttgtatcatttccaagccaatattcacttgctagtcctcagtaattcttcccatctgtgttgtctgcatcatttcctaatccctgaatcactgtccatcctacatcttctgtattcatgtcccagtatactcgatacggtttgacagctctgtcaggttgaatgacatacatctcag

SEQ ID NO: 492910 - DNA, 879 bp, Homo sapiens
tcttcaaggaggacgactgacaatcccccaagcaccatcaaccgagccccccatactcgctatgttggagctccagaccctccataggacacgcaaaagccctgggccccaatggaagagttttcctaccagcgcttcaggactcgggcttgtgcagcacgagacgcttacagcttgatacgcgcagtggcaaagagactttagggaaaggacggtgtgaagcctcagaatgagaggagtgcacgaagcggttcacacactgatccacttggctactccctgtcaggacacatagctcctgaaaatggtagcgctcagtcacttcctgcaccagcggggtccccgaactgcttgctttgctggctttcccgtaacaccacgacggatctatttgtcgtcgttcccatcaacgacctgttcctagccatagaagatgatatctgaaatatagatcaagggtaaagggaacagatgttgcagctcccgacccctgtaatccccacaacaccaagaccacaggtctagcatccagggcaacagcctgccttctctcctcccaccacccccactgcccatcttatgcctcgctcctttgcgtgctaccagaactgaccgtgaacggcatggaatccactctgtgtgcatgaatcttctgtgcctgccttccattagactttgcaccagagacacggttgtccagcgagtgaccctcaggctcgttcatctcttctcattgcggagcctgagcggcccagtcacaagtgtactgtaacactcaagatgcaccatacgccttcatgcccatatggtatgtggaagctatgactcaggacctcccatcaccccccaagactcatctcccaagtagtaatgctttta

SEQ ID NO: 492911 - DNA, 131 bp, Homo sapiens
cagggagcagaagtccttctggacagtgtgatgcccctgtcagacgatgagcagttttcccggaagcagatgccgcatgagcgagatgacggggaatacagcactgcttgctccaggtgaacaagttacag

SEQ ID NO: 492912 - DNA, 1049 bp, Homo sapiens
ggcagcgctggagtcaaaagccggttccggacccagttccctgtctgagcagtctgcctcctctttacaaatgacagatgcccgcttgtgtccttcgccaagaggactttccttggacaaggtgtacgtgacccggagccaatctcctaacgacgccgatagccgccatcagaaggggcgactcaaagcatcgatgctgcatggtggcatagactcgagacgagacgcgaagactcgacggagagaatatacaaaaacacaacgtcgctttcattacgcccggcgttagatcaaggaaatccccaggagatgcacggcatcttgctgcgaccttgtcatgggcgagcggatacccgtgccccactttgtacatcagtagtattaacccaaacagagagggttctaaaatatgcgacttcaaaggaatacctacaaggcaggaaatcacacgtggggaggtgatgaaaatagagaaacacgttaggggcaatcaagttgacagggaagtcggacaatggcggtgcgccgatgcggtacaattacattgtgttgtgttgaacccaatatgaaattgggacgagaaaaccaggtataacccagtcgatagttaggaataaagtgtggacgtatgacaagttgggatagtacgaacgcccgctgtgtgagacgtgactgggataatgaatatgagagattcagtatgcaatagaggagctgtaacagaggctataaatgtgttgtggcagggaataattaattaacggaggcggacagtggggtatgtaatgacagtggacgggaaaggtgatcgcaacccaaaaacaatgaatgtgcagtgaggttgttgactgacagactgtagagtggtagcgggggtgaaactaattaatataattgtatcgacgagtaatgataataggatacaggaaatgactaattgataagcgaactatagtgtagtaatgtacgtgttagaggaattttcaggacgtgcactatataacacgggaggtagtgttatgtgtagcgaagaaattattagtatgccg

SEQ ID NO: 492913 - DNA, 177 bp, Homo sapiens
gttgggctgaatggctgtatcaccaccccggtgaatcatgacatgatgaagttttgtgagtccgggccctccagctcatcagggccacgcacacctccgtccctccaagttgtagaattttgggggcggaggcttggtccgggaccagaagactgttcggcagactccctttccttg

SEQ ID NO: 492914 - DNA, 395 bp, Homo sapiens
gactcaagaggatcccagtcggttctaccatagatttaactgactactaagcagttttattgggtggctccttgaatgtggcaaacacttaaatgcagtccctgctttaaatgaacttattgtcacaagatttcctttttattttttctctatatctttgtttacttattcttttccatcattgtgttataacaaactatagaaaataatgtttcctatattccatgatgtattcaggaggaaaaggataattcattaagttaaaattattttccccaagtcattcctgtgaaattgcagaattgtagaatcttgccaaaaaattaataatgattacttaaaatatttaagtagtttaaaagtaggtaaactgttgctgtatggtagaaccgact

SEQ ID NO: 492915 - DNA, 307 bp, Homo sapiens
cccctcctttccagcccaattttttgggtccaaaccgggttgtcccttttttagaaaacccttttaaactttttaaaaattttaacccttttttcagcaaaaatggagaggggtgccaatcaattcccattttttaagccccttaagaaaaacggtccttgggcatttttgaggttccctcatggagctccccaaatccatttttagggaagggattttgggtcaaaacgatttgaccccctttgccctgtcccccaggataagtgacccctaggccccaggaaataaaagccgatgatttgtgtga

SEQ ID NO: 492916 - DNA, 414 bp, Homo sapiens
  misc_feature (347)..(347): n is a, c, g, or t
  misc_feature (394)..(394): n is a, c, g, or t
  misc_feature (408)..(408): n is a, c, g, or t
gggcacaggtcagtgggaggcattcgtgcctctctgtataacgctgtcacaaccgaagacgttgagaagctggcggccttcatgaagaatttcttggagatgcatcagctgtgaacatgaccagccacgctctgcctgtgagcagcacgcagcgtcgtttagagtaacttgggattgactacagaaacttaacagacatggatttttttttcccaaatacatgcttattacagattcctttctcaaagaataacgacttaaacatcaagggcactgcagagcttgagggaaactccccaggttaacaggccaccttccattctcaatgttgacctgggaagcatttnggaaaggtttctttcccggttggtctccttaaattgaattcaagccngtcaagccactttnggttgc

SEQ ID NO: 492917 - DNA, 212 bp, Homo sapiens
tagaggatcccccgcacgtgtcggataagcgggttggccaggtgtcatagtccttctcgtgcaacagggcggcgcgacacccaggctgagcgtggtagatgcacgtccatgtccacgtcgcttcccaaggccagcacggtggttaccacgttctgcttgggcatggagtgcgctgactcgtgcagactgtcgttgcccgtgacgccgtccgt

SEQ ID NO: 492918 - DNA, 550 bp, Homo sapiens
ggaaaacccggtaatgatgtccgggttgagggataggaggagaatgggggataggtgtatgaacatgagggtagactttcattctcccctttattataacaattcctttttttaacaaacccaagtgagaacagtctacagtgttttacatttttgcaaatctcttgactgtccggcttaataaaaaacagctggattctcatatcggcttctgcattcaatcagctgtgataaatgttgttttggataaaagtatgccaaggaaaccccgcctcacgcagttatttttgttgaaaagggaggaaaatttttatagtctcttcaaataaattgtcaatattctcttttgccattatacccaaacccaacccatactgtcttaccttcgctatctcccattccgcacacttaaacctattctataaactttttgtcctcaattttcttaaaattcacctatctgcctttgccccttaataaatcttttgctcattcctgcattttgaaaaatcatccatgggccatttggaaaacatttctttctcttact

SEQ ID NO: 492919 - DNA, 437 bp, Homo sapiens
ctaaaccctcattgcttgctgcagaaagtcaaatttcttatttagggttctcttgcccaaatgtttccaagaatccccggatccttatatgtgtccaaataacagatctgattgtcacgtggggctgagctatcacttcatatcctcaagccaaagaggttggccaagatggctttctgccctcttaattgttgcagtcaccttcatggtaaagatggaagtgggtgtgaagtaagaaagataatgccttttttggtggtactttctcttagggatagaggtgtcccttcaaatcaagataatttgaggcttaaagtgttatagcaataactgtgagtggattttcttagttagttttcattagtccttagttttctcaggtattatcagcctggggggaaggggcagaagatcttaattccctgaccaaatagcat

SEQ ID NO: 492920 - DNA, 429 bp, Homo sapiens
ttgacaggtgcgcagccacgctgggctaatttttgtatttttagtagagactgggtttcaccatgttggccaggctggtctcaaattcctgacctcaggtgatccacccccttcagcctcccaaagtgctgggattacaggtgtgagccactgctcccaccttctcccctttttctgatactctctttgatatagtttggatgtgtgttcctgctcaaatctcatattgaattgtaatctccagtgtaggaggtggtgcttgagatgggaggtgactggatcatgcgggtggatttctcatgaatggtctagcaccatctccctaggtactgtcctcatgacagcgagtgagttctcatgagatctggttgtaaacagtgtgtaacgcctcctccctctcccgtcgctctgccatagggtaccgagctc

SEQ ID NO: 492921 - DNA, 97 bp, Homo sapiens
ggagccaggcttcgcttcaaggcggctctaccttttctcagaatggtttcctgatgtgtcaatgtgaaagttaaataaaatttatgtgccaaacctg

SEQ ID NO: 492922 - DNA, 281 bp, Homo sapiens
cgggcccagcctgcccaaaccttgggccctggaagagtccttcaccccatcactagagtgctctgaccctgggctttaacgggccctattccaccgcctccccaactagagcctgtgaccttgggaccaaagggggagtccctctactattgcgactcatcctaggctgcggccactttcagggaggggccggctggcctgaacgctcagcccaccctacactttttgctgagggtgctctgacgtccacgattatggagcactattacccttatccaaag

SEQ ID NO: 492923 - DNA, 448 bp, Homo sapiens
  misc_feature (407)..(407): n is a, c, g, or t
  misc_feature (434)..(434): n is a, c, g, or t
cacattaacctcggttttcaaaagtgttcttaaaagaatttttacagccaaatacatagaaactagatgatttttcaacttacagaaaactacccaactataagataaccagagacatttattcaaggaagtttcataagttatgatcaattctccatttttaatcatctgggggatttgtttctaaactacagtttaagtgattttagcttttgatttgtgttcatcatagatataaaaccttatttgtagatggataaactgccatatctgaggtaggagaagctgtgagttcagggacagctttggctacatatcgagttctgggacagctggcctatattgtggagcctgtctccaaatcaataccaaaaagaaaataacatggactataatattttttttcntcatatactttttaaaagtggggacanttacccatttttcc

SEQ ID NO: 492924 - DNA, 217 bp, Homo sapiens
  misc_feature (27)..(27): n is a, c, g, or t
  misc_feature (114)..(114): n is a, c, g, or t
  misc_feature (133)..(133): n is a, c, g, or t
tttgagaccagcctgggtaacacagtnagaccccatctctacaaaacatttttaaaaattagttgggcatggtggtatgtgcctatagtcctggctactcaagaatctgaggcnggaggatcactggagcccnggagtttgaagttgcagtgaactataatcatgccacttgtactttaccctggacgacaaaggggagactctgtctctttttaga

SEQ ID NO: 492925 - DNA, 409 bp, Homo sapiens
  misc_feature (409)..(409): n is a, c, g, or t
gtctagactccaaagccaggcgagagatagagagaccaggcagatgaggagctcaacagaataccaagccgatagctgcgacggaccaagcttaacgctgagtcaacagcccccgtgctcttcacaggagtggtggatgctcgttgagagcggactgtgctggcactggcgggaagtatggctgggacatcggtagatgcttaccacctggtcactgatcgcatgcgccggacagtcaagttcctgtgtgctctgctgcggggaatcttcaatctgtccgtggactggctgcatcaggcccgtaaggctgcgttctatataccgccggatgaatatgtggtgaccgaccctgagcaggagaagaactatgggtttagcctttgacgcactgagcagggctctggagctn

SEQ ID NO: 492926 - DNA, 102 bp, Homo sapiens
cgtagctgggcaggccttatgtgggtctgagaggggggcatggctgaggggattgcctttggagtgtgcatggacattaccacagaaagcctgtgtgaagtg

SEQ ID NO: 492927 - DNA, 1474 bp, Homo sapiens
ggactttcacttggcggagcatgagtgacgtgtgggggacaagtatccatcttcattctgtgcagcaggttgtatagagagctcgcgccttcaaacgtaatctctaacttcgtggacgcgagtgacctccaggaagtacatccaatagagtaacagtcatgagccttgattctagtacggaagctgaaagattgtattgagttaccatttactggcctgcggaaacagctagcacaatcagctttgccacaatccttatcgagcgggacactgaccatcgtaaaacgctcgtacactgacgttcgtgcaaagcgcatacgctggggcttcagcaactgcggcagcacgcgaaccactgcatcgatccacctccgaggcaacggtcccttaacacgaccatgctattcccgatggagcaagtgcgcttaccatgtccagagcttgacctgggggactttcccgaacgccgccagccagtaccatccccacttcgttcattccctcgcttgcgtccctacgccgctacacgccgcatttgcactttgccctttgcgtgccccgcgccttgcgacttcccctgcttgcgccttcttcgccctcctccgcgcctcgcacccgccctcttcaacccccaagaagtgtctatgtatccccatccgagcggcaggacaatggccacgtgcggaacttgcggtataagcacggcgaacacgacgggcaagccttccattgtacaaatctcccggcatcctgtggtcgcgttccacgtccgtggatcaagcttgcaccaacgctacttgcttgcacaccactagcgcacttgacaccactttgactgcatttgtccgcacgagtggtacgggcacagtgtccaccccagtgggctgactgagagtgcctccgataatacacttcgtcgctctctatctgcccttactccctaatacccaatcaatatcgcttatcccccttgacatctcttgacactactgccctaatattcaatgtaactgcggtcccctttaactactccaacccgtcattctcctttccttgccagctcaactctcgactgcaaacactgccctgtatatatctccacagatcgtaatcattactcccgcgccaaatagcaagccttggccacgctctttgccacgagcgcaacaccattcacccccgagcaggagccgcattgtaggatgcatctcactcggcccccctttcagagcaatataccatcgggtgttcccgcggacgaaatacctccccttggattgctcactgcagttgatctcggcaacaagatagcactcacacaatacccatagatataatggacgcattggtcccaccgcgtgcactcgtacagtatgacgcaatcgtcgtccctacaggtttgaatccctccgtcttcactcgctacgcggtctccctctctcgagtccatttgtggttgtccgctcgtgtccta

SEQ ID NO: 492928 - DNA, 118 bp, Homo sapiens
cagctgattcacagtaaagtcatggagctcacacgtggctcgcaactggggcataaggacgataaccggcatccccatcctcagtaaaacctcaccacagcccccacagagagagcgt

SEQ ID NO: 492929 - DNA, 341 bp, Homo sapiens
tgccactttttgcaactggtttgttgtcacatttcatctccattctttgcatttctgagaacacttaaacgtttctgcaggtccattttatatctaacttgaaagaccgtataactttctggttgccagcatgcttatctttcttttcagctcatccattttacagctgtgccctactgtgattgattttccaaatctaaattaccttgagcagcagtttagcataatatgccttcagtggcattcaataaatggagtttcccttagcacagttctgtcagaagtgcgtttgagattgtgtgtatatatatgtatgtgtattttaagttattatttgtatt

SEQ ID NO: 492930 - DNA, 511 bp, Homo sapiens
  misc_feature (231)..(231): n is a, c, g, or t
  misc_feature (239)..(239): n is a, c, g, or t
  misc_feature (257)..(257): n is a, c, g, or t
  misc_feature (312)..(312): n is a, c, g, or t
  misc_feature (337)..(337): n is a, c, g, or t
  misc_feature (378)..(378): n is a, c, g, or t
  misc_feature (463)..(463): n is a, c, g, or t
  misc_feature (466)..(466): n is a, c, g, or t
atgaccccaatacgcaaaattaaccccctaatctaattaaccactcattcatcgacctccccaccccatccaacatctccgcatgatgaaacttcggctcactccttgggcgcctgcctgatcctccaaatcaccacaggactattcctagccatgcacttacttcaccaggacggccttcaaccggcctttttcatcaatcggcccacatcactcgaggacgtaaattangggctgantcatccgctacctttcangccaatggggccttcaatattctttatctgccttcttcctacacatcgggacgangcctatatacggatcatttctctantcagaaacctggaaactcgggcatatcctcctgcttgcaantataggcaacaggcctttcatagggtatgttcctcccgtgaggccaaataatcattctggagggccaacagtaattacctttacnatngggccatccccatacattgggggaaggacctagtttcaatgtctg

SEQ ID NO: 492931 - DNA, 374 bp, Homo sapiens
  misc_feature (18)..(18): n is a, c, g, or t
  misc_feature (64)..(64): n is a, c, g, or t
  misc_feature (213)..(213): n is a, c, g, or t
  misc_feature (218)..(218): n is a, c, g, or t
  misc_feature (240)..(240): n is a, c, g, or t
  misc_feature (278)..(278): n is a, c, g, or t
tgcacgatggaccgtganctccaccggggactcttaatctcggtggaatgctgtgcttatcctncctggggtgccagagtttggaaaacgggaggcgatgctgaatttaactgtgtatccttagtgtccggcaccgtgtttggatctcaaggggagctcagtgaatttgatggatgaacatgtaaggtaacagatgctcgcttcctttcgggnaggcntcatctggcttcaaaaaaaaanttcatgtcgcctctgctgcagtccacttcctatcgcgnatctctacctaattggactacactctctctactcttcattgactattttgaggtttttccggataaaaaacaaacgtcagcatgccaaaaaaaaaa

SEQ ID NO: 492932 - DNA, 828 bp, Homo sapiens
tgggaaagtcatgtcaggggtagtaatataatggtggggacaattagtttaaccattgggagtaggttaaggttattgtacgtagtctaggccatatggtgttgggaaattggaaactagtagggctaggcccaccgctgcttcgcaggcggcaaagactagtatggcaataggcccaaatatgggtctaaaagggatgtgggtgtttagacgggttaatgagaagctagcctaataatgtgaaccagcgacatagtatttatttcccttacataggacattaacatagggaggacattgagggtgatgaagcgactaataccatagaatattacccatagaaaggtgacaagtggtaaaagtgccacaagatacataatcactataaacatgcataacaaaaagggagagaggaacaacatgagagaaacaacaaaataatgacagtaaacaacaacaacaacaaacaagagcaagactcggaaacacacagagagacacaacaagcaaaaaaaataccgtgagaagaataccgaacccacgagggaacccggcaccgaaacccagcaccgcgaagaggtacaacacgagagaactaaatgagtccacaaggcaaacaaagaagacacagaaaccacccacaaaaaaagaaccaaagaggaaactaattgagggacggaaagaggagaaaaccacatggaaatgagcgacgaaaaattacgagaaaaaaaaaacgagacaccccattggaggcgcaggcgaacaacacacgggacaaacaaagggcgcggaacagacgatttaaccagccatctgaggaagcgacca

SEQ ID NO: 492933 - DNA, 353 bp, Homo sapiens
  misc_feature (272)..(272): n is a, c, g, or t
tggtgattaagatccacacgtacgcttcttcaggctctgtcacggtcacagaatctaactggctcttctccatagtagggcggcgattcagcactgtctggcaggtaaccttattagcagtgtagaaaaagaggcagaggaagagaacaaaagaagaagaggaagagggacatgaggaggcggttgtcgctggacttaacgatacatggttttctccgagtggagctgggggacccgtgtttgatgacgatctttggttcgcaggatgtgcnggtggcgcaggccttgggaggaagggtgattggcccgggaggaggtggcctgcaccggcttgggggtttggcgggaaaggc

SEQ ID NO: 492934 - DNA, 138 bp, Homo sapiens
  misc_feature (40)..(40): n is a, c, g, or t
  misc_feature (125)..(125): n is a, c, g, or t
tctagggtgaagtttattctgttttcacatctaggttgtnggggagagtgatagacaaagttctggattctgggcatcgtcggcgcatgcttgtaatcctacttgggaggttgagacaggaggantgcttgaacccag

SEQ ID NO: 492935 - DNA, 81 bp, Homo sapiens
gcggccgcctactactactactgctcgaattcaagcttctaacgatgtacggggacatggggttggtttgaaaccagcttt

SEQ ID NO: 492936 - DNA, 332 bp, Homo sapiens
tgtgataaggatggaggagcatccctatagtcatctccaggtatatggaggatacatctactattaggactttacgctacgaagcgaaagcttctcaaatcatgaaaattattaatattactgctgttagagaaatgaatgagcctacagatgatagagatgtaacatgtggtgtatgcatcgggatagaccgagtaacgtcggggacatccggataggccgagcaagtgttgtgggaagaacagttagacattcactctgatgcatctgctagtgacctggcttttggcgtaggtttggtctagggtgtagcctgcgccattcactctgta

SEQ ID NO: 492937 - DNA, 170 bp, Homo sapiens
  misc_feature (27)..(27): n is a, c, g, or t
gagctccttaccgtttgtgtctgtgancggcccactactggtggatgaggcgcctacaactcctgctcctctgctgactcggctggcccagcacatgaagtggtcatctggtttcgttcctagactctgccttggaaagcagtccatccctgcacagtccagctgacccc

SEQ ID NO: 492938 - DNA, 757 bp, Homo sapiens
  misc_feature (578)..(578): n is a, c, g, or t
  misc_feature (592)..(592): n is a, c, g, or t
  misc_feature (649)..(649): n is a, c, g, or t
  misc_feature (710)..(710): n is a, c, g, or t
ggcacgaggtcacaactgaccgtgccgcatgacctctcagagcctcagctactggaggagacatgctctcacgacaggggagaggcactaagtcatggacctggctgcaaggtactgaaggctgctgcagctatggctgcacgtcaccctcctgagccgcagctttgctggcagacatcctggtgtgaaatcaccacattctgcatctgcaaggctccccctacatcctaaagactcatgtgacggactcagactactgactacatgtggaattctctctgctcagagatctcacttaaatatatatacacagccttggatacgtgataacactagtgtgcacaccagcatgcttgaagaggcacgtctgggccagatgctgcgcaggccgcagctgcagatgggcctgtgtgcacacaacatgatgctatgcatgtctagtcgacgatcactcaaccagactcagattcaggagctcagctgcatactcactagggactatggatacctgcatacgcaacggatatcaacaggggaagaggtcttgctcgaagagactttgagcaggtctacaactnggctgacatgatcngactggtacgtgaatagactgtcgtagctacttctgtcagactcactgatacactantactatatgtgatgcatcaggactgtctgactactcagtgatgatgctagtgtcgtcaggnactcagcgacgtagcatgggcacaacacatcgatgttgctgcgggcc

SEQ ID NO: 492939 - DNA, 1307 bp, Homo sapiens
  misc_feature (7)..(7): n is a, c, g, or t
  misc_feature (65)..(65): n is a, c, g, or t
  misc_feature (101)..(101): n is a, c, g, or t
  misc_feature (119)..(119): n is a, c, g, or t
  misc_feature (128)..(128): n is a, c, g, or t
  misc_feature (135)..(135): n is a, c, g, or t
  misc_feature (141)..(141): n is a, c, g, or t
  misc_feature (163)..(164): n is a, c, g, or t
  misc_feature (167)..(167): n is a, c, g, or t
  misc_feature (185)..(185): n is a, c, g, or t
  misc_feature (232)..(232): n is a, c, g, or t
  misc_feature (250)..(250): n is a, c, g, or t
  misc_feature (277)..(277): n is a, c, g, or t
  misc_feature (280)..(280): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (323)..(323): n is a, c, g, or t
  misc_feature (335)..(335): n is a, c, g, or t
  misc_feature (343)..(343): n is a, c, g, or t
  misc_feature (351)..(351): n is a, c, g, or t
  misc_feature (354)..(354): n is a, c, g, or t
  misc_feature (359)..(359): n is a, c, g, or t
  misc_feature (372)..(372): n is a, c, g, or t
  misc_feature (384)..(384): n is a, c, g, or t
  misc_feature (388)..(388): n is a, c, g, or t
  misc_feature (419)..(419): n is a, c, g, or t
  misc_feature (456)..(456): n is a, c, g, or t
  misc_feature (461)..(461): n is a, c, g, or t
  misc_feature (839)..(839): n is a, c, g, or t
  misc_feature (847)..(848): n is a, c, g, or t
  misc_feature (852)..(852): n is a, c, g, or t
  misc_feature (862)..(863): n is a, c, g, or t
  misc_feature (871)..(871): n is a, c, g, or t
  misc_feature (875)..(876): n is a, c, g, or t
aaagtcnatcccttgattctcccgttggggaacaatttttcgtttgcctggtcaggtgcctggcnagggagcccatgttttctttccctgggtccctgaanaataatagcaggccctgncattaaaanaactggnttttcnacaactccccaccaaagccgcnnccnattacagataggagagtntttaaaagaccccactcagcccctctaagaggccttggacaaggacngctccccaaaggatgacntctgggactctttgtccattttctcgnttnccggnaaaggngcnagnagatgttctccaaacgctttgaaccnaagcatgggccncgcccacnggcccccnggnagagntcaagccatcggngctgctagagtncttnctggactttccagagaccagtattccctttngctgcctctaaaaggcctgtccccgcacacatcaganacacnccggtctcatgggggtcacaagcttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactngaaataanngatngtatagtgcnntgtttttnaaannaaaaaaaaaaagaaaaaaacaaaaaaacaaaaaaacaaaaaaaaaaagggggggggggaataaaaaaatttacccggagggtggcgccccaacttaagaggctgatgcaccacgatcatattgcttggtcgatcaaaaaaaggcgggggcccccaaaaataggagaggacagccgacaataaataatgacgacaggaccgactcgatcgagcccacgccggtctttacaaaacacacgctcgtgctagctagcgcggcacaaaaacacgctccaagcacgtggctggcggccagtctatcgtggaaaacgcagaacaccccacaacaacggagtagggggggggcgaacaaaaacaaggaagaacaaacaacgtccacccaaacagacaattaccaagcagctgctcggaggggacacacacccacacgtt

SEQ ID NO: 492940 - DNA, 116 bp, Homo sapiens
aaagcagccaccaattaagaaagcgttcaagctcaacaaccactacctaaaaaatcccaaacaattaactgaactcctcaaaaccaattggccatctatcacctatagcagactaa

SEQ ID NO: 492941 - DNA, 936 bp, Homo sapiens
  misc_feature (7)..(7): n is a, c, g, or t
  misc_feature (85)..(85): n is a, c, g, or t
  misc_feature (90)..(90): n is a, c, g, or t
  misc_feature (468)..(468): n is a, c, g, or t
  misc_feature (476)..(477): n is a, c, g, or t
  misc_feature (481)..(481): n is a, c, g, or t
  misc_feature (491)..(492): n is a, c, g, or t
  misc_feature (500)..(500): n is a, c, g, or t
  misc_feature (504)..(505): n is a, c, g, or t
ttttctntatttttttcttgacgtgctcagaaaccatgaggcccgggggcgtccttgaaaaggcctgtccccgcacacatcaganacacnccggtctcatgggggtcacaagcttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactngaaataanngatngtatagtgcnntgtttttnaaannaaaaaaaaaaagaaaaaaacaaaaaaacaaaaaaacaaaaaaaaaaagggggggggggaataaaaaaatttacccggagggtggcgccccaacttaagaggctgatgcaccacgatcatattgcttggtcgatcaaaaaaaggcgggggcccccaaaaataggagaggacagccgacaataaataatgacgacaggaccgactcgatcgagcccacgccggtctttacaaaacacacgctcgtgctagctagcgcggcacaaaaacacgctccaagcacgtggctggcggccagtctatcgtggaaaacgcagaacaccccacaacaacggagtagggggggggcgaacaaaaacaaggaagaacaaacaacgtccacccaaacagacaattaccaagcagctgctcggaggggacacacacccacacgtt

SEQ ID NO: 492942 - DNA, 951 bp, Homo sapiens
cggagacgaggatgccgggggcccgaaagtgagattggggcactcctgacaagaaaggaaagctgaaaggcaaaggggttctaaaggaacggcaacccaaggaaaaacacgggaggacatccagggcagagcgaagaataagacctagaggtgacccaggtagacggatcaaagccattctcatcaaaaaccaatgtcagtgtgaaccagaaagtgcccaaccaggtatacccaaagttcataggaatcacagggggaaatcagaatagacaagggcaatcctgacgaggggaagaactgaggcatcgcgctacttagcttcaaaacattgcggggctatggtaacccaaagagcatggtatgatataagcgacacgcggaccaatggaacagaatagaaaacccagagataaatacatatatttaccaccaactgattttcaccaaaggtgccaggaatgtgtatcagggaagggatgccctcttcgatgaagggtactgggaaggctgaatattcatctgcagaataatgaggctgggcccctaatgtctcaccatacacataaaattaaaatgattggagacataaatatagggcctgaaattatgaaactactggaggagaccacaggggaaatgtttcaggacatgggtcaaggcaaagattttgtggctaagatctcaaagacaaaaatggacaggtgggactatattgagctgaagggattctgcaagacaggggagacagtcagcggagtgaggagacaatctgtagaacgggagaatatgtgcagactatttatccgacaggggactagtgttgagagtatacaaggaattcaacagcaaaaggaaaatcccttttaaagagtgggagggggaacgtggcggggacatttctcaaaggaggacatacaaatggccaagtatatggagggaatgttaacatcg

SEQ ID NO: 492943 - DNA, 509 bp, Homo sapiens
gcaagaaaccagagcgggacaatcagttaaagcagtgaaaatagattattcagaactatgacaataggggaacagatactatcggtatagaactgggctcaataccaaatacaaggtggaccagtggggattataaatatagcccaggagcagagtggggccagtcgatggaaaatgactaatgcgaggaaacatcaggggtaaagggggattgttacgtaaactgacctgacaagattcttgctgaaggcaggtgagggtgatcaaatattacgtgggggatagtacaagatgaggaatttgatcagatattaagggtgatcagatattgaggctgggagattctagctaaactgacttatcaggaatcttgctaaaatttggcaatgccaggattccccttggtaatcatgatcagttaccccagccaaaagcatagctcccttgtttgacagttgattcaggagcctgagggacccgaagtggtcgggtgggagttttcactttta

SEQ ID NO: 492944 - DNA, 473 bp, Homo sapiens
  misc_feature (67)..(67): n is a, c, g, or t
  misc_feature (103)..(103): n is a, c, g, or t
  misc_feature (214)..(214): n is a, c, g, or t
aaaatgttttggatggtcctacattagcaattaaaatgctgtggcccagaagtaaacaccttacctnagcccctgagtgattaggatgatcagagctttcccnggtgaccccataggaaatagaacacgagcaagaaaataaacttctgttatttaaagcccactgagattttgggattgttattgcatataatttagtttatggccgggtacngtgtgtcacgcctgtaatcccagcactttgggaggtcatagtgggctgatcacctgaggtcaggagtttgagaccagcctggccaacatggtgaaaccccatttctactaaaaatacaaaaattaggcaggcgtggtggcgggtgcttgtaatcccaggtactcaggaggaatcgcttgaacctgggaggtggaggttgcagtgagccaagattgtatcactgcactccagcctgggcgacagagcaagtctccgtctc

SEQ ID NO: 492945 - DNA, 360 bp, Homo sapiens
tgtctccgtgcattacgtaagtagcacgtgatgccactatgtctcattagaagtgatgtggggttcgagattagcatcagcgtaagaaagctagtgtctgacactgcttaaattactattatcttttttgtaattaataaataatctgaatcttgtaaatatcctgtatcccattaaacttaatagttgtagcatcctggcaattctcacatgtattatatacagacaatcgtgggacaaaactaggttcctggagatgcagaagttaggcacaagactgtatttctgagcagccagagtggatctagtcagatcagaaagaagccagcttatctaggtgactaaaaatttacactactt

SEQ ID NO: 492946 - DNA, 1124 bp, Homo sapiens
  misc_feature (150)..(150): n is a, c, g, or t
agcgactgaagcagcatggtcaagccgtgtggggctgcgcctgagcggggaatgcccgcaagacaggtggaggtcttcacgacacgaatcttccacagtgaggctgaggaattcctctacagattcttgccacacgaacatcatataccntgaatcagctcttgcaacgaggtactcccatcaattgtggcttgactttgactttccctccggtgtccctacttggacatccccaatccctagaccctccataccaaggcatgatgacgatggaaaccagattaatgcatggagtaatgaccagaagatcaccttaaaggatagtggcacttctctcccatgtggcatataggatggaacaagtaccgtgtaccccctgactgtggaccacttgtgctttgaaacgctcacggagagctcgttggtaccttccttcaaaaggtaggaacaaatggcatttactggcctcgatttcatccatagggcatttcactaaccaagcattgaattctgccccatacgaaattaggaaccgaatacgagacaatttgcattctccttcgagcgtgcttacgtccaaattcctatgagtacgcaaatgcgttgcttcgagacggaaggtgttggaaaagtggcgcgagtcaaaagaaccgcaaaaacgctgggcataaagcttctatccaatgtacttaccgccaattatccaatggtaactttgctcaagaatcgtgagtggattagctagtgagcgcaatgggcctgccaccaaggcagaactcatagtacatttggatttaccgtgagacctttggtgccattgatccgagaattgacggcacggctaatcgggagagactcacgggctcaatgggttgcatgggaaccaggaaggcccttatacatattgcctgagcttttgtaactaatcagtctaggcattgaactatgcgacggcaagaaattggatcaacccacacacgggttgaacacaaaaggccagcctaggtacctggaaaaccggggaagtaggacggcaaaatgtgacgaagcgcagaacagaagaagagcgaaaagaaaacacaaaccaagagagaatcccgcgccaacgactaacccagcacaag

SEQ ID NO: 492947 - DNA, 421 bp, Homo sapiens
tcgcccgggtgcatgcttgtgcggaacatgcaggttgtaacataagtatacatgtgccatggtggttgctgcacccatcaacccgtcatctgggttttaagcctgacatacatcaaagtacttcctcaaaataaaagggcacatatatattaagatcatcaccagcaataattattacagccatatagttaatgtggcatgacattatttggcaagccttttagaaatctagaacagaccaagtaaatatttcccctaattttactttcagcatagtgttcctttaacaaatatttattacgtacttattcctttatacttattcctttaacaaatatctattacgtactgtatatcaggtgtgattctgatgccaaaatgtagcagcaaataaaacagataaaaatccatgaccacatgc

SEQ ID NO: 492948 - DNA, 193 bp, Homo sapiens
  misc_feature (4)..(4): n is a, c, g, or t
cggnccgcccttttttttttaatagcagttggtaagaacaaaacgggatggcatcagaatggtctgggaagttttggtctgtgggcagtatggggctggggccaaatgcaaaggatttttatacattctacaacaggttaccaaatggaaaggtcatggctttactttgggtcaaaacaaagggcggccgctg

SEQ ID NO: 492949 - DNA, 133 bp, Homo sapiens
ctgaggtccatggggagcttactgacgtcatggtcgtcatgcaggccaagtgcagaagcatccactggtttataagaaaggccaagcataggcagaatgcttcttagagagtaactccttcaaaatgccattg

SEQ ID NO: 492950 - DNA, 159 bp, Homo sapiens
agccggacctcagttacaacagctaaggatacagcattattctagcagcatccattctgtttagccttccactgttagagatttgagggtacatgtacttcctaaatttggagataattatctttctgtaagttcgttatgcttgactgttgtaactgg

SEQ ID NO: 492951 - DNA, 274 bp, Homo sapiens
gctgaggtgaggcacgagaatcacttgaacccaggaggcagaggttgctgtgagccgagattgtgccactgcactccagcctgggcaacaagagcaacatactgtctaaaaaaaaaaaaaagggtaaccctggcccaaatttttgggggccaataggattgtttgggcccaggagttcaaaaccagggggggcaacatagcaagaccccttctttacaaaaaaaaattttaattccggggccaggggatggacacctgtagccccagctcctca

SEQ ID NO: 492952 - DNA, 162 bp, Homo sapiens
agaagagttgtcaatatgctggtccattgaacgaattaatgacatctctttcttaaaattcaaagttttgattgattaaattttgaggtacataagaaatgaatagaaaccaaagattttcctgattttccctctaagaaataaatccaaaatttctggttt

SEQ ID NO: 492953 - DNA, 457 bp, Homo sapiens
ctgtctagaggatccctaggctaaatgacctcccatcactctctctattcaagctagacttcttaatccttctggagctaagccagagctagctgtccctccttcaaaagtatagggtaagaagcacaattttccagggcgtatagcaatgaaaaccatagtatcttaatggatgtctaagattattgttaagggataggaagagtaatgtcagcaaatacatgttagagttgatggcattttaataagcatgtggattgcttgtaatgtaattataacattttttagttaataactacaattaaaatgacatatcagatactatttataaaaaccttcctctgatgggagaagactgcgcagtcttctcccatcaggagtacatactctaaaagtaaattgtactgatccctcatatttccgttcttcatttctttgcactgatgggacgaagacg

SEQ ID NO: 492954 - DNA, 136 bp, Homo sapiens
ttggggctcatcagggggggaaacgggcagggctggcgaacggggaaccccttttcccaccccaaccggctctcctcttctactcacttttcccactccaagcccagcccagggagatggactggaagggagcaaa

SEQ ID NO: 492955 - DNA, 659 bp, Homo sapiens
  misc_feature (41)..(41): n is a, c, g, or t
  misc_feature (559)..(559): n is a, c, g, or t
ccactggggaaattctgaagccaggtggagccatacacggngctctctcccacccgggctcctgtgttgggccttcctttgagaaaccacaaaacaagctgctggaggtctgagtgcctgccctgccttcctgcacaaacggggccctttttaccctgaggatggcatctggtggtcaggaagatgcctggacagcaaatcctcactgggcctcgcttccccctcacagaaagggttagggggcctcttacggaatgcatgactagctacagaacgggcatacacaggcaatgcctattgccaagggagaagtaaatgttagttttaagaccctatgcaccattcaaggcagaagggtcagagtgtgagggtgcctgacccaaagaaaaaccgtttctgtgggttctaaaccgtatacaattttggggggtccccattgaagaattctacacaactggaatcttccatttgcttcagggcttggaaatgggattgagccagtggaagaactggaccccaaagcttcattaagtgctgggccttccggtaaattgccaanctgccccaccgaatctcccttgggtaaacccccttaaatgtgctagcgctgggccatttttggcccttaaaaaggtgccattttaagagagccccggggg

SEQ ID NO: 492956 - DNA, 205 bp, Homo sapiens
caggcggcaaaggaaaaaaaaaaaatttgggcagtgtgactcctggtttagctggaggggacaggccggggtgagtgcagctcccccccgcctccctaccccctccctccaggggcagcttttttaaaccccccctgaagtaccggccgtcagcctttccgaagtcatccctgtccctatcagtaaagtcccccctcggtttcca

SEQ ID NO: 492957 - DNA, 804 bp, Homo sapiens
taaaacactatatttttacatacaagtatgcttttattatacagataataaagatgggggaaggttctgtttttcttaataggtgaagaaatcttgaagaccagaaattggatcttactgaaaaactgatgttttttgttttttttttaaattatattgtccagctatggaagatggatttttttttcatgatcctttaactctcaagttcatctttaaatgaactctttttttttggttattggaggtaggttggtttggaggagataactaaccctagctgtccccagtctgacaaaggtttttggattggacttaatctcccagtagtggggccgatgttttaaaaacacttgctggtgttggaatggtggctgaaaggtttcctgggccaatgtgagcgacggaaatttttctgcctcataataatatccaggatgagtgtgggtccgacctacagggcgtaatagatggacccagtgaagacacagatgttcctgttcagagcacccagttaattgttttaccgtttaagacattctgtgctcaggtggccttgcaagattaaaccctttcccggaggatgtgggcctggcctgccttgaaaaaccaggttgttcaagaactcgttctgttaaaaattaccgatgccaatcagagaaacgcattttccatcccgttcccgaggaggtccatcctactgtgagtgcagaatgactgtctattgaaggggttcaagtgagtgctgaaggtacacagcacttttggaaacggagatattccacaagttgtccccagaggtag

SEQ ID NO: 492958 - DNA, 105 bp, Homo sapiens
tttccccctggggccccccccgggggggggggggttcccccttcccgggttttttttttctttgggggcccccccccaggtttttaagggggttttttttttcca

SEQ ID NO: 492959 - DNA, 1627 bp, Homo sapiens
aataaaaaaaaaaaaaaaaaaaatttatatccttttctccccaccatccgggttatcacaggagatctataaggacaggcagaaatttctcagaaacaggttttatcaacaggtgggccttccttcagaacctgtgggtcaacatgtggggcattcagcgggtggtatcagctacacttcgtgagaggacattctcacgaagtgaaccagggactatttgtgcacctcttgtggggcaagggctcgaaaccagtctcaagttccacaaaagaagtgccgcggattgtggagaaagccagagaggccaagaagaagaagtggcgtgggaactccgggaaagccataaagcccaagcgcaggaaacaagggtggtcgtggcctcagaataccgtggagtgtgacgaactcgaagaagtgggccaaggggcaccagaagagagacatatagcgaaaagcgtggaagaaaagggccgcccctattgaaacattcgagagggtcaaacaccgcggcgcgaagacacagaggctgtgacaccctggtgggccgtaattcgagctctctcacgaggggggtgggcacaagaggaaactctcaagcccaagcacagacactgtgggaggacagacacagccggagtgtgtgccacaggtgtgcacagggtgttggtgtgagaaacgcggggggcccccacagccagagggtgtgggccacagtgtggcacagggcggcacgcccgagaggcaagcaatcgtcgcccgcgggggcggggggaacacacaaagaggcactctctggggagagtggccgccgggggagttgtgccgctgtgaaacagacacataggcgggggacaaagccgggggcacgcgcgcacttacacaaagacgctgtggggaaagccggcctattaaagccccgtgtcgagggcccgggcagagacaaagattccccccagattattaatacttttaatttgccagaggcgctagggaacggccagcaaaaaactgcgccggagggattcaactgtgcgagcgaggcaattacgacgtatgtggggagacaaaacgttttgcacggggcccttatttgtgcgcaaataatggggggggccccggaagaggcccacggaagcagcgaaagtggattacggacgcaaagtatagtggggcctaaaagaaacaggggcagaacaagaggcccttctcacccacgtgtgttccccacacgagagggagggggcaatacaagcggggaacacatgggggggtgccttgaaacgacagacggggtgcccccaggagtttgcgcgcagaggagaaaactaccaggggggtgccccaggtgggaactaatctgcgaggcaacatgagaacccaagcaaggtgggtggtaccaccgagagatagtggacaacaactaggggggggccccaccatggtgacgcggcggagacaacacacgcgtggcagacaaaacaaaaccagacgcggcgcacaacgaacagagtggtgtgcgatgatcaacccacagggaggcagagataacccagacgaagaacacaacgacgtggagtaaagaccgagtgagtaacacatcaacgaactcagagcagaccaatactag

SEQ ID NO: 492960 - DNA, 799 bp, Homo sapiens
  misc_feature (259)..(259): n is a, c, g, or t
caatgaaaaatgatgcaagtgttcacagaagctttattcatttacctaaaactgaaagcaacgccagacactcttcaactggccaatgggtaaacaaacggcagcccaccggttccataaaacagcactcagcaggagacaggactgggccactgatgctggggcagcggggataagcctgaaatgtcttatgcagagtgaaagaggccacacttagaaggctgcagtttttgttttttatatgccatcttggaaaagncaacactatagcaacagagaagagctctgcagtcacgaggggctggggcagtggaaggactgactttcagagggacaagagggaattctggggggctgtggaaagattctgtatcttgatgctgatggttgttacatggctgtgtgcattgatcaaaactgaagtatgcatcagaaacagcgacttggactgtatgtaaattatactgcagtttttttgtttgtttgtttgtttgtttgtttgtttttgagacggagtctggctgtgttgcccaggctggagtgaagtgatattggctcactgcaagctccgcctcccaggttcacatcattttcttgcctcagcctcccaagtagctgggaccacaggtgtccaccaccatgcctggctaatttttttgtatttttaatagagacaaggtttcaccatgttagccagggtggtctcgatctcctgaccttgtgatctgcccgcctcggcctcccaaagtgctgggattacaggcgtgagccaccgtgcccagcctatactgcagtttta

SEQ ID NO: 492961 - DNA, 387 bp, Homo sapiens
aagatatacacgtggccaacaagcatatgaaaaaatgctccacattacaaaaatgcaagtcaaaaccacaatgagataccatctcacatcagttagaacggttattaaaaagtcaaaaaacaggctgggtgcggtggctcacacctgtaatcccaacactttgggaggccaaggtgggaggttcacttgagcccagaagttcaagaccagtctgggcaacatagggaaaccctgtctctacaaaaaatttaaaaattatccaggcttggtagcacatgcctgtgggtcccagctacacaggagggcttgaaagcaaaagaatcactgagtctgggagggtcaaggcttgcagtgaggcacagttgttcatgccacttgcacttcagg

SEQ ID NO: 492962 - DNA, 179 bp, Homo sapiens
accgaactgcgcgggatatagtacgcaagggaaagatgaaaaattatagccaagcataatatagcaaggactaagcccgtataccttctgcataatgaattagctagaaataactttgcatggcgagccagagctaagacccccgtacagcagacgagctacctaagaacagctacaag

SEQ ID NO: 492963 - DNA, 840 bp, Homo sapiens
agcgggagcagtgggcatgtgaaatgcagctaatctaatccaactgctatgtgctgtgagggtggaacacacactgactgcaagacctggaaggaagaaaagatacagtatcttattagatagttttagtattacattgcagcagttgaaagtgatatttcagatagattgggttacatgaaatatattattaaagatttatcgaggaaggaaggaaagaagaaagacgaacaacgaagctccgtctccctcgtccctctccctctccccagcggtcgtccctctccgctctctctcgcacggtctccctctgatgccgagcccaagctgctccctctccctctccccacggtctccctctccctctctctccatggtcgtccctcgtgatgccgagcccaagctggactgtactgccgccatctcggctcactgctgacctccttgcctgattctcctgcttcagctgtgccgagtgcctgggattgcaggcgcgcgccgacacgcctgactggttttcgtattttcttggtggagacagggtttcgctgtgttggccgggctggtctccagctcctaaccgcgagtgatctgccagcctcggactcccgaggtgccgggattgcagacagagtctcgttcacatcagtgcgtcaatgttgcccaggctggagtgcagtggcgtgatctcaggctcgcttacaaactcgcactcccagcctgctgccttgggctcccaaaagtgccgagattgcagactctgcccgtgcgtaccccggtctggggaagttgaggagccgtctctgccttgccgcccatcgtctgggatgtgaggacccc

SEQ ID NO: 492964 - DNA, 1152 bp, Homo sapiens
gccgccaggcttccctcctcttcctttctccgccatcgctgctgtgtgcttgagctccgtcgtgtctctgccgatgtactgtctctacaagcacttgtcaggattagagcgattcctggcccaagaatacaaagagccacaagctcgtcccacttaccccgagtcgggattcggagtgtaatacactgccgtgatactagaacatcaggtgagcaactcctgataaggatgacactttggagaacgataccaggctggcgtctattggatggtaacttgacacagtgagtatgtgtggccacactagttgtatgcgtgctcgtgagagggtctacgaatcactgcttaccggatatcgaagcttggaaagacttgtcttgcacgtattctcggcagacttgctgacccgtggtcattcgcgtctctccattgacatcctttgtttagattgaacccaacgggttgtgggcttggggcattgcgcattccaggctaaattcacaatttagttggtaatggggcacctctctcaatatgtctctacacacacactatgaacttcgaagcggcactcacacatgggaggatccctttaacaggagaccatggacatgaaaagtgtctatttcggccggcctctcatgctggggcccttttgcgagaacatccactttgtatcctgacctacacccgagctacgtttcgtgggcgggcgaggggttccaccctgggtttagagagttgaaacgcgttcaaccctgtgtgtggcgctgcccccggccttcctgtgtttgcgcacctgcgacgcacccctctccggcgggcgacgcttaagcctgttcccgagggcgccggttcgtcgccaatgtcttctcacgcctcggccgcccttatctccacatgaggcgcgccacacggtggggttgggcccaccaacgaccatggcgccgttgctcgactagaacccccatagaccccccgcgtagaattgaggcccatctccacgaaggccacgagtgcaccatcagttccccaggaggcatgtatgtcctaacaccgaaagcttagttcctccctccacacacgcgctaggcaacacggcattgatagcccggcacttgtgtgctcgcccccttccccttaggggtggcc

SEQ ID NO: 492965 - DNA, 246 bp, Homo sapiens
  misc_feature (47)..(47): n is a, c, g, or t
ctgcgccaggtattttgcattttagtagagacggagtttcatcatgntggccaggctggtcttgaactcctgacctcaggtgatccgcctgccttggcctcccaaagtgcagggattacaggcatgagccactgtgcccggccgatgagcaccttgctttgctcttctctccattctatatacttaactccctcttcggattatcctcagacccaatcattgagtcaagttactttactgagcacc

SEQ ID NO: 492966 - DNA, 150 bp, Homo sapiens
cagcgagtcacagtgttggcttatccagtgtgctttgcatcatcagaagatatccaaaatactggtgcatccgcacaaagactgatcacggggatctttagcattccaaggcacgcaacgcattctttctaaccgcgcttactcaatcac

SEQ ID NO: 492967 - DNA, 817 bp, Homo sapiens
  misc_feature (21)..(21): n is a, c, g, or t
  misc_feature (117)..(117): n is a, c, g, or t
  misc_feature (143)..(143): n is a, c, g, or t
  misc_feature (156)..(156): n is a, c, g, or t
  misc_feature (159)..(160): n is a, c, g, or t
  misc_feature (186)..(186): n is a, c, g, or t
  misc_feature (225)..(225): n is a, c, g, or t
  misc_feature (304)..(304): n is a, c, g, or t
  misc_feature (306)..(306): n is a, c, g, or t
  misc_feature (308)..(308): n is a, c, g, or t
  misc_feature (312)..(312): n is a, c, g, or t
  misc_feature (320)..(320): n is a, c, g, or t
  misc_feature (374)..(374): n is a, c, g, or t
  misc_feature (383)..(383): n is a, c, g, or t
  misc_feature (404)..(404): n is a, c, g, or t
  misc_feature (417)..(417): n is a, c, g, or t
  misc_feature (437)..(437): n is a, c, g, or t
  misc_feature (674)..(674): n is a, c, g, or t
  misc_feature (679)..(679): n is a, c, g, or t
  misc_feature (681)..(681): n is a, c, g, or t
  misc_feature (689)..(689): n is a, c, g, or t
  misc_feature (692)..(692): n is a, c, g, or t
  misc_feature (706)..(706): n is a, c, g, or t
  misc_feature (721)..(721): n is a, c, g, or t
  misc_feature (815)..(815): n is a, c, g, or t
ttttttgcggtgctttatatngaggtgacatttaccagtgtggaaatatcgcagttttcaaatctcactcggatcttcagtggttcgagtgtttgtccgacacagcgggggctggtngtctgaagttgaattcctcccatgcntgcgccatccccngtnnagtccttcctcatcaccgtcgcaccngctcacacagtggggtggctggctgctgaggcaattccncaatggtttctccggtctttggccatctttacgttgccacccatgccccattcttcaccccagctgtgcttcaccagcnantntttnttgttatntgattctgtgctttcaaatccgtagccaaccaccagcacaccatgatccatgtnttcactgcngcagtgtggctcagaaataantgccttctttatnggccggggggggctcatggnctgcggtcaatagcaacgagagatgggccccacagttgcgactgccttcagtcgagggccttctcctgcttagggatgtccacaaagccggtgtcattagctacagaatacttgggattgtacttacaggattcttctgttgcctcatatggataggattcctcagagtgcaggcctccattatcctgaacatactggaaagcataatccattaggccaccattgcagccttcattnccttnangcccagancantttaccagattctnctcactcagtgaganaagcctcccagttttccggaacatctgttcttcaagagcaccagttgcactaaaagcccaacaagaaccacactgaccctgattcttcacaggngt

SEQ ID NO: 492968 - DNA, 382 bp, Homo sapiens
aaattctctttccccccctcttctccaatcaagcccttggagttagatttaggtccttttatctcgtccctctacaaatgtattttccccttgcataattcatgccaacccgggtttttttaggtttctccattttcccccctaaggaggggccccacccaaattttctctaatttgggcctgaaacttgtttcttttcccgttttcccctttccctggggccccctgtcttccaatccctgctggggaatcatgaaaccccttttagctctttgcatcttcccccaggggatttttgtttttcaaaaggaagtagattttaactggccccctttgaggactgccccccttgataaataaactggcttggggtttccatcca

SEQ ID NO: 492969 - DNA, 111 bp, Homo sapiens
ctgggaggcggcagcgtaggaggccgctggagatggtgctgaggacgaggaggccgttggtttgatcatgctcactaggccactgaccaagctgaagaggggctcagtcca

SEQ ID NO: 492970 - DNA, 607 bp, Homo sapiens
gatcccgacggacgcattcacccgcttcacaaccatgactaggtcggtgactgacctcttcagatgccactcagtacacatcatttgcttagattttgttagagcccaaagtctggtcaaatgagaaggtggtaatgaagctcacgaaactggcgtccactgtgaacactggtcgtatatgcgataagactaggcaatgtggtacatgctatacaggcaactgagcagagcattcatgccactgacctggtacctcgataatgcttaacattagccaacctgaaccgtgtgatttatttcatctgtgacaccatcctctgggtgaggagcgtaggtctcacctcaggcatcaacaaagagaaatggagaacgagggctgctcaccactactactattctcttctgctgagccttgtgagggatctgtatgaaatctccctgcagatgaaacgagttacatgtgacagggcaaagaaagagacatcagcatcccaggatcctctttggttcagcgtggctgaggaggaaacagaatggcatccatccttactacttctattattccgatctctgaagcagcatcctcccttgctcctggacacagtga

SEQ ID NO: 492971 - DNA, 124 bp, Homo sapiens
actaaacacattctctgtttgttcaactcatctcagtgaccctaggtcatagctgtgtcctcagtcgatcagctcaagatcgcctgttgggatgttaaacgggctcgctgcacatagtcactga

SEQ ID NO: 492972 - DNA, 143 bp, Homo sapiens
agaccccttgcccgcgggaaaaaattaaaaaaccccccccggaaaaaaatgttaacaccccccccgagaaaaaaaaacaagggggccttcctcagaagaaaaatatgcccccccccccaaaaaatataaaccccccccaccag

SEQ ID NO: 492973 - DNA, 355 bp, Homo sapiens
  misc_feature (32)..(32): n is a, c, g, or t
  misc_feature (128)..(128): n is a, c, g, or t
acagatacatgcctcaacatctggctaatttnctttattttctgtagacacagggtctctctatgttgcccaggctggtctcaaattcttagactcaagcaatcctcccactgctgggattacaagtntgagccactgcatctggcccgaactcactgttaagttgaaaatatcataagttgaaaatgtcagccaggcgcagtggctcatgcctgtaatcccagcactttgggaggtcatggtgggtgggtcacaaggtcaggggttcaagaccaaccggccagcatggtgaaaccccatcttcttactaaaaatacaaaaaatttagccagggcatggatggtgcgtgcctgtt

SEQ ID NO: 492974 - DNA, 251 bp, Homo sapiens
tctgatacaatcagctcgtgtacccaggtcttttcccctcaaagattagcaaatagcatccaggaaacacccgtttggacagcctaaccaggattcctctcaggctctgtttgccatgttactccacactctagctgcagtggagctgaggcagttgctggtcatcgattcccaagatcctggggtaaggtcctgtccgcgaacagagaaggctccctcagggaatggtggcagctgcgtttcacttccga

SEQ ID NO: 492975 - DNA, 472 bp, Homo sapiens
tccataatgtgtgcccaggctggagggcagtggcatgatctggctcactgcagcctctgcttcccgggttcaagcagttctcctgcctcagcctccgagtagctgggattacaggtgtgagccaccgcacctggccaaattcttgctcttaaaaaaaaaaaaaaatgggcacatgcctgtagtccagctactggggaggctagagtgggaggatcgctggagcccgggggtgggaggcggcatggagttatggtcacatcactgcactccacggggtgacagagtgagacccagtctcaaaaagatagaaactataaaagggaactatacagaaattcgggagcataaaagtacaataactgagatgaaaactttattagaggggtcaccaatagattggggcagacagaagggcccatacctgggtcagccctcttagagggacggatccattggggcacacattatggag

SEQ ID NO: 492976 - DNA, 882 bp, Homo sapiens
ggtgaccggcagccccagacctgcctgccttcctgacttctgtgccagagcataggtcattcagccgcttgaatcagtcttttccccccaaccggtccccaagctgtgtgtacccgatacagggaaggtccagcattgcagatagtcgaggaagcgccattatatcattcccgtgcgctctacaaatagttccgtgagaaagatggccgtggaactcgatccgtgcttggcgtgcgtgtctcatattctctcggcctgtcagctagagttattgtggctctgcagagttggagaaggcacatgattatagatacagagagttacgcccccaagcaggtcactgcgtcaccagagtttgagagagtattgcgggcacaacaagaactgtgtggagttttatcctatattcataattacacttgtggactggcatgggtggcagtttcaaccaaggtttatgctacttgtctgggtctggtgtacagtatatggccgtcacctatacttctggaggatattcagaagctgctaaaaaaacggatcaccgttttccgactgagatctgggggatttggcctaggaggaccctccctaggtggccctgcagatatcgcaacccagctttcttggatgagtattctgaacctcatattgccaagacatctgaagcggataattctaaaatgaatcttcattccctataatgcgtggccagaacgctgttccaccatggagtagtattgggatcattggtagactacactaacgtccgtaaatacacaaaacaaaaacaaaaattgagaagcgcgtgcccacagaacatagaaaaactattagtcgcgcgcgcaggaaaaaatagcaagggtcaaagaacaggcaaaa

SEQ ID NO: 492977 - DNA, 589 bp, Homo sapiens
  misc_feature (52)..(52): n is a, c, g, or t
  misc_feature (502)..(502): n is a, c, g, or t
  misc_feature (567)..(567): n is a, c, g, or t
tgtttatcgatgccactgaggttggcatcatcagtggctcgaggatgtcacnggactgagaggcttctgcacttgccttcatcgaattttcagtctggagtacaattgtttgccttccttcctccacctttctatttggctctgctgatattcctgaaacatttggagtgcttcctgtaaactctggaaagaaatggcttggaaatcagaattttctgttcagtgtttcccaagaactgcctcttcctttaatgagctggagagatgcttcctaaacttttccctttttttatctccttcattcactccatccgggagaggcatgcactcaggcgaacattccctgaacacctgctgtcttctgagcagccataaaatagctcctgctgtggtgcagggggggtggtctagatgaaggagtggctcagagttgactagaactcttaagtgcctggtggctgcagcataggacctggggaggctgctcaggccctgtcctttngggggtcttgtgcggaggctgcggcagtggtctttaagctttctttgctgttgtagcaacctttntgaaaggtggcatcgataaaca

SEQ ID NO: 492978 - DNA, 316 bp, Homo sapiens
tagtacacttgaaaggtagacagagcacgtgacggtactagtgctggtacgcctacatcacctgcacccaggggacacatggcatcgtctccgcacctgatgacctaagaagctgcatcatgtatggctggtatcagatgactgctacacctcagcccgaggctgcactgccaacctggacaacttcgacaaggccacctttgatgccattactaagacctacagacatacctggattcgcgaccgacctggattcgcgaccgacctggattcgcgaccgacctggattcgcgaccgacctggattcgcgaccgaa

SEQ ID NO: 492979 - DNA, 293 bp, Homo sapiens
gcgctccgacgcgcgctcccaaaggtcttgcgccgaaagacgcgacacagcacccgcctgccacgcgaagtcgaccccctcgcgatcccacgcttgaaccaacatcatcgcccgccctgaagttgcatggcgcacaggtctagtccagttccgcgaagctcttgtgaccttttcggaccgcctaggcggacgcgcgcgattggttcactatcgctgcaaacaaattaccgggaggattgggtcatgatgcggatgttcagccttagcctggctctggccttagccctggcgac

SEQ ID NO: 492980 - DNA, 682 bp, Homo sapiens
ggccgggggcctcggataacccgaatgggcggtccaaaaaattgcccaacaaaggctagttcttgacgtaacggcggttcctaaaaacagtttatttcatgcctgcctgggatagggattagagcaaggggagctaaacctcccggccagcagcctgtctatgacgccctccttcacccggttagagggtccctcaacagagcttggacgtcatcaaagatatgcgtcctgttctgtcagagaagacatgcctgtcagctctacataatagatcaagggccttggtcagctaacgttcagtggacagctccattcattgaggggtgtgtcttcaaccagggcatgcatcgtgtataatgaccacagtcccagttaacagcctgatcagtgcgctgagacacaggtagcgactgcacttatagcagaggttcggataatgctcaccctgccaagtggctcggatgtcctagaggttccatcagggggagttactttcgatagataataccattgcagaacctgtccatggagggccgtgctatttcagtcctcaacaggcgcagatggagggtcatactgagtcaaaatgaccctgtatgagccccttcctatatggagtcattcagaagccattcggccagggaatacagcattgtctagttccagttcaatatacttccgc

SEQ ID NO: 492981 - DNA, 213 bp, Homo sapiens
gtacttgaggatcctccccgactagccgacagggggatacacgttcgcgagatgatggagcgtcagattttactgaacctccaaaaggcggcatagatggcgagcagtggtgagcagcgccatgcacgacactgcacagccgatcaccagtgggaccgagggggagcccgccagctccagggtcaggtccttgggctgtcgggctagtcgggg

SEQ ID NO: 492982 - DNA, 908 bp, Homo sapiens
ggcggcaacttctgggtgccaggtgcatcctatgcccgcccgaggcccctgacaccaccatgggggtctgggcccggcctcgacctgaccctcctggagcccagatacacccctacccaacagcgaaacaaaaataaaggatataagaacggacaagaacatacaagacaagacgaaaaacaagtaaaaataccacaaagaagacaaagatcacagaaagccccgagacaagcacggacacacagaacacacaagcaacatacccgacacgagagagacagagagacacaaatagagacacaggccgcagacagaaaagacacagagcacagtcgatacaacacacagagcctgagagacggctgcaagaaccacccgagaacccgacggacccacaacccctcacacgcagacctcaccatgaagcgtcaacgagacaaaagagagtacgaacaggccgccgcaaacaggaagagcaaaccatgaggaagacatccagaggcacaacaccgcagcagcaagatgaaacagacgggaaccgagcggcgcagagaaacgcacagcagcaaaagaacccacggcggaagccaggcagaagatatcccagagaaccgaacgaaacaaacgaaacaatgcacaaggcacagagaacaccacgcggaagaaggaacgcaggagcaaaaaatagaaatcaaaaaaacacagtatctcacaacacaaagaacaacaaaataccaatcaaaacaaaaaaccaaaacacaaaacacacaacaaagatacaacaagtaaaataacaacagatacaaacaaacgaaaaccacgacagcaaacaagacacaacaaccacaaacacacaaatacaaataactaagctataccaaatccagcacccccacaccacaatccta

SEQ ID NO: 492983 - DNA, 322 bp, Homo sapiens
ggtgatacgtgggtgagaaaggtcctggtccgcgccatagcccagcgcgcctcgaagccatgcctcggaaaattgaggaaatcagggactttctgctcacaccccgacgaaaggatgccaaatctgtcatgatcaacacaaataaggacaacgtgaagtttaaagtacaatgcatcatatacctttacaccctgttcatcactgacaaagagaaggcagagaaactgaagcaatccctgccccccggtttggcacagaaggaactgaaatgaaccatacacactgattgaaactgggtgatattaaaatactgaatatcctt

SEQ ID NO: 492984 - DNA, 162 bp, Homo sapiens
agggagcccgactgaggatatggatcctggccggcgcaagatctacaccctctgcaggggagttttgaggcccagcgagagctcacagggcgccggcggaaccgcgacgctttccgcggcacggccccctctgtcgcgacgaacactattccaggacgccct

SEQ ID NO: 492985 - DNA, 89 bp, Homo sapiens
  misc_feature (15)..(15): n is a, c, g, or t
cattaaaatatgtgnaaaacccagaaagcatccatcatgaatgcatccatcatgaatgcaagatactttcaataaaaagtaagttatat

SEQ ID NO: 492986 - DNA, 163 bp, Homo sapiens
tggtgtgactggcagacaatctcacctggctacttcattcacacctacctgtggctgtcggccatgtgatggagcagatactcgaacggtatgtgcactgctgctcatgcctggtgcattaagagggtgacagatgtcatgctcacactgctgatcgtgtgac

SEQ ID NO: 492987 - DNA, 1284 bp, Homo sapiens
gtgagctgcgccagaccgcatctgagtggttcgtgtgcccacctgctccttctgctggtccctgccgccacctgtccactgctcagctgttgtagatgaatgatgtgtgggtcggaacagcgccatctgccgcctggtgtctgctgtgggcccttttcatttgggtactgcatctacttcgaccgcaaaaagacgaagtgaccccgaacttcacagaacaggcttcgcagcaacgacagaaagaaacagaagcttgccaaggagagagctgggctttccaagattacctgcaccttcaacagatgctgaagctgttcagcaagtccttcctatgcaagcaaaatcaccagctactggctgcaaccagttaaatcagctcaacaggtagccatcatcgcagcacagggctgtcacaacatcatgcaccacacatgccacattgcatcgtagtgtcgcgcccagccgacagcgagtttgacttgccagtgtcttcaccagtcgaacactctatcgcaaccaacgcaagtgtctccaagatgcttatactagactcaagctcccaaccacattcagtcagagcaatatgtacagtgctcagagcttgcgcctgcaacgcatgcatgtgcgccatgccgacaccccacactgtcacacattaactccacacctctccacttaaccacctactctcacacacagctccttgcgaacgtacgcagcagcccctcgggggggcactacacgggcacactactgctacggtaatggaacctaccaccctggacagtttcaacaaaagttcgctgtttcaccttcggtgcaccgactcccagtatgggctcacccaccctcacactcgcaccccagtgacaacgtgtctctctgcaagagccattttacatctatacagtaccctaaatgagttcaccacggcatacggccgctgcagacgtcccggagacagacgcgtgcgaccgtacacacgggcgacatgtcccagctggcaagtacagacgaaccaccgggcccccatcggacgaccgccccgacccaaggacggcgcgcagaggcgacaacccccccgccagggcaccgcgcgagccgccgacaggacgccgacgacgggaccaagacagcccagggggccagacacgacacgggcacccgacacagcggaaccccgcgccgaggccggacaccaagcaccagagcacggaggccgcagagacggaagaacgagacacccaccacggcccaacgggagcgagacccgacccacaacac

SEQ ID NO: 492988 - DNA, 214 bp, Homo sapiens
ttttacagttccccgctcgctctcctctgtggtggtcagcttcacattctcagcgaactctccttctttgggtctggctgaagttgaggatctcttactcctctaggccacggcaattcacccgttgctggccttggaggcctctgtctctcacctccatcagcttgtgaccagatgctggcctaaggtggatctgcggttggcctcgtggctc

SEQ ID NO: 492989 - DNA, 453 bp, Homo sapiens
tgcaaacagtacaaaaacatgtagtgaaaaatatttcttccagagctgggtgtggtggcgtcatacctgtaatcccagcactttgggaggccgaggcgggcggatcacgaggtcaggagagcgaggccatcctgaccaacatggtgaaaccccgtctctgctaaagatacaaaaattagctgggcgtggtggcacgcacccctagtcccggctactggggaggctgagacgggagaatcggtcgaacccgggaggcggaggtaggagtgagcctagatcgcgccagggtactccagcctggcgagcagagtgagactcacgtcttcaagaaagaagaaggagggatgttgtcttcgcatgccctataatccaggtcatctggctaaggctgcttacccttgcctggagtgaaacttccagctagtaattgtcttatgtttggaaagagatatt

SEQ ID NO: 492990 - DNA, 581 bp, Homo sapiens
gacgccaactaaatctgtattccctagcagctgtttttactatgtttttcttatagtcttcaaaaggattgtagttttgcgggggacccttttttgaaaaacctttggctcctaggaagaagctatttcgtgcgttttggggggttggggacggtcctgtctgaaagtgaattctcctgtttacaccttgcccattcaataatcctggtacgcccagtggaaacctaacaggactaacagaatccctccttatcttgggttaaagcaacctggtctccagaactagaacacaggtttacacatttaactttcgtaaacccacctttaaaaaattttggcaaggacttgtgcaagaaggctataaaggctacattgggttattagcctaagtagatccacggtggatcctatgttggtgggaaggttaaattggacacaaaataactttccttaatttgtaataaattggtgggaatggtttccaacttctgttaaagatcattaatccacacagaacattcatacttggtcaaacaggttataaggtctctgaacgggggggtcgtccaacaaaaacattc

SEQ ID NO: 492991 - DNA, 306 bp, Homo sapiens
  misc_feature (153)..(153): n is a, c, g, or t
agtagatttgagcaggaataaaggcgtcttgaagaaacgtcctatacgatgcagttgttttggaatggcttgatttcttatattaaacccacttgatacactggtttggttctttgactcgggatctatcttgaattgctttcactagtacanccaagggttaagttaaaaactactattaaacttttgttataagcccttggccatcttgagggtggaattatttttccaaaaaatactaatatctattgaacttgagactaagccattagtttggaccttacttccccggtggtacccgagctc

SEQ ID NO: 492992 - DNA, 130 bp, Homo sapiens
ccgagaggtgtgccccagcaagtggaaggaacccctcgaatccgccagttacaggaagtctgtcttccaccaggtctgaagagtctatgcctgatgtcctcctcatgttgatcatgttatagccgggtac

SEQ ID NO: 492993 - DNA, 1171 bp, Homo sapiens
  misc_feature (1004)..(1004): n is a, c, g, or t
gaggctccggcggacctctggttggacatggctgctttaccagcttagcccacagcgacgctaacgttatagcagttcgtaagaaggcagtgacagttgctatctgcctctaccagaagggatatttggcaaagcaaattctggtcgagttccaagactgattcgtgatcgcaagatacctgaaggatcggggcaacgagaagaattccggaacgaaacagacataggtgcgcagccgaaggaggatatcgactccggatgatagaattatctctacaggccacctagtgctagctcagaggtagttcagaatacaagatccatctgggctttaagcctacaaatctttagacatattagactatttgatttctagacaaggagtttgtcaacagtctccgaatgatagtagccgtttgcaagtttaagggcatgtaaacaatggggagcagagcaaaaagctcgcaagtgtctgtagctatctctagtaatgtgacaagtgtattatgggtcgtatcagtagaaaggccacaaagggagaaataaacaacaatccgaggaaatcaagttctgactcattttacatcaacatgcaaagaaatgagtaaacactcctggcgaatatgtatctggaaatagagttgtgttgaatagtgaactgttgcttacgacgacaaggttcctgtcaaaaaatggagaggtacattaaaaaaaccaatataaaactacagattggtgggcccaatggttagggtactcggtcttgggtaacgaaactgattgcaaattttgaggtgggaaaaggttggttaaaaattgcagaaaaaactataaatctcatggtaggggttacgagcagagtggttgtaggttgggcctttcaaatgtggctttggtttagagtgactcgccagatttacatttgtaagaggtggagtcgggctctaggttgggcgctctagagagttaggggaattgcaacactgttgggaaagaggttggcnaaaggggggaagtttttactcaaacgggaaacccatggaacccttgaggacacaataaggcatattgtgcttggcaaaaaagcctttacaattactttcttaaacttgaagagagaaagaattaaacgaaaaaatttaaaggctttggcgtgttgaggagatgggga

SEQ ID NO: 492994 - DNA, 282 bp, Homo sapiens
tataaaaatttttaggtccaatcccaataaagtaaaataactttagttttggtcagacagttgattagctctattgatgctaaggcaggataactgttcagaggttttgatgcaaaactctgctgttaatctggaattaagaaaaaattataaaatatgctacccttgcttaatgggtaaattggggggttgggcatatctttaaaaccccttgggagccaatctgtaaatgtttgttgaaatgaaatatttggtaaataaatgaaaaatttgcctttttta

SEQ ID NO: 492995 - DNA, 518 bp, Homo sapiens
  misc_feature (35)..(35): n is a, c, g, or t
  misc_feature (120)..(120): n is a, c, g, or t
agcgtgttaaaggattggaatatggaagtcaggtnatgtgagtctaccaattaattttttcccaacattatttggacttttctaggttcttaacattttcataacattatagaaacaatntgtcagtttccataaaaaacaaaaaaatagatcctggaaatttgactaggatagccttgaatttatagagcaattcggagagactgacattttaacgacattgcatcttctgattcatgagcatggcatatctttccatatatttagatcttttttcacttctttccaaagtgttttggtatttgtcattgtacagtcttatatactttggttatatttatccctgagaatttagtggttttgatgctatcataggttatattttaaattttaatttctgattgcttattgctagtatgtagaaagattttttcacatattcaccatgtattcttacacatatttggttagattatccctaagaatttagtacttctgatgttgttgtaggttgtatt

SEQ ID NO: 492996 - DNA, 201 bp, Homo sapiens
tactgtggacgatctcagatctccgcatctgtaatgcggttgatcacagcaatctcctgttggtgttgcgcaggtcgtacaccatgtatgcctgcggtgcactgcagctcctcgtacttgtgtctggtaccaggactcagcctcagcccggcttctctgagcaatctcctcatattgggccttgacctcagcgatgatgct

SEQ ID NO: 492997 - DNA, 131 bp, Homo sapiens
catgtccgggcatgtacgggcaaggcgctttggagtaggcttatttctcttgtcctttcgtacagggaggaatttgaagtagatagaaaccgacctggattaccccggtctgcaagcccggtacatgcaag

SEQ ID NO: 492998 - DNA, 136 bp, Homo sapiens
gttggggttcctacagatacgaagatgaagtgtagctgttcctccacgtggagcccggatagaggggacggctgtgtgccatctcatagaagatgcaggccacaccccacatgtaatctgagtggagtagtcgcgt

SEQ ID NO: 492999 - DNA, 1035 bp, Homo sapiens
gacgctgtacctgggcacgtcccggattgaccagcgcgtactgctagcagagaccatgtactgcctgacggggcagaggctagatggcagcacccaggtgacagtggaagaacctggtacagcagcccagtgtggtggacctgtgtggccagcatgcctactgatacagctccacctgcgacatggtgtaccgcagcctatgcctccaccaaggacgagctacccgcacatcaatgactgtctgctgacgcagcagagaagggagtgaggaccctcacgtgcggctgctgtcagatggggctcagcctgatcctctccaatgctgtgagccccagattgcatcagcagagcgaatacgcccacagggggctggacaatgttggatggagaacctccccatcctgcagacagcccacggagatcggtcctgtgcggacaccaaggacgcttgtgtcgtactaaggtgtcgcgagtgcccaagagatggagtctagcgccaaaggcacacggatggccacccaacacgacgcgacgccggcgcgaccgcaaccccgccggtgcctgaagcaccagccgggccgtgccaccaagcaccacagtcacggaacgtgacccggcgccccccccccaaacccaacaccctggagccccacgctcagaggcccagcagtggcgcatgacatagggagcccgacaacacgccgccaggccccaacgcccggcacccacctgagcagagaccgaacaacctatgccgcctaacacacgacagcccgccacaggcccaaggcaacgaacaccacatcacctgggcaatggacttcagagagtctgaatgatacccgacgccaagtattgccacaaccgcgcactgcgaaagacgcgattctatcagtccatgcatacgctcacttgggagacccacccatgtgaccgctaatgatcgacctagagggacaacaacgtcaaccactataaagaccacgtcacattgctgccaatacctagcacaccacccggcccgtacgccccacg

SEQ ID NO: 493000 - DNA, 448 bp, Homo sapiens
  misc_feature (19)..(19): n is a, c, g, or t
  misc_feature (68)..(68): n is a, c, g, or t
  misc_feature (144)..(144): n is a, c, g, or t
  misc_feature (260)..(260): n is a, c, g, or t
  misc_feature (313)..(313): n is a, c, g, or t
  misc_feature (366)..(366): n is a, c, g, or t
atggttaaagtgtttggantttttaagttaagcttttgggttaaacacaagtccatggtgaattgggnataccccactaaaaagaaaacatgaaagaattaagaaaaaccttgaaacagctaagcttggctgtcctacccattncaggatgccctgcaaaccaaccactagctgctcctgcaaacacattatgtgttccttttccctgagaaatatccttgatgtgtttggtggcagtatctacagaagcggcagccacnaccgccttttgaagctctccatagtagtagaatcaggaaagataagcacagcnttcagttttgttcagcaccatacacaagctcctagctgggcaaaggaaatctnaagctgcatgaagttccattacgtgtttttgttgaacacaggtggcctcatccatccatccatccatctcaattaaaaaaaa

SEQ ID NO: 493001 - DNA, 142 bp, Homo sapiens
accctgggaaggttttgatcctgtgactcatcatttctttgctttctattcatttcatatttagagaccctgtttctaattaatcaacagcatttagtatgacttataccataaacgtattttcactccttcacccaagcta

SEQ ID NO: 493002 - DNA, 378 bp, Homo sapiens
  misc_feature (25)..(25): n is a, c, g, or t
acccccggggggggcccccttaaanaagcctggggttttttcaaaattcatccagcccattggccgctcaaacccaggggcaaagaaaattttaggggaggttttcctcctcctccccttagggggggggagggaacagggcagccccccaaggagggttttggcccctgtccccccgggggcccttatggccaaaaattttccctgggggggtgggtcaggggctggggttggttctaaggacttgggttctcccaaaagttttgtttttttaaaaaaattaaattcctgttttcttaaaaatttttggggttatatgtttggttttttaaaacctttaaggggccccccccccttccataaaaacccggcttggga

SEQ ID NO: 493003 - DNA, 217 bp, Homo sapiens
ctagaggttaccacagtcttgctcccatcacgaggtggaagctagactcactctggaactccagttttacgtttttttgaggaactgccatactgtattgctattgtggctctatcacccaccaagcagtgtaggagggttctcttttctccacaccctctcggcatttcttatttgtactttttgatgatgtcgtttctgatgggacgaagactgg

SEQ ID NO: 493004 - DNA, 720 bp, Homo sapiens
  misc_feature (401)..(402): n is a, c, g, or t
  misc_feature (439)..(439): n is a, c, g, or t
  misc_feature (533)..(534): n is a, c, g, or t
  misc_feature (539)..(540): n is a, c, g, or t
ctcacgactgtccaggggccgacaggcgcccaggcgggcagaggggcttcatgtcagggatgccccaaccagcggctgtgcgcttctggagcgggggccacatccggacacggctatagaggaaatcaaagagaaaagtgaagactgtaaaacacaaaatcttggtattgtctgggagaaggcggatgcttggcgaaaagcacattcagcgcccaccttgcccagtggcctagcagaggatgaaatactacacagagttgctcttcgtagacagtcgagtatatgtgggccatcgattcccaagatagactcgggattcggcagggagagcacggttctaccaagagtgcgctcaggctggtctccaagtgtacgtggatagtacaaccttggtgggtganngtcggtgggcttcctgctcagcagtcctgatgatgcngttatctggaggggacccaagaaaaacggcatgatcaagcagttcctccgagatgtggactggggagaggtcgactacctcattgtggacaccnnacctnngacgtcggatgaacacctctcggtcgtccggtacctggccacagcacacatcgatggagcagtgatcatcaccatccccaggaggtgtcactcaggtggtcccggagaatctattttggcgcagggtaacttgccttctcggggtggggggaccctgcgggcccccttcctaggaaattc

SEQ ID NO: 493005 - DNA, 166 bp, Homo sapiens
cctagctggggcaggagtcacagtgttccatccaaagcccccgcagtctcgtcatttcgttttcagcaagcagcatgcagcagcagcagcaccagtcatgctatggtgtcattgctctgcagttgcatccacagcacaatccagtggcaggcaacattctgttggc

SEQ ID NO: 493006 - DNA, 414 bp, Homo sapiens
  misc_feature (330)..(330): n is a, c, g, or t
ctagaggatcccgcgctgaccatacacgtcaagatcaaacagcatacctgctaggctaagatagatggtgtgattccacggggtttggatcaatacaataacaaacctttttcctttgacatactctgaatttggtggttgggggggagggggtgtgtgtgtgtgtgtgtgtgtgtgtgtatgtgtgtgtgtgtgtgtgcacgcgcagtgtccatcagtatcagtgcctgcctgagtgaggaaaattacatcccgggttctgtatagaggagaaggatgtatagagcaacgtgaaacattagccctccttttattatagagactagtgtngagtgttcttaaaaggggatttttttcccttagagcaattttttctcttcgcgataaagtgaagtatggctcagcgctgggtac

SEQ ID NO: 493007 - DNA, 151 bp, Homo sapiens
actctagaggaccccctgctgtgatcataccatggaccacctccacaacagggatactccaccccagcagcagcatgtacccagggcagcaatggttacccatggacatgcagcagtggctacttgtcctatcacatgggtgggtccatgt

SEQ ID NO: 493008 - DNA, 124 bp, Homo sapiens
cgccccccccgccacgcgccccgcgcgcgcgggagggcgcgtgccccgcacagagcgccgggtccgggatccggtgcggattgccagtcgtcctgagaaacggaaagagaatggaatgcggccg

SEQ ID NO: 493009 - DNA, 254 bp, Homo sapiens
ctaacttaacatagtgagctgactacagtagtactgtctacattacattctgatggataataaaaccagagaaattagacagaaggccaaggaggcataaacctgataacacacatatccgccacacatgcacacacaaaacatacacgcacacaaaggttatctactgaccacaaacgtgatagaaaaaagctttgcatgcgctacactccaataaaaacccttaatcataataaactgtggcaatacctgtg

SEQ ID NO: 493010 - DNA, 124 bp, Homo sapiens
atttatgggagaagggtataaaaaacaaacaggttgagacgactatggcatcagcaacaccagataaaatacgagattgtgcagttgttattggcgttggggggacgatcacatagaggtcgag

SEQ ID NO: 493011 - DNA, 105 bp, Homo sapiens
gccgcaggcgttatttcacgactggaagaagaggaacaggacattcttgcagcgactccgagaaaatgcttgctcaccttgtgggacaagcgccgggacctggcc

SEQ ID NO: 493012 - DNA, 1048 bp, Homo sapiens
  misc_feature (699)..(699): n is a, c, g, or t
  misc_feature (800)..(800): n is a, c, g, or t
tgtcacatgggatttatcaccttcccaacgtccatgtagcgcttcccttcaataacttaggcccctatttttttcccgacccaacacctgttcctccatattagcccccagtgattggggcccgcaattgtgaaccaccgcaggtattagccacccatttcccccatgggcgcacaccaaacaacaaaccacaccctcgtgccccaaaatagggccctcttcggataaccgcggatataattccctcatatttatttacccctctcacgaaagtttgtttattttttttcgccacggagtatttttttctcgaggacctcttttgacccacactctccacggctcttatagccccctctatccctcccccaccactttaaggagaggcgacaacactgtgggcgccccacaacacacaggcactttcacacccccccgctatatattctccctcctctagagaagtgtccccacactctccctcatatacaacacacactctcgcgctgagtgttaactcgcgcactttcacacgagaggtatttacacacatgcacccccctcgtgaggcgtctacacacacaatatgatgtgtttatatatataagggatacacacactcccggagacacccacacaatatatattttcacaacgcacactgtgcgtgtatatgtagcacaatgtgttatactcggnggttcttctatattttaaccctcccttaccacaagcctcacagagagtgatactttcgagagtttcccgcttcacaccacattttccgagccggcgacatnttatcgggcgtcacacactgttgtttgtatagccacacacaggcgttccaccggagacttcaccgtcacttatttggctcaaactttcctcacctaatttgcttcactcccccacactatatattttcacctttaacaatccacaacactcacctttggcttcgaaagcccccccctgataactggcacttttgtaagaatgtggtttgactatttttgtaagtctccatttattgatgagggtttta

SEQ ID NO: 493013 - DNA, 885 bp, Homo sapiens
  misc_feature (855)..(855): n is a, c, g, or t
agaaactaatggcatctacgagacgacgcagagtagacgaggacggcgatattcgatacatacatatacgagtatcagcgcgacgaatatgccgggaatggctaacgcggggggtacggtggccccaatttacgagatagacgtacccgagcctattactcgtacataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttcaaaaaanaaacaacaaaatgtgggggcgccgaattaa

SEQ ID NO: 493014 - DNA, 453 bp, Homo sapiens
  misc_feature (342)..(342): n is a, c, g, or t
  misc_feature (415)..(415): n is a, c, g, or t
aagaacaaagtaaaggatggaggttttataaagagaagtgttacatattttgaaagacaggtcattggcactagtaaagttttggggaggtggcaagccctgattggtgagtgacagtggtgggtaatactggtcttagagtcagcaacaagttgtttcagtagccattagataaactggtttcaggttacaataggcagtttcagcagccaggcttacagagaattataatcttggagcaatgttacatccctccccctcccctggcccccccaccccatccctgcccctcagctctgatttagttggagtacggaatagggatggacccaatttagtatngtccagcttttcacacatggaaggtttgaattttattggaaacattgttaaattttggaaatttacatgtttnacattggccaaaaagcttttttttaaccaaaattttgg

SEQ ID NO: 493015 - DNA, 473 bp, Homo sapiens
  misc_feature (443)..(443): n is a, c, g, or t
taaattgggggcggggtggcgccatttttttgtggacgctagggccgagccgagggaaaatccattttattgtcatatttaccgggggggagcatactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttcaaaaaanaaacaacaaaatgtgggggcgccgaattaa

SEQ ID NO: 493016 - DNA, 210 bp, Homo sapiens
aaaaaaaaaaaaaaaggggtttaaaaaggtggggccggttttcccgcccaattttggggtttttttttgggttaaaaggcccggggggaaagggggccgggggtttggggtcccccccccaaaggcccctttgggttgggtttttttttttttttttcttttaccccctggggaaaaacccctttggttttaaggattttccggttttta

SEQ ID NO: 493017 - DNA, 1660 bp, Homo sapiens
  misc_feature (44)..(44): n is a, c, g, or t
  misc_feature (46)..(46): n is a, c, g, or t
  misc_feature (101)..(101): n is a, c, g, or t
  misc_feature (147)..(147): n is a, c, g, or t
  misc_feature (180)..(180): n is a, c, g, or t
  misc_feature (202)..(202): n is a, c, g, or t
  misc_feature (310)..(310): n is a, c, g, or t
  misc_feature (1630)..(1630): n is a, c, g, or t
cccacgacgtccgggttgactattctctacaaagcagcaaaganantggaacactagtacctattattgcggcgcagtgagcgtggagtcctaggcacagntctaagcctccgttattcgagccgagtctgggccaggccaggcaancctttctaggtaacgatccacatctacaacgtnatcgtcacagacccatgcattngtaataatcttcttcatagtaatacccatcataatcggaggctttggcaactgactagttcccctaataatcggtgcccccgatatggcgtttccccgcataaacaanataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttcaaaaaanaaacaacaaaatgtgggggcgccgaattaa

SEQ ID NO: 493018 - DNA, 181 bp, Homo sapiens
tgctgtatgcggtggcgcgatcttggtactgcaatctcccttccagattgaagcaatcctcctgcctcagcacaagtgtgcactaccacggctgcctaatttttgtatttttggtagagacgggggttttgccatgttggcaaggctggtttgaaactgctgacctcaggtgattcacctg

SEQ ID NO: 493019 - DNA, 1283 bp, Homo sapiens
  misc_feature (1253)..(1253): n is a, c, g, or t
actggccgtcgtgttagatcaagaatcagttatcagggtgattcccgcatcatggggcgtcggtatacctaacgatatcgtctttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttcaaaaaanaaacaacaaaatgtgggggcgccgaattaa

SEQ ID NO: 493020 - DNA, 1055 bp, Homo sapiens
tcctccatgatactataaatgtatcaggtccacttttttcttcttactttaggtgatcctgtggcaggccaggtctcactaacagctgaacaggcaggcctccatggcaactgtttcagcactgagtagttaagtttaatagagccagtgtcctcatacgtaggctggaatgcaacaaaatcccaccaatagttttgcctagtcctttcttgggccttggagcatgacaagataacgaaggaattcttaacaggacccctttacaattaaatatgttttattgggggcctgaaggacctccccagactgccacaagcaagctttactggggactaaaggaactccccaaacctccatgatttagtaggagacaagataagggtaatctctgtggtgcctggacccatttagattaagtaaatttactcaggctccagaggaaggtcttcaagactcagatcttagttatagattagaagttaatcacttatgtctttagatgaatgcacacttacatgtagacatatagcttagaagttatataagctctgcaaaactttgtaattttgagttggtctggtgatatttccccagccttcttcctatacccggttacagaaataaactctgttctttcccagttcatcttcatctcgttattgggccacaaaaatatgcagcctgacccttggtttggtccgagaacaattccactataaaatgtggatttattattgaattatatcctgtctttgaggagcaagtaataggattcacaattcaatctcctgtaccccatgtattaattggcttacatggctggaagtccatgtcagacagggaaggctttgcttcaggcctaatccagtttcattgttctctgactttgtcatctgcccctcttctgtgtgctagcttcatccagaagttagcctctttcacaacagtaaaatgcatacagcaatttcaggctttccacacactaagtttcccagagatgagcagagtttctctatctgtggctcatacgctaagatatttcttcccagaagctt

SEQ ID NO: 493021 - DNA, 1267 bp, Homo sapiens
  misc_feature (1237)..(1237): n is a, c, g, or t
aaccgcaggggcttcgaggtgccactccctctctttacttagcttccaggtcctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttcaaaaaanaaacaacaaaatgtgggggcgccgaattaa

SEQ ID NO: 493022 - DNA, 1669 bp, Homo sapiens
  misc_feature (44)..(44): n is a, c, g, or t
  misc_feature (46)..(46): n is a, c, g, or t
  misc_feature (101)..(101): n is a, c, g, or t
  misc_feature (147)..(147): n is a, c, g, or t
  misc_feature (180)..(180): n is a, c, g, or t
  misc_feature (202)..(202): n is a, c, g, or t
  misc_feature (310)..(310): n is a, c, g, or t
  misc_feature (1636)..(1636): n is a, c, g, or t
cccacgacgtccgggttgactattctctacaaagcagcaaaganantggaacactagtacctattattgcggcgcagtgagcgtggagtcctaggcacagntctaagcctccgttattcgagccgagtctgggccaggccaggcaancctttctaggtaacgatccacatctacaacgtnatcgtcacagacccatgcattngtaataatcttcttcatagtaatacccatcataatcggaggctttggcaactgactagttcccctaataatcggtgcccccgatatggcgtttccccgcataaacaanataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacaccgtaatagctagaggaacaccgtaatagctagaggaacaccgtaatagctagaggaacaccgtaatagctagaggaacaccgtaatagctagaggaacnccgtaatagctagaggaacaccgtaatagctag

SEQ ID NO: 493023 - DNA, 1187 bp, Homo sapiens
ggaattgcgcgttgtggccattgctggccagcggggctgtggaaccatgtgtcccccgtgtggggctgccgtctgcccctgtctgccctgcccctgtgcccgcgcctgcccctgatcacctgtccggccatcaggccgaggacgaggagcagcagcccaccgagatcgagtcgcgtatgcatgaacgtgttacgtgcaatggcgatgacgcgccatccgtgctcaccaagattcccttcttcagagaaataatagtgagctccgttattcctgcgaggcacgtgtgtgctggaacaacacggagatccagtctggcagtgcaggatccatggaccagggaggtgctgcgtacgacgtttgtcgtgtcagtgactctgcgagcgaccatgacacagaggacagttggttgcaagacttgactcgtgacttgccaacaaagggagtgcgctgaggcataggactctagctgagaagtgcgcgtggcgcggtttaagagccaggagaacggcagcatccgtgaacacagcgtgataggaacgcgaggttgagtcagccccggatgcactaagtcgtcattgggccacatggggaaggcgagcgaccacacgggcccctgtgcgagccgaacaggcggtgctcaaagcgcaacaccggcagttggacgatagccacgggctctgacacacacgaccactttggacgtcgacaggttccgagtttgggtcgcgaaaccgcttggcaccagcggaagtgcttactagagcgcggaagggggttatgggggcagttcagcgcggcagttagtatacagaggcgttccgttgtgaagttcacaggtattttggagagttgagagttatcgcagagagttagcaagaggggggagaaaccaaggggtagaggaatgggcaatagtgggaagaggataaagggctaggcagagcgagtttagtgacgttagcagtattacaagcagggactaggagagtgggagactggacagtttgaggaggcacggattgggaggctagggacagtttcagaggtaagaggaagagcgcataaagagaggagagcgccggggtgagagtccggcgggggaagggtaggggggagctgggggcagagagggcaagggaaattttgtattggcaggtggttattctagcagagctgaagagtgtgag

SEQ ID NO: 493024 - DNA, 465 bp, Homo sapiens
aggaagtagaacctactccatagtacactcttcgtaagtcagtagtacgaagtccgagagggagtctcactctgtcgacccaggctggagtgcggtggtgtagatctacggctcaccctaccaccacccaggttacaagcgattctactcacctcagcctcccaagatagctagggatatacaggcgtgcaccaccacgcccagctaatttgggtattataggtagagatggggtttcaccatgcaggtcaggctgatctagaactcccgacctcaaggtgatccgcctgcctcagctttgtcaaatagtaacacatatttcaccaaaactctcatttcttcattgactttgttgctaatctcttaatccactcaacagttgtcatttatattctgtcaattgcatctttgtccgcttctagagatccggggtcaatgaggacgggtccctgatgctccaattgt

SEQ ID NO: 493025 - DNA, 230 bp, Homo sapiens
aatacaccatctctacaaataagagaaaaaaattagccgggcatggtagcatgcacctgcagtcccagctacttgggaggttgagatgggaggatcatttaagcctgggatgtcgaggctgcagtgaactgtgattgtgatcacaccactgcacttcagcctgggtgacagagcaagaccatgtcttaaaaaagtctttttttcatattgacccagtgctcagagtcctc

SEQ ID NO: 493026 - DNA, 1187 bp, Homo sapiens
  misc_feature (44)..(44): n is a, c, g, or t
  misc_feature (46)..(46): n is a, c, g, or t
  misc_feature (101)..(101): n is a, c, g, or t
  misc_feature (147)..(147): n is a, c, g, or t
  misc_feature (180)..(180): n is a, c, g, or t
  misc_feature (202)..(202): n is a, c, g, or t
  misc_feature (310)..(310): n is a, c, g, or t
cccacgacgtccgggttgactattctctacaaagcagcaaaganantggaacactagtacctattattgcggcgcagtgagcgtggagtcctaggcacagntctaagcctccgttattcgagccgagtctgggccaggccaggcaancctttctaggtaacgatccacatctacaacgtnatcgtcacagacccatgcattngtaataatcttcttcatagtaatacccatcataatcggaggctttggcaactgactagttcccctaataatcggtgcccccgatatggcgtttccccgcataaacaanataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccatcaagatagcgatcgacatagcgtagaagtatttagcggactcgtggaaatctgcggtgagcgagctgaagagagctggtgccgtgctcagacactagggaacatcaagatttgaaccgcaggagaccggactgacgctgggataacctctgatggataaacatagtgcaatgccgaaggactaaggagaagatcctgcgacatggcctaataaatggtcagtatgttgcaacaaggaggctgcaa

SEQ ID NO: 493027 - DNA, 363 bp, Homo sapiens
  misc_feature (223)..(223): n is a, c, g, or t
tatgctgtctcaggagtacttgattctatagaaaacctccaaagtagatgtggactcaaggggaaagcaaggcaaagagaaaatgattagggtactggttggaaacaaaagtacagacagaacacaaaaggtttcgggcatttgaaagtcaaagagtattcagcgtgggatgaattacgaaaggaatttgaaactgcaggacttaagaagcttttctccgaanttggtactggctcgtggtaaaatgaaatggaagacaggaactcttttagttaaaatagcagtgtttttggtggttttggcattgggattgggggagtggttaatggaacatagtcaattttaaagctttctcgtgaagca

SEQ ID NO: 493028 - DNA, 850 bp, Homo sapiens
  misc_feature (44)..(44): n is a, c, g, or t
  misc_feature (46)..(46): n is a, c, g, or t
  misc_feature (101)..(101): n is a, c, g, or t
  misc_feature (147)..(147): n is a, c, g, or t
  misc_feature (180)..(180): n is a, c, g, or t
  misc_feature (202)..(202): n is a, c, g, or t
  misc_feature (310)..(310): n is a, c, g, or t
  misc_feature (820)..(820): n is a, c, g, or t
cccacgacgtccgggttgactattctctacaaagcagcaaaganantggaacactagtacctattattgcggcgcagtgagcgtggagtcctaggcacagntctaagcctccgttattcgagccgagtctgggccaggccaggcaancctttctaggtaacgatccacatctacaacgtnatcgtcacagacccatgcattngtaataatcttcttcatagtaatacccatcataatcggaggctttggcaactgactagttcccctaataatcggtgcccccgatatggcgtttccccgcataaacaanataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccaccccaccctaccacacattcgaagaacccgtatacataaaatctagacaaaaaaggaaggaatcgaaccccccaaagctggtttcaagccaaccccatggcctccatgacttttcaaaaaanaaacaacaaaatgtgggggcgccgaattaa

SEQ ID NO: 493029 - DNA, 155 bp, Homo sapiens
agtctagaggatccctggggttgacttcgggagagcagacccaccctgtcgaaggcgcatcgcccaccacctccctcctcgtgccggccctgcttctccccagattccaaccccaggaaaaacgtgcttctccgcgaagagtcaattccatcagg

SEQ ID NO: 493030 - DNA, 497 bp, Homo sapiens
  misc_feature (464)..(464): n is a, c, g, or t
atgctcgagcgtccccatatactgcagcgacataccctagtcccaacgtacatcctctgtcaattcactttatcatatccattcgtgcctggatctaacgtgtgtcattccctcataaaatctatccttcggactatccggacttgcgccgctggtcgctcggactaccccgtactgtgattgccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacaccgtaatagctagaggaacaccgtaatagctagaggaacaccgtaatagctagaggaacaccgtaatagctagaggaacaccgtaatagctagaggaacnccgtaatagctagaggaacaccgtaatagctag

SEQ ID NO: 493031 - DNA, 309 bp, Homo sapiens
tggcaatatactatagttccgccggggggatgatgagaggagattataaccaagcatcatatagcaaggatctatatcccctattaccttctgcattcatgaatgttactagaattaactttgcaaggatagcgcaagcttatacccccgtaatccagacgagctacctaagatctgcttagagcgcacatcccgtctatgttccacaatactgggaagattctataggtagaggcgacgaacctaccgtagcctggttcattagctttttcgtctgtcttgtaatgtctaagttcaactttaaatttg

SEQ ID NO: 493032 - DNA, 212 bp, Homo sapiens
gcctatcaaagatgttaggggaatcaattctagtgatgatgggcatgaaactgtggtttgctccacagatttcagagcattgaccgcagtatacccccgtgtcgtgtagctggtgaaagctggtttgcgtttaagacgtccgggcaattgcatcgtgtttttaacgcctaagagtggggacagactcatgagatgcagcggtaccgcagctc

SEQ ID NO: 493033 - DNA, 391 bp, Homo sapiens
agatatgactagcgtatgacacgctagctttaatagtaaagatcattctttacggactccacttataactcccatctagcccaatttcgacgccccgatcgctgggtcaatattacttgccgcagtactcttataactcggctgctatagtatactacgcctcacactcgttctctaccccctgaccaaacacatcgcctaccccttccttgtactatccctattaggcataatggttacgagctccatctggctatgacgtacagacctaatatcgctgcattgcatactcttcaatcagccacatagccctcgtagtaacaggcattctcatccaaaccccctgaagcttcaccggcgcattcgttctcattatctcccaccggcttac

SEQ ID NO: 493034 - DNA, 245 bp, Homo sapiens
tatgactctagaggaccccccaacttttatgtaactggctttcctaggctgggggcttgaactaagtaaagacgccaaggagttcagactctagatagcagagaagtaagtctcattacaaaaacttgcaagctacgtgtaagagtccaccccgatgaagctgttacagataggtgtatctatggactagaattctcataagtatcatattggtacaagactacaacaacaaatgtaggctaagc

SEQ ID NO: 493035 - DNA, 664 bp, Homo sapiens
tctctctcttgatcatttggcattcttcatattacatcatcacacataaaattgttgattctcgtgttagaaggaaccatttttaaaagtacagtttcttacctgatactggaatccctgctataatatagctagtcattgccaagctacacttggaaaaaatagacgaaagaaaactcaaaattcatgctcatatgctattgagcatttagtgacattgcagctaccttatttgagaaggcagcattccactgataacatatatcaccctctaagtatggcatgctcctcttacaaacagttaagcttcagagcagtagtgcaggaaggaaaaaagtcccttcataaataaatccttttgcctaaatgaaagaatatacagtactcataaaaatggcgattagagcccagcatgagaaagataccctcataacactaataatattagcaataaaaataccctctgagatttgctattccagagaaaatatttgctattattgttattattattatattactgctaataataataatgggttgcttgctaagagattgagcctttgctgtaactaagtaagcatacttagaaagtgctcccctgaagacatttcttcaattaataaagaagactgacagatcttctcacagcaaaaaaaaaaaa

SEQ ID NO: 493036 - DNA, 1030 bp, Homo sapiens
cgcggtggctcacacctgttatcccagcagttgggaggctgaggcaggaggatcacttgagcccaggagtttgagacaagcctgggcaacatggtgaaaccctgtgtctacaaaaaaaatacaaaaattagtcaggcgtggtggtgcgcacctgaagtcccagctactctggaggctgaggcaggaggattgcttgagcccaggaagtggaggctgcagtgagccaagattgtgccactgcactccaggctaatcaacagagcaagacccagcgtccaaaaaaaaaaaaaaaaaaaggggtttggtgtgtgatggggccctttttcacccaaattttcaaggttattatcagagaaccatagaggccttagttctttcagaccaattagcccgtgggccggataagctattaacgcggtataacaattaacgtggagaggggccacacttacttcatgtggcccttatttggggaaggggccacccttaggcaatttttcgacccatttaacctttccctagtagaggagttatattacagttgctgtcaccaagagttcgataaagttcgtaggggagatatctcctagtaagaaaaaattcgggtatgtacggcgttatagagtcacaagggcctaatcagggttttcagacacagtttctttagagttaagaggccttctatacccggggggaggagaaaaagggggaagagaagaagtagagaacgacaagaaaaaagaatgaaaaaaaactactggggggggcagccgcagacgagcccacacgaaaaaggcgtcagttgcaaacacacacgcagaggggcgcgcggcggcccaccaagacgagttaaagtagcgacaaggggccaaaggtgaggtggcaccccacggagagacaacatcgtgggaatagaataaaaatggacggggtaggaatccacccaccccacataaaaaaaccagcccggggggggggaaacaagcagacggtgtggttgagaaaaaaacatcacgatagaggaggtgat

SEQ ID NO: 493037 - DNA, 472 bp, Homo sapiens
ccctttgtcttcagaagcactcatgtcaacaaaaaggacacccacacaaaaaccccattcagaggccatcagcatcaaagctcaaaggtagataaacacacgaaggatgaggaaaagccagtgcaacaatgctgaaaattccaaaaaccataatgcctcttctcctccaaatgattacaactcctctccagcaagggcacaaaactggacggaaatgagtttgacgaattgacagaagtaggcttcataggtgggtaataacaaactcctttgagctgaaggagcatggtctaacccaatgcaaggaagctaagaacattgataaaaggttacaggaactgctaactagaataaccagtttagagaagaacataaatcttcttgaagaacgagtatcaataactgaatcaatcaagcagaagaaaggatatcagagattgaagatcaacttaaatcaaatgtgaagacaaag

SEQ ID NO: 493038 - DNA, 288 bp, Homo sapiens
gtaggatgagctcatagtcattgctgtcgatgggcctagagtacgcattcttaattaaagtcatcactttatcctgtgtactatcgtattcctacaactcaactcaaactccagaaccacgaccctactactatctcgcacctgaaccacgctaacatgactaacaaccttaattccatccaacctcctctccctaggaggactgcccccgctaaacggcttattgcccaaatgggcccttatcgaagacatcacaaaaaacaatagcctcatcatccccaccagggt

SEQ ID NO: 493039 - DNA, 738 bp, Homo sapiens
taagtatattccattttattataaagcagggctcccaaatcttttcacagggtacacctcgagggtggagaacatccaagcacaccgtggatggtggatgggacccacttcgtgggtaccctgatgaggaagctctaggtgtagaaattcaggacgcggtcttcagagcagagggctggtctcacgtcccgtgtctgccacttactaacgtgctgtgaccttgagcaagccacttaattttctcgtgctccttctcgttggtaaaaggggtacaacgtggtggctcagcagataagggacctaattacacgttaacagaactcagcacaaagccgtggcacacagacaggctctcaccagggtgccattctcagcacaagtgcttggttgacgcatacgtggtggcagtgggcaggtgtggtgccccaagggggtgtgggcctcaggagacccgatgcagcaaagaggcagtgaccacggaggcaggggacaaatagcccatatctttaacaggacactcgtgcctgacacctggcaaaagtggagaagaccatgagagcacccaaactaaagcggatcccaacgatgggggaacacactaacgggcaacacagcgggaggacgtgaacatcgggaaatggggaactccctggggataccccaagatgggccaaaaacccggaaaactcataactacacaaggtgaacaccaggcgaacaccccgaagtccggacacc

SEQ ID NO: 493040 - DNA, 744 bp, Homo sapiens
tggggaaagggccgtctcccttcggtgtcacctggggctgaacgtgcagtggcacgggtctgggctcgcttgcaacctctggcctccagggtccaagtgattctcgggcctacagcctcccatgcagctggggacatacaggcacgtgccaccaggctccggcataatttgtggtgatttctaagggaaagaggggggcttggcagccattggggaataaggagtgggtctcagaaggtcctcacctcagatagatccggacaccgcctcgggccttgcacaaatgtgctagggataacagggcgtgacgccattggggcccgggggcataagagccaggcacgttattgtatcactgggggaagactccccagacaagacgaccggtcaaagggtaacaaagggggaaaagctgtcggccactatataagtcccatcctgaaacgactgggtttagagacgggcgcgggagagaccctcgacacccccggcagcgcgagcacacacacatgcgggtgcggggcggcagaacacgcgaacaacggggggccacatgggctccactaacccaacgggcacagcatcaccccccgccggaggggggcctcacccagaatactgacaacggccacctataacagcgagaaccaagaacgttggtaacgaacgaccccggcagcacagataacccaacgtgctcggcggaaaaaaagggcagcaaaaagaggaaccagataaaagagg

SEQ ID NO: 493041 - DNA, 600 bp, Homo sapiens
gggaacactaagaaaaacgggttaaccccaataaagccccgtgggggccgcactgtttcacgggggttataaaccccccaaagtatttagcgctcttcgaccaaaaaagaggcgtgtttgcttcaacttttcgacggaataaattagagctcccctctaagttagtcttttcttaagagaacgttggtgacaggttgcgcaaaatttgaataataagctctcctgtgtatggcaatagcaccacgcgcccccacctcactaggtggttttacatcggtagaccccctctctaaaaacaggcgggtgcgtttggcgagaaaatttttcttaagaatctcagggctatgacaccccccttcttcaagtattacacgagtcgccaacttttctacctgtgaggatatgaccacagaccccaccttcttggggcctgttctttacaaccctccggagacattctctgcatccacatcatggatttaaacaaaaattgggaagaagaaagtatcttcattataacccgaaaatatacttcggagggacttttatttctatcaagggcagaaggggcaataaagtcacagcaataataaaaaaggg

SEQ ID NO: 493042 - DNA, 210 bp, Homo sapiens
acagctcaggcagaggggctaagagaggttggggaaccaaagtcatgggagaattcgaaggaaggcctcagcttggtgctgctatcccttttccctatgaaagtcggcaaaaatggccgggcgcagtggttcatgcctgtaatcccaacacttgggagctgaggcgggcggatcaggaggtcaggagatcgagacaaccttgggtaatgg

SEQ ID NO: 493043 - DNA, 723 bp, Homo sapiens
agcgttgttgcctaccaaagctcctcaagaccaatttcatgagatgaagaagcttccggagggagatggccctagtgcccagtttcgggtgccaggcgggggcttcctgtgacctgcgggaagggggtggggggcccaagcggccccttctgctccaaggcacaggggctctgcggctgcaggcctggttggtcaccccgtctgcatctgctggatacccaccccctccagagacggggctcactgccgccacggcaggtccccaggggcgaggtcttccggccccaccggtggcacctgaagcacttggagcccgtggatttcctgggcaaggccaaggtaaaggtggggacggcgtcctggggcatggcggctggtgctgagccctcgaactgtgttcccagggatggggggaggtgcagtccaggccaccgtaagggccaggagggtagagagtgggcccacagccatcctcaaactggcgcccacggtaggggggcggtgccccaaatggggctgtgagcttgaaggcagagcccactagagccggctgcataggagggggctccagctctctcaacaaggaccctgcaggtgccacccgtccccagactgggccatggccacagccacagccttgcagcctcccagagtcctgcgtctctctgcgtcctttcatgcctttgtgtctccatgtgtccctgccacagacagcgaagtccc

SEQ ID NO: 493044 - DNA, 1140 bp, Homo sapiens
gtcgtttataaacgggcccgcgcgttgacgcccacctcggtccgccatgctgctatccagtgccgctgctgctcggccctccatcggcctggccggtcgccgagaccatgccgtctacttcaaggagacagctttctggatcggagcacgggtggacttcccgcctggactcgaactccacaatcacacacgtcacgacttctctggccacaacttcgttctcacgttcccggcacagcttctacggctgacgagggagacccgcatacaaggctttgcagacacacgccaggcattgccacgcattcttactgcatctgctcggcccagcttctcgcagccctcttcacgcacaccaacaggaccacgacgcctggctggctcgcagctctccacggctgcacacccacttgcagccacgcaaccactcgcacactgctgcgcgggccggccctattgctgcaacggcctggtcttccatacactaccctctctgggcacccacgcaccagcaccacttgccaccgcgaacgaccttcccagacattacgacaccacatcgattagctacctggcgtcaccccgacacattcctagctgggaccccctggccaacccaccacgccaaccgggttccacatggctccaccttcctttctacacctacacccacaacgtggcgcccacacccaaaccccgctgccccgtgcacttcaaccagccacacgcggacacaccgttccccgcgctacgcccagcacccgcacctggcacctcgccacggcctctgcaaccccaccgcaaccaccctggcagtaacccaacccaccccttgcaccctctcggcttgcgcccgcggcccacccaacggcaaacccgaccacagccaacccacccctctaagtttgccaacacgcgctttagaacaagtagcaactctttggcatcccacaagcagagggcagccgcaacagcgcgtactctgtgccaaagcgcctcacccgtggggtcatgttccccccctcagtgcgcgccaagacaggcgcagcacccggcacatccattctggggctgcgcaaacccatcattagcccgcagtggactcccacgcgaccgctcccaaaacccgtcacacagcca

SEQ ID NO: 493045 - DNA, 123 bp, Homo sapiens
cctcctgattttacctctacaaaggttgtccccgtgacagcatttgtccccccccctcagccacatcatgctcagcccccctgccttggtgaggacccaaaggtaaaggtgtatgcagttgca

SEQ ID NO: 493046 - DNA, 302 bp, Homo sapiens
gtggctgttctaatgccccagcccgaagtggggagtgttgtgggggtcagagccctcccccagcaggagagaacctcccggaggggtactctgtggggcctgtgtcccctgctcgggagtaaggctggtcctggggtcctccttgaatggaacccactgggcctgccgagtgctgtgttcttcctcagtctggctgtgggcaggagcggacttttccagtgtcacccagggtgagtgcaaaataaagacggcgagtgtggctctgtccatcccttccctcctggagggtaaagggctcccgg

SEQ ID NO: 493047 - DNA, 221 bp, Homo sapiens
attctagaggatcccgaacgggtatcggttgaagaggaggagaccaacaggctccctgtgtggcaggatgcagagtgctgctggtgatgtgtacacctgcaagtccctgccagggatgagcgctgcagcctgacgcagaactgttcacatggtcatacctgctgaaccctcattgcccacgggaacaccgagtcaggcctcctgagcagccagtccacgtg

SEQ ID NO: 493048 - DNA, 926 bp, Homo sapiens
ccatataccaatgatggcgcgatgtagacacgagaaagcactataccaaggccactcacgacatccaacctgtcctaaaagaggccttcgatacgggataattcctatttattacctcgagaagtttgtgttcttcgcaaggatttttctgagctctttgaccatctccagctcatagctccactagcaccctcaattatagggaggggccacatgggatcgcactcaaacatgggcatcaccccgtcataggaaatcccctacgaagtctccacgtcctaaatgactaatccgtatttactgcgctaatcacggagttcatcagaattcacgctgacgtcttcacacataggtgcatagtatgcaatatggcaaattcgtataagtcaataataaacttttcaatgccatcatggcttattttacaatatgtacactctggagttcttctcatttatgtaacgcctacgctaatcaaagactccttcaggaagttaacttatacggaccgatacttcacccttttaatcgcgatttttcccgagggagggaattcatacggggcttcaatcagtatatctgctggatatgccgcgcggggacatatcccaagcgggaaggtttaccacccggtccatttcacttgtgcgcttcgagacctttttgcccatgcaaagttacgtgctgggctattcaattcccgcggccaaaagcagaaataactcattaattcaccttttttttaagcaattcaccataaattcattccaccttttgtggtggacttatacggaaaaggccgggcctggcaccttgtggtgagcctcggggcaagtgttctggtcaagaactgttggggtcttggagcgtacatttccttggatctggttccatcccaattccttattgcggactcggacaagggg

SEQ ID NO: 493049 - DNA, 739 bp, Homo sapiens
tgaaagccgctcagaatttgtatataccctaaataggttaatgggaccaggttaaccaagtgtcgaacagacacaaaagagcccaggtaggtcctttgtggccccgtgccagtgaatgtcaacctcactgagttgagtctgagtcgtaaatggaagcacagtccaacagagtgagcacatgtccgcaggacagctggatgcgcagcacgtaaacttgtggatccgtagtggtcaggtaagccataacctgagcagcatgatcgtttgtgaacaaggattggtcgagcattggcatgcagcccagctgaccgccccatgtacatcgcaagtggagacctggaaaagagccacgcatagatagaggtctgcacaggacaggtttccagtctcggtatgacagaagcccttgatgctgcccttgcctacatgaattaatgccttgagactaggcagagtgaggtcaggcggcctctcctcgtgaagcgatctcagagtcgcgtcatggaggttgtgcggttcgacatcatagtatagggtcacaatagtgtgtgtaccccccgctgagcctgagccagcggacagtggggagctagcctcgagaccctagtgggatagcaatcaatcaggatcgtccagcggcccacgcccatctctagcagtggagtgatatcaggaggaaggttctagcaacagtctggcagagtaattagaatggcagatcgcccccacctgcatgatc

SEQ ID NO: 493050 - DNA, 127 bp, Homo sapiens
  misc_feature (26)..(26): n is a, c, g, or t
  misc_feature (58)..(58): n is a, c, g, or t
gtagtgctaggtgtccgagtcctcanggcatgtcagtagtttaacaagacgcatgttntgaactacgctccgattgtcccatccccgccgggccaaaacagatttggtgggccacccagggatcccg

SEQ ID NO: 493051 - DNA, 472 bp, Homo sapiens
  misc_feature (13)..(13): n is a, c, g, or t
  misc_feature (32)..(32): n is a, c, g, or t
  misc_feature (34)..(34): n is a, c, g, or t
  misc_feature (46)..(47): n is a, c, g, or t
  misc_feature (50)..(50): n is a, c, g, or t
  misc_feature (53)..(53): n is a, c, g, or t
  misc_feature (55)..(56): n is a, c, g, or t
  misc_feature (62)..(64): n is a, c, g, or t
  misc_feature (66)..(66): n is a, c, g, or t
  misc_feature (76)..(76): n is a, c, g, or t
  misc_feature (83)..(83): n is a, c, g, or t
  misc_feature (86)..(86): n is a, c, g, or t
  misc_feature (90)..(90): n is a, c, g, or t
  misc_feature (94)..(94): n is a, c, g, or t
  misc_feature (111)..(111): n is a, c, g, or t
  misc_feature (113)..(113): n is a, c, g, or t
  misc_feature (116)..(116): n is a, c, g, or t
  misc_feature (122)..(122): n is a, c, g, or t
  misc_feature (143)..(143): n is a, c, g, or t
  misc_feature (149)..(149): n is a, c, g, or t
  misc_feature (198)..(198): n is a, c, g, or t
  misc_feature (217)..(217): n is a, c, g, or t
  misc_feature (232)..(232): n is a, c, g, or t
  misc_feature (235)..(235): n is a, c, g, or t
  misc_feature (245)..(245): n is a, c, g, or t
  misc_feature (247)..(247): n is a, c, g, or t
  misc_feature (250)..(250): n is a, c, g, or t
  misc_feature (255)..(255): n is a, c, g, or t
  misc_feature (270)..(270): n is a, c, g, or t
  misc_feature (281)..(281): n is a, c, g, or t
  misc_feature (283)..(283): n is a, c, g, or t
  misc_feature (291)..(292): n is a, c, g, or t
  misc_feature (294)..(294): n is a, c, g, or t
  misc_feature (300)..(302): n is a, c, g, or t
  misc_feature (306)..(309): n is a, c, g, or t
  misc_feature (311)..(311): n is a, c, g, or t
  misc_feature (316)..(316): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (326)..(326): n is a, c, g, or t
  misc_feature (333)..(333): n is a, c, g, or t
  misc_feature (358)..(358): n is a, c, g, or t
ggggggaaaaagntacttgacttggagggaangngtatgtattagnnggnagncnntggttnnnanttataaagtnatataantcnttcnttanagtaaaaaaaattttcntnaanaactanaatataatactgaagatgaanaaaaanaaaaccaaataggagtgtttgtattcctttagagatctggatatttttnaaagacttgctttttacgnacattgtgatagagnatnttttgttgantnatntaacntccatgtgtgggtcntttgttttatnanaaccatgnngnaggttnnngggnnnncngtatntnttncananctcacanccaggaacacttattttgaacaatncagacagtacttgccagagtcccaaatgctgaattattgaaccatgtttttttttcctttgttgaaaaaaataaaccagggtgatttctataaatcaccagtttttggcattgg

SEQ ID NO: 493052 - DNA, 128 bp, Homo sapiens
ccatgggtcctgggccccttcccccacttcaggctaccagcactgcagggagggtaagggctggctccagatacccctcccccacagattcctagcaatgaaaatctaatatattcttctgttgcccc

SEQ ID NO: 493053 - DNA, 267 bp, Homo sapiens
  misc_feature (55)..(55): n is a, c, g, or t
  misc_feature (71)..(71): n is a, c, g, or t
  misc_feature (82)..(82): n is a, c, g, or t
  misc_feature (180)..(180): n is a, c, g, or t
ggaggggcctggtgggaggtgattggatcatgggggcagacatcccccttgctgntctctcaataatgagnttttatgaganctggtcgtttgaaagtgtgtagcacctcctcctttgctctctttttcctgctggccatgtgaagatgtgcctgcttccccttcgccttccgccatgantgtaagttttctgaggcctctccagaaggagaagcctgtatagcccacagaactatgagtcaattaaacctcttttctttataaatt

SEQ ID NO: 493054 - DNA, 164 bp, Homo sapiens
  misc_feature (73)..(73): n is a, c, g, or t
ctgtcacaccgacctgtcacaccggggcctgtcacagcatgacctacctgtcacaccggggcctgtcacactngtgcctgtcacaccgacctgtcacaccactgcctgtcacactgacttgtcacaccagtgtctcacaccgacctgtcacaacagtacctgtc

SEQ ID NO: 493055 - DNA, 164 bp, Homo sapiens
  misc_feature (7)..(7): n is a, c, g, or t
  misc_feature (16)..(16): n is a, c, g, or t
  misc_feature (159)..(159): n is a, c, g, or t
gaggtanggacgacanaaataatctacaaaaatttcaaacatcactggcggtagatattcctccagctcaggggggaacatccggaaactggcatctccggctgcagctggggttccagcttgcatcacggggaaacacagctatctccgtggatgcanggaag

SEQ ID NO: 493056 - DNA, 293 bp, Homo sapiens
  misc_feature (123)..(123): n is a, c, g, or t
aggatgtggaagatcctggtggtgatgaagacagtgcagagctgcaagcctcagaccgggttctgagtacacagtcagtgtggttgccttgacacgaatgatatgtgagagccagcccctganttggaacccagatccacagctaattccgtgcaccaactggacctagaagttcactcagtgtcacactccacaagccttgagcgcccatgtggacacacacccaattgttcagcatcatctggatattcgatgtgcgtggtgaccctccaagtgagaagacctggaaccaa

SEQ ID NO: 493057 - DNA, 583 bp, Homo sapiens
  misc_feature (16)..(16): n is a, c, g, or t
  misc_feature (95)..(95): n is a, c, g, or t
  misc_feature (208)..(208): n is a, c, g, or t
  misc_feature (218)..(218): n is a, c, g, or t
  misc_feature (224)..(224): n is a, c, g, or t
  misc_feature (241)..(241): n is a, c, g, or t
  misc_feature (265)..(265): n is a, c, g, or t
  misc_feature (282)..(282): n is a, c, g, or t
  misc_feature (304)..(304): n is a, c, g, or t
  misc_feature (321)..(321): n is a, c, g, or t
  misc_feature (376)..(376): n is a, c, g, or t
  misc_feature (395)..(395): n is a, c, g, or t
  misc_feature (403)..(403): n is a, c, g, or t
  misc_feature (434)..(434): n is a, c, g, or t
  misc_feature (466)..(466): n is a, c, g, or t
  misc_feature (468)..(468): n is a, c, g, or t
  misc_feature (491)..(491): n is a, c, g, or t
  misc_feature (500)..(500): n is a, c, g, or t
  misc_feature (515)..(515): n is a, c, g, or t
tcacatagtttttttnttcgttgagtttagcccaagtttgactggtattttcagttcacttaccaccattccagcagaatagcagagcaatttcnattttgcagtgaatcagggttaatcatcccagaactgtttgatagcaaaagactaaaacaactcaagtgcctaccaacagtggacaggttacataaaatataatgcatttgcntaatgcagtncatgcnactgtgtacaggaagcnctgtatgtgctcatagggaaagtnctccaagatagattgtnatgaaaagggcaagtgcagaanagtctacacagtctgcnacctggcaagaatgagaaaagtgaagaaaacacgtatcattcattattgactganatcagcggggatgaatacngggcaganacacaagagaaagagaagtggccacctgggnaagtgggggggtgggttctttatatatgatcncnttacttcaaatagtttgaacccngtgaatgtnatacttatttcacanattaaacacattttgtattcagaagaacttcccctcaataatattctttctcttcattttatcctcct

SEQ ID NO: 493058 - DNA, 129 bp, Homo sapiens
ctctagagtgatacccgcgcggctgcggcacggcgatagttgagccgatcagctcaccgccgttcagcagctaggtactccacactgtagccctcagcggccgctcgcaccgcggctcctgccacctca

SEQ ID NO: 493059 - DNA, 627 bp, Homo sapiens
ggagagagaactagtctcaagttttatttttatttttaatgggctttggtagagggaggtaggtggtattattgataatttgttgtgatagaaattgatggcccctaaaataaaggaaacacctgtgctagggtttaagggaaggaagatggtataggctctacggaggcctccagggtggagagtagtcccctgctaagggagggtaaactgttcaacctgttcctgctccggcctccacttatagcatgatgcagagcaggatgtaggagaaagggaggtaagagttcaaaagctatatgtggttaatgcggggaaaggccatatcgggggacaccgaattattaggggaacatagttcagttgccaaagcctcggattatgagtgggatatactattgaagaaagatttttaccagcttgacatggggctgttgacgaataaccgtcggtaaacatggtgagtacgtaacccctaaaaagaggttgccataggattgcgcccaaaactacgaggatcgaaaataaaggaaggacttacaagacatgatcccataggaaaatccacacacatgcaccgaaataataaggaaatagtgtaccaatgtatatggggaaggaaaaaaa

SEQ ID NO: 493060 - DNA, 114 bp, Homo sapiens
  misc_feature (48)..(48): n is a, c, g, or t
  misc_feature (50)..(50): n is a, c, g, or t
  misc_feature (56)..(56): n is a, c, g, or t
cagcttctgcaggaggaatccaggctagcaaagaatgaagctgcgcgnantggcantcgtggtggaagcagagaaggagtgtaacctggagctctcagagaaactgaagggagt

SEQ ID NO: 493061 - DNA, 202 bp, Homo sapiens
tggggatactgccagccattgggtgcacatgtggtctgagcagtcagccaaagataaaccaccatatgaacagacagcagctaagctaaaggagacatatgacaggatattgctgcatatcgtgccaagggcaaaagtgcagcaggccagcagggccctggcaggccaacaggctcacagcaggagcgcgcaccacaagttg

SEQ ID NO: 493062 - DNA, 120 bp, Homo sapiens
ccgctctagagtatcccccctgcttctgcctctctagtctggcacggtgaagagacatgagaggggcagaagcaggaagcagaagcaggagcgcttcctgcttctgcgcctctcatgtct

SEQ ID NO: 493063 - DNA, 1356 bp, Homo sapiens
  misc_feature (325)..(325): n is a, c, g, or t
agcggcttaatccggcccgactcccccctccccccgagcgccgtccggctgcaccgagctacgcatccgagttacaggctcgtgctaagctaacgccgtcgacgaatctcccttcatgtacgccatcactgattatctaccggggacctcagtccagcgcacgatgaggatgtgctccgacatctacaaggatcctgggagatcgcggacgggttgtgcctgtgaggtagcgacgtgggaacgatgcgtcaagataggaaacgaacggtaatcctttcgagtgacatcaggcgttacgaatctggtggagaaattgcacttcctngcatgaaatcgcccccgaaggggacgaatacgggtaaccagacaaagcactagatacttcagctcgcgtgatccgactaattgatcgagtagaaacccagtgcacactgccatgggaaagcaacgttctcagcaaaaagacaacctagcagacgatacgtaccactcgagcacgaattgaccattgataatacaaatccaaaaacgggaaaaactgtgatacgaatagcacgtaggaacccaagaagatagtagtaaaaagagccgttattactgacctcgtgggggactcgcacgaaaccataagtgcgagtgcgcaacgactcccgtatgtcgtaacgcttatcctcactaacctcgtatcgcagaggcatgcatctactattaattgcgtcggaccacacagcacttggaagcttcgcgcactaatctgtggcgattatgcgactgtggcatactataatagttggccgaacgtaaaccgctcgttggcgaacgtcgcacgaggcgtaagtatgaaaaccctgccacattattacatagaattagtcgacctcttgtggtacaatctcgactcggtctgtatacacccacacacatttcgcgaacaacagcacttcgtttaacactccacacaattgttgcggccacacattctaaatagttgcgtgcaaatcacttaatattcaaacccactggagtgacaaataccacgtacagaacgtttggggcccctactctgtgccacatgagcccatgcattcccctacgagacgacgtcagcgcctatggtgctacctttctaaaggaagccacaaattatggcgaaccattcgacgttggcttccacattcgtcttcgaactgccttcccttatccaaatcatactacttcgttggacccgatgacatgtgaagtctaacgtcgctgtagcaccttgcggcacgggacacgtgtggtctcagtactagccaacaacacacgctcttgtttcatagtgtaatgcggtagtgctaccagcagcggacgtcc

SEQ ID NO: 493064 - DNA, 422 bp, Homo sapiens
ggaactcaaggaactctttttcagtgaccagacagaccaaacgtcatcaaattgttcctgtgctacgtctgaacttcagagagaaaccctctttcttggcaagtgggctcgattcaaaatgtaggcattttccagaaaaagggtccgtgtttcttgaagaacaggaactggtaattattaacgggaactgtgtttaactttggcaaagcgacggtttcgggaaaactgttttggacattattcaacagaaacggtttaaggttgttttggggtctcctaagagtaagtaacaagcgagaagagaaggcccagacaatgttctttcaagtttggatgctggccctgaggacacgtgcccatcagcagaggagccaaggctgaacgtccaggtcacctccacgcccgtgatcgtgatgcgcggg

SEQ ID NO: 493065 - DNA, 223 bp, Homo sapiens
gaggacatggatgaatgtgagcaggcgttggctgctgagcccaaggccaaggaccccgggggttatctgcccaagagtacctccccgctggatgaatttaagcgcaaggacttcaatgaggacacactctctgtggcactgccatattactgggagcactttgataaggacggctggtccctgtggtactcagagtatcgcttccctgaagaactcactcaat

SEQ ID NO: 493066 - DNA, 300 bp, Homo sapiens
gttgaccgatgtgcgagccactgagcgcggggcgagccagcgagaggtcgcgagcggtggcgctgcctgcagcctgcagcctccggtcggccgtcgagccagtgcgcgtgcgcggcggcggcctccgcagcgaccggagagcggactgaccgacggtagggctagcgagccagcggtgtgaggcgcgaggcgaggccgagccgagagcgacatggtggaccgcgagcagctgctgcagcgggcgcggatggccgtgcaggcggagcgctacgacgacatggcctacgctatgaaggcagt

SEQ ID NO: 493067 - DNA, 582 bp, Homo sapiens
  misc_feature (37)..(37): n is a, c, g, or t
  misc_feature (75)..(75): n is a, c, g, or t
  misc_feature (144)..(144): n is a, c, g, or t
  misc_feature (204)..(204): n is a, c, g, or t
  misc_feature (216)..(216): n is a, c, g, or t
  misc_feature (224)..(224): n is a, c, g, or t
  misc_feature (329)..(329): n is a, c, g, or t
  misc_feature (382)..(382): n is a, c, g, or t
  misc_feature (430)..(430): n is a, c, g, or t
  misc_feature (434)..(434): n is a, c, g, or t
  misc_feature (436)..(436): n is a, c, g, or t
  misc_feature (454)..(454): n is a, c, g, or t
  misc_feature (518)..(518): n is a, c, g, or t
  misc_feature (577)..(577): n is a, c, g, or t
  misc_feature (582)..(582): n is a, c, g, or t
cagatgctccagctcactgaaggcgacaggccaggcngcctcattaacaactatactacaagggtaaacagctgngctaactggctgacagttataaaaacacaaaaaggagcctgggaaacagcaaagtcaacagggaacagnaagtgggtaccccctttgccagaagctaattgttttctgggacctccaatgcaagatggnggcaagagaganagatgtanggcagctggcggcaggccctgcgcccacagctcctcgcctgtcctttgaccacagatcccatcctgcatgactcaaggtcccataggcttggcctagctcttatngataggggaacaatagaggggaacccagcctcaacccaagtcagaaggtagcnttttgccttgggaggtctgtccattgaactcaaagggaggcagttacngcangngggctaagcatgttgacnaccatggctcatggcaacctaagatggcagaagacaaacacagaaaccaatggggtactaggangtctgcacaacatggagtcctgctccccgtacttagtccactctctgcctctcgagcgnaactn

SEQ ID NO: 493068 - DNA, 255 bp, Homo sapiens
tggcgtcacctattcacgggcagcgcctctcctgctcgtccgggaaggcgatgtcgaagatctcccggtagtgttccacgaaggtgcaacctccaggccctcgagtgatgcaaagctgccaggatcgtagaaagtccattcttagtcctcgagctggcagagagaatgcacgatgaccccatcagcgcattggcccggcaagaggctcttctcctttaatagcccacacaaacaaaggcagggactcttgccccg

SEQ ID NO: 493069 - DNA, 237 bp, Homo sapiens
actacgacgaagcgcacgatgggcgtcaactcgggtccagcgagcgcatatcatagtaggacccgccagctgcgagacaaaggcggcagcggggtcaggggcgcacttggactcggacccgaggtgcggtctgcgctagcattcacgggcaagaggagggcctgtctctgcgaaggcagggtgtagaccctcgtccacccgcaaagcagcacatggagacgcttccacgggtgaact

SEQ ID NO: 493070 - DNA, 746 bp, Homo sapiens
gcgcctcattaccatcatgagcatcatcacaatcatggacatcagcaccttgggagcagtgagctttgcagagaatcagcaagccaggagcaccaaatgctcctactcatcctgctcctccaggcctgcatcgactcaccgataagcgaccagggtcagcataggcagggtcacccgagagaaccgagatatgccagcaagtgaagatttgacaaggatttacagaagagaagctctgtcgaacagagatgtataaatcaagtggactctgtaaagttgccacagattcacgagttggctcctaggagcgtgatgctgccattgtcgacatctgatatttgaaaaaacagggtctgctgattcgcctgacagtgtaaatgaaagacctcccatcttgtatgtagctgacagggacttcgggcagaggagaacataagctgagatcttgtcagtgacgttgcctcgcagctgcctgacgaagtaagtcagcagcttagtagcccagcagaagccagtgccagtgggacgctagaaagaatccaggcaaagaaagtgagaatgagcttcaagctaaagtatttaacaataggacgatagtcgcccaatttagtctagacatcaatttcatttccagcatttttataaaataccaaattagtgaagcagaaatagaaattagatattgtgcaagacatggggaaatctgactggaatggggttccagattttaaattttatgtcctaga

SEQ ID NO: 493071 - DNA, 854 bp, Homo sapiens
gacagacgtcttttggacgaccgatccccggggacgctcccccccggtgtggcgccccctatgatgaaccaccgggtctggtctcagcccctccggggatttttactcttagacccccggggggggggatgaccaattttctcaccaccggggcccaagcttgttgcgccaccttggcggcccttttgggggcgcacccacctagagaaccacaagtgtgttgcgaccacagaaacacacaggtggggcccgctgcccggaattttcccccgggggaattgtttttggccgccgccgcgcctccgcgcccgcggtgtggtggcgaccacccggattttctctggtgtcttgcgggacagtgacgctcccccccggcgtgtgtatttataaaagatgtgcgccgcccccacccacccacccctggggggagatcttcccccccgtctgctaataggcccccccctgtggtgatgaaccggggtgcccccccgcggtgatggagcccccccccccgtgcccctcagtggacgcctctgttggccagagaagaagcgcgcggtgtaatatttctctctagaatcctctgggggtattttcctcgcccccccccttcttcttgggagaccccccctctcgtcatgtgtgatgaggagaacccccctccccgatgttgccccgagcccccccgatgcccgcttcgttgaactcgggcacctcctccccgggcaacccccccccttgggtgtttttaaagggccccccccccccccggtccccaaattttccgttttccccccggaatttaaaaaaaatatttttttgaaaaaaaaaaaaaaaaaccccccctggcccca

SEQ ID NO: 493072 - DNA, 237 bp, Homo sapiens
  misc_feature (3)..(4): n is a, c, g, or t
  misc_feature (32)..(32): n is a, c, g, or t
  misc_feature (40)..(40): n is a, c, g, or t
  misc_feature (84)..(84): n is a, c, g, or t
  misc_feature (94)..(94): n is a, c, g, or t
  misc_feature (110)..(110): n is a, c, g, or t
  misc_feature (131)..(131): n is a, c, g, or t
  misc_feature (170)..(170): n is a, c, g, or t
  misc_feature (172)..(173): n is a, c, g, or t
  misc_feature (198)..(198): n is a, c, g, or t
  misc_feature (201)..(201): n is a, c, g, or t
  misc_feature (209)..(209): n is a, c, g, or t
  misc_feature (220)..(220): n is a, c, g, or t
  misc_feature (222)..(222): n is a, c, g, or t
cannactagcaagcatctagttgaacactctntatttttngtaccagcattcactggctgttcccagctccaggaactcaggtnggattcatanttttttccgtttcctngctcttaggaaaagtactganagctcataatttgttgttttttttaggatattttctttntnnctagaagcaatgctttttttttctnggnataatttnttttacatttntnaaagaatagctattc

SEQ ID NO: 493073 - DNA, 749 bp, Homo sapiens
ggagcagcttcgcgtcggtcccgagggatctggtctcattgcttcaacagcagttctgcgacggcacacacgatccggtggtactactactatccagaccatccgtatccggcccatcacgacattctcctactcccgctttggcaacgctcacgaggcaccgatcattcgttcgagacacactacatcacataggcgtactactgagcgaccccctggcgcacgacaacacaggcttctctatatggtgcgtctagcgcctcacatatcctatgcgccacaccgcacagccccaactgcacgcgcctcccaccaaggacgtatacagactccaggcaagagctgtaactatgcgcaggcacgtacccgctgggcaggcgccaggcccctggctgcaaacgcagcacacgtgaggctcagcaaatcatactgggctacacctcttggaccaaggggaccccaattccgcgttaacggaccgcccactaagccgctctttcacgtttacctaccatggggacgccccctatccataagattcctacgggaaccgccgggccgcaaactggcaacatgcgctgggggcctgctcaccttggagcacacagctgctggccccggcgttgtaaagaccccctaagcctctctttcgcattcctccgcacggcctagggaacacatctggccgacctccaggaccgctgcacaggcacaaccgccctgtcgcgaaacagccgcagcctcttcat

SEQ ID NO: 493074 - DNA, 308 bp, Homo sapiens
gacctaatcccatatgtctctttacactatatagctagtctgcactttggggggtcaaactaaacaaagttactgcccagaccaatgttcgtcgtttctcctatgttttcttctagtagtttttacagattctggtattacaattaagtctttaatccatcttgagtagatttttgtgtatgttgtaagatgagtccactttcatttttctgcatgcatatctctagctttcccaacaccatttattgaagaggctatattattctttttatgtgtagtacacacctttgttaaaaatcaattgactg

SEQ ID NO: 493075 - DNA, 863 bp, Homo sapiens
gaaaccgcggttgccggagcccgaactgaggcggcggcgggagcccggttggcgtctggtcttcgcgtcggccccgctggagccagactgctgcccccggcgctggggagaagatggtgcctagctggcctcgggcccgaccacgcgccgacacgagtgagcccagcgcgaccgcggggcgtccgccgagcagctgggcccggctgggcccggggcgcgcagctgcccgccggggcggggtggagctgatcagacataatgttcagcatcaaccccctggagaaccttgaaggtgtacatcaggcagtcgtgctcccctgggtggtcttcatgatcaggcgtaagcgccattggcatagctttcctgaccctgggctacttcttcaaaaatcacggagattaaatccccagaaatggcagagggattggaatcactttctgctacggttcactgattcggccttgtgtgtactcagagcaatgaaaccctcaaagcatctcacaaagcgaaaccagaactcccggacaggtacaagtgaccaagcgggcaggccagagcattccacccagtccccccaggcctggaggactcggggcccggtgaatatctcagtctcaagtcacgcataaccctgggacccactgaaaacccttccggaaggggtaattccccggccaacgcgttcggcccaatccttgtaacatcgaagcaatctaaggggcatcacacttgtgacgttcacaggccagggaaagaccacgaaggaggataacaacataagctttaaccctttcgtagcagcgttggagcctcgaattgactgtcgccgcgtcaactggacactgttgagccagtgtggtaa

SEQ ID NO: 493076 - DNA, 439 bp, Homo sapiens
tcgtctcacataagattgttgtgaaaattaaataagatagatgtatgtcatgtcgccaaacagacatctttatcgcaggagtcagtcgacagaccccatcaaggacaagatagtagctacttggggctttgccggtcatgtgacctccatagcagttgactcaactgcacagtttgaacactgtagccatagactgtgcataaattagtgggtattgttgtgctccaataaaagtttatttatggacatcgacacctttaggtctcatatgagtgctacatgtatcagtgagcacctggtgttctcctgcattacagcttagctttgtctgaccctctcagccccgctccaggcttcacgcatctcctccaccgcctgaaccgcctcccttgatgcatctatacttattctccttatgtattattttttatttttttat

SEQ ID NO: 493077 - DNA, 129 bp, Homo sapiens
ctagcggacccttatatctacgtctcatcacgtggtcattagaagaaatgcatgataagaaccacaactgagatgccatctcacgccagttggaacggctgtcattagaaaggtcaggagacaacagat

SEQ ID NO: 493078 - DNA, 457 bp, Homo sapiens
gcagacgcgtcatgcaatatactcgctgtggcacgtgtctcagtcttgacatcagagagctgcatagaatggtgctatggtggtggattttcgtgtcctctaacactacatgtacagctctaatctctactgctggaggtggggcctaatgggaggtgtttggtgtcatgggggcagatccctcatgaatagatgaatgccttccctgggggatgagaaggtgagtgagttctcactttatttattcccttgagaactggtggttaaaaacagcctggcacctcaccgctctttcctcctctctggccacgtggtctctgcacacactggctcccctttaccttctgccacatgtagaagcagcctaaggccttcaccagggacagatgctcaatgttgaacttggtaaccatcagaaccccaagccaaataaagcttttctctataaattacccag

SEQ ID NO: 493079 - DNA, 144 bp, Homo sapiens
ggcaagtggaggctgcagtgagctgtgatcatgccactgcattccagcctgggcaacagagtgagaccccatctcaagataagtaaggtttgtcagtacctgatggtggttctttccgcagatgtcagtcccaagtcgcgaaga

SEQ ID NO: 493080 - DNA, 127 bp, Homo sapiens
  misc_feature (28)..(28): n is a, c, g, or t
  misc_feature (58)..(58): n is a, c, g, or t
  misc_feature (69)..(69): n is a, c, g, or t
gtgaaaatgcggtgtatcctcacgtacntgtgtactttgtacatatatttaacctttnatacctatgtncgatttttttttgttttgtcctggctttgaggcttgttttgttgtctgtgtctgtctg

SEQ ID NO: 493081 - DNA, 394 bp, Homo sapiens
ttacaaccccacgatcaccgatgaccagcctggggcaacagagagagacctcatctctacaaaaaaggaagaaaaaaggaaaaccagcctggacaacatagggagacccagtctctatcaaaaaaagaaaaaaaaaagatttaattttttaatatagctggacatggtggtatgcgcctgtggtgctagctattcaagaggctgaggtgagatgatcacttgagcccaggagttcgagttgcagtgagctatgttcgtgccactgcattccagcctgggtgacagagcaagaccctgtctctaaaagaacaaaaaaaaaaagagagagaaagaggctagacaagtctctggaggagtttggggcaaaagggagcagagaacactgatggtgtga

SEQ ID NO: 493082 - DNA, 333 bp, Homo sapiens
taatctaatgaaatataatagatcacatacagaatgaagactcagagccaggcacatatatagaaaagaatctgtgactacctaatacatgcaatgagtagcaagtaaatctaacagtcatacatcctggaattatacaaatttgcacagttaacaaattgaagacattcaatcaaatatgtaacattgctgaactgaagaaatattaccagtataaattaggactgacctgctaaatcaaatgcattctacctcttcagattcagatttaaaatgatggtcgtattaccgagctacattaacaaaaaactctgctaaataaaatgcggatcc

SEQ ID NO: 493083 - DNA, 131 bp, Homo sapiens
ctgatcagaggattagctggactcgtaacagaaggtgtttcttgagaccagcttcctctccaagagtgatcattccttcttcaagacagtgaccagccatcggagaatagaaggtgacgagtgcccagcgc

SEQ ID NO: 493084 - DNA, 176 bp, Homo sapiens
ggactgctgcttctctctcgctaagtgtccagaacatccgggccacagcctccaggcgtctcggggcgtctggcttgccataggtgcgacacagctcccgcatcttgagggcggcagggcctcaatctcagcccgcccgtggcggaagtcagccagggccaggccatggtggccca

SEQ ID NO: 493085 - DNA, 408 bp, Homo sapiens
ctagaggatcctctcgcttacaaacctcacagctgcagtgttccaatgctcctctagttcagcctggaatggtgctaattttacttttcgagaaatcctatcagcctgttgattgggtttagtcaaaggcaatctctaggtcttcccgggaggacaggatttttgtttgttctgttttttggagacacgggtcttactattttgctcaggctgggcttgaactcataatcgtcctgcctcagccttcggcatagctgagactaggcgcatgccaacacaccccgccccagcatggctttgaaggcccttctctgctattttgcagtcatcagctgatccaagtccctaattttaaacttcacatttagcctgcaggaggctccttcaatgctaggcctgtgggctcag

SEQ ID NO: 493086 - DNA, 186 bp, Homo sapiens
ttaacggtcaggaagatgtaacaattaaaaatgtctgctacaggccagcgcgtggatggctcacacctgtaactcccagactacttggaaggcgaaggtgggagaattgcttgaaccccaggggaccccaggggcagaggtcgcagtaagccaatatcgtgccactgcactcctccctaagaccct

SEQ ID NO: 493087 - DNA, 157 bp, Homo sapiens
acaggatcctcggagccttacctttacatcaatttgtctactaatccagtcttcatcccttcaaccaaattatacactgaaccatctgaccattgacccatctagctatcaactccatcttaccatatactcaggccccaatcacccttccaaaaat

SEQ ID NO: 493088 - DNA, 775 bp, Homo sapiens
tctcgaactcctgaactcgtgatcgccgctcggcgtcccaggtgctgggattgcgggcgtgagccaccgcgctgggcctagatcaaatctttatccatgctcattggaacacaggattactgggttgaaatcattctagtttgtcatattagatacttgtaagatgaatctattttagcacaaggtataaataactacgggaggtcggatctctatctgctatccttttgtgcattgggcgtataccacgtctaggtactaaaacagctttgcttatgtggccaggggaaaacatggcattctgtgcgcaaagtcctacatgatcgtcaggacctgtcttggtccctcccttgtttatggtcattgtaagatgcccgcatgttaatggcttaagctgtcactggagctgggtgtaatacccgcttcattcctcctcccatcgctcttacccgaaacatgaagtgggcactgtgactctattgagatctcgataagatcatcatttgacacttgtagttccaacgtggagcggaggtaaaccagtgatatcgtgatgtgctggctggattgacgaagctcaagcatcgaattctaaaatcgctgtccgaaaatatgccctattatttttgtcccaactctggctaagtgtaaagcttctgaagccagttttatagtttgatacattgtggtgaaggatgtactcgctgttctattgaaatgaacctacagttagtaggtgtcaccatcagggttagaacattctgactagaaattc

SEQ ID NO: 493089 - DNA, 130 bp, Homo sapiens
tcgggatcatgaagaacttggctgtcagtgtctgaggaggtaggatcgtcgtagaaggatctgggactgccagtatctgagagtgacgcctgcatgaggatctgtgtctgtcagacctgagcaagccagt

SEQ ID NO: 493090 - DNA, 219 bp, Homo sapiens
catttactcttgacaaataaaacatatatttactaaaatgtgtttaattttcctttctgaaaactctcattttaaaaacgttcatttaattatgtatttgaattattttggagatgaggtattttatgagtattttcagacaatgaaacttattagtctgtgtcagattctgagcaatcatagagtcatctaagttgtaaataaacccttgcatagcac

SEQ ID NO: 493091 - DNA, 676 bp, Homo sapiens
ccgggatagtagagtagagagagcgagtagagtagagtagagtagagtagtagtagtagtagggggggactcggctatggtaagtaagtacggtgactaaccccgctacccctacaccccataccccataccaccggcgacgccgcagagggcagtaccgctagggccgcaggaaatagcccgaaaactgaagacatacgcaggaggagagcgacgctagagccacaatcgggctactatacgataaatagcaactaggcaagggaagcacgtaaggggaccacatacaatagacagcctattacaacagtatagcagggactacacgtacccataacactaccacaggagcagaaggccatacccggtgcccaatatacctaagaacaaaaggcgcgagcagaaaataaataataccccagctaactaaatagactgcacaatggggaagacacaagctctaacaacaatccaacccaagtcgaacgcattaattataggaaccgcaacccttacgacgatggccggtacacgcacataggccaccctatactagggcatgccaatgcagaaacgttaccagttaggccactagggcaggaaactgggccgcacgggtcacctaaatgtaggcgcccaaaactagtggaggaccccaaaacttaacacccatacc

SEQ ID NO: 493092 - DNA, 847 bp, Homo sapiens
  misc_feature (847)..(847): n is a, c, g, or t
ggcggcgcgaggcgagccgggcgcggcggcagcagggacgacccaggctggagctgaggccgagctgagggcgcccgagccccccgccccggccgtcctctggctccgagcgctcagccccgggcctgcggagacatgaacgccccgggcccacgcacccgggcgcatgcggcccgtgccccgtggtgccccgtgatgaggctcctgcgtgtcgcgagctgccacctgaaatgagcgattggtgtacaaactgatatgaggtgaaccttccagcaggtaatgccatgttaggggaatggagcgagaggagcggatggaggatcgccatgccaggcaagttggggtggtcctcaagagccttggcctccagcatggtcctgcaggggtactccggaggacctgttcacgaagtgcccacaagaactgccccatgcccccaaggatgcggaccaccgttgaactcagatcttgctctcgcggccgcatctccgcaacgatggctcccgagacctgttgtctattggcaatggacaagacagagtggattacgtgttgcggatcccttgtgcacgacgggtgttcccaggacacacaaaccggataaccttgtacccgagctccccggtgtcccagcccctcggaaacttacaagctgtgcagcaacgccttgggctcatcgtctgatcgacattggtgagcgagtgggtgcagaggcattcgactcgaacccactatcacacaatagcgcccagcggggcattggcccatacgggccagatgtgcgccaacctcaatcgatgttggaaagggcttggaagtggccatcaggcacaggcttgggagcctn

SEQ ID NO: 493093 - DNA, 102 bp, Homo sapiens
aaaggcaactgcgcgccgacctcagcgtataacccatgcacctgctcaggactcagcccggcggtttcgtttcggatgacaacatcgccgaccttgggcaaa

SEQ ID NO: 493094 - DNA, 983 bp, Homo sapiens
agcaagaaggaacagaaagaaacttcggagacaaacacggagggacagcacagaaggaactacaagaagaaatgtcaggctgggtctgatgcctcctccagaacccagagtgagaattgctaactttgatgcgagtattaggaacagaagctgttcgagaaccttcacgtagggtagaagcccacgtcatgagctcagatggcgagatgagatcgcgagaaaggcgcgatgaagaggccatcgttctgtccgtatactcacagtagaacagagaaatggtccagaagaattaaaaagcttagagaagacatttcacgagggggtacacatatctgtatatagagttcgaaatttgagcaatccagccaagaaggttcaagacttgaagccaaatgctgggcaactgtacctgacagggcgtggtggtactgcacaaggatgtcaacgtggtagtacgtggaaggggggcccaatggcccagatgacattgaagcgtcttatgctgcatcggataactgtgggatgaacagacatctaacataaagggagatgatgatgaggagtctgatgaggaagctgtgaagaagagcaacaaatgttgtactaagttgggagaggtacacagccaaagacggaagctttggacgagcttgaagttatacaacaggtgttcctagcagagcaacagtggatacaggagacataccagaaacacctggggactcgaagctaactgcgaacccattaagcagctagacggttagaattcttgtcgctcaagacagtccaactggacttgggacgaattaagtgcagaagcccctttggcacatattacttcactctaagactatttggtagtccataaagacaatcataacctgaaaaggaaacatccgaagacgccctcccacagttggaaaggaggtagaactagagacgtgtagccaagggaggaacatgcaggaaagagggggcaatta

SEQ ID NO: 493095 - DNA, 341 bp, Homo sapiens
gaggctgccacgcctccatgggtggtccacacttgcttacggtggtcccaactcgcttggctggcccaacgacgactgtctggttcttaacaaataccagagcctatagaacattgctaaagggatttcagccacaacctgaagctcaccaagaatgagttttctggacctggttaaagtgtcacagaagggagtcaggaaataagaatccccaacaaatataagagaacagaatgatactagtccctactagtccatgacaaggggtgccaacttaggcatttaaagctatcaaagatgatgctggtgaggggacctggccacttttgtaatcgtctgac

SEQ ID NO: 493096 - DNA, 305 bp, Homo sapiens
agtcagctgcttccacattaaaatacttactactccgcagctcaccaccacttgcaagcctttctccaaccggatctgttatacacaccctgagtactctggatagtggaatgcgataattgcgacttgcaatctccccaatacgagtgcatgtgaatacatccctactgccattaaattccgcaattctctcatgtcgagtcaatgtgcgtgaaaatatgccggggggaataatgccacgtaaccaccaatgaaattgtcgcagaattggctacgagggacatctacaaagtctgtgcattcgg

SEQ ID NO: 493097 - DNA, 389 bp, Homo sapiens
ggctcccccctgaaaatctctgatttcaccttctgtcacaggagggacaaaagttactcccatctccaaaaagtaacaggtacttttattataatataaagttaggcccggctcagtggctcactcctataatcccagcactttgggtggctgaaaggcaggcagatcacttgagcccaggagttcaagaccagcctgggcaacataatgagacctgctttccaaaaaaaaaacaggaaaagtatagttgataagtatagatgtcgggcacacaggaagcagtataagtctataatgctgctgtgctatttaattttcccaaacgtccatccttgcagaatttggtgatcagtgaacagagtatctaaacggggacatattgacccaaa

SEQ ID NO: 493098 - DNA, 299 bp, Homo sapiens
cccccccccccaaagggccccccccccgggggaaaaaaaaggtcccccaggggccaaaaaaaaatttttttggggggggggggacccccccccccccatggccccccgggggtttggggggttccccccggggcaaaccgggggccccaagggggggtttcgggggcccgggtttttaccccggggcccccgggggggccgggggggggttttaggggggaccccccccggggggggcccggggggttttccccgaacggggggttttggggtttggttttggccttttaaatttttta

SEQ ID NO: 493099 - DNA, 133 bp, Homo sapiens
  misc_feature (50)..(50): n is a, c, g, or t
catataattatatatatatacattagaaatatggaacataaaaggagaanctctaaagaaatcaaagtgattgctctagcgaagagactggaaagtgagaggaatactgtattttgtaacatataacggtggg

SEQ ID NO: 493100 - DNA, 103 bp, Homo sapiens
atgtctagcatgaaaacaagtttttttatgatcagatggttcactagcaaatgacctcaaataagccagatgaacattgaagaaacggtcaccagttctctgg

SEQ ID NO: 493101 - DNA, 210 bp, Homo sapiens
tctacaccggggacagtattactccagagtttaagcattaagcaatggtgaattgaaaaaaaatggtacaagtgtgtcagcaggaggctgatgagcagttactgtggaaaacccaaatcaagcagggctggactgccatctttggtcagtttccacattctgtaattacggagttggcccaggtcaaagttctattttttcttatttctc

SEQ ID NO: 493102 - DNA, 387 bp, Homo sapiens
aaatgaccatgtctactgttgtcaggtggcagagatatctactctgaagccttgtatgggcctgggtacgttgtggagcctgatgctggaattgaagtctggcgtgctagcagcctgtgccttgttttgatccttggccttgggcttgtgccttggcctttggccggcacagcctgagccgcctggcaatacggacacgagcacgcttcccaagcttggggtgggcaatgtaggccagtcgatcgagcttgcggctgacaccctttgggatcttgggcttaacctccttgggctttacgagggccttgatagcctcggcacgtgcactcatggccttggcattgttggcctgcatcttctttaggccctttttgttgtgcttcttgg

SEQ ID NO: 493103 - DNA, 429 bp, Homo sapiens
  misc_feature (14)..(14): n is a, c, g, or t
  misc_feature (73)..(73): n is a, c, g, or t
  misc_feature (105)..(105): n is a, c, g, or t
  misc_feature (108)..(108): n is a, c, g, or t
  misc_feature (121)..(121): n is a, c, g, or t
  misc_feature (210)..(210): n is a, c, g, or t
gaacgaggaggggncacaaaaacccaaaaatcggtgaatccgggagctgtttgaaccattcaccaaattgatngttgctagcagactataaggagaaagggagangantcaatggacgcantaaaatgataagggggatatcactaccatcccacaaaaatacaaactaccatcggagaatactataaacacctctatgcaaataaactngaaaatctagaataaatggataaattcctggacacatacaccctcccaagactaaaccaggaagaagttgaatctctgaatacaccaataacaggctctgaaattgaggcaataatcaatagcctaccaaccaaaaaagcccaggaccagaaggattctcagccgaattctaccagaggtataaaggggaactggtaccattccttctgaaactattcc

SEQ ID NO: 493104 - DNA, 449 bp, Homo sapiens
agatgttggtgtgtgccctggggttgttgtgggcctcatgggcattgtggggggcactgtttttatcatccaaggcctgggttcagttggtgcttccaaaccccaagggcccttgtgaatcccctcctggaagggaagggggctcgcccttttcaggggcaaaagaatgggcttggtaaaagacccagccctattttttgggccggtttatcaaatcccctttttccccccaaaatttttcctctccccctttttttgggggttaagggggtaaatccccccaggggtcccaaaagcctttacattttttccccggccccccgatttttttttttttttttcaaaaggtacccacccagacaaggctggggggagccccccgggtaccttattcccccggaacccccctttaaaatttccaagggagcaataaattccttttttgggga

SEQ ID NO: 493105 - DNA, 281 bp, Homo sapiens
attgtttcagtcccaaaaaacttttttggggacctctgggtagccccttttactctttgatatttcctatggacaaagcttttattgttgtaaatccctttttaaaggttaaataggattgttaacaactatgggtttgcagttttttgagtaggtgagtttttaaaatgggtaaatcaaaataattagaccacttgttaatttctttaaaactaaaaataaattacttttttatttcaggggcttaggtaatttaaaataaaccttccatttatggtcca

SEQ ID NO: 493106 - DNA, 468 bp, Homo sapiens
gcaaccaatagttgacataagcaaccgacatttacaggaccgtgtgcctacacttgaacacttgcgggtgaacacaagataaaagacaacaacaacaactgcaagggtagaggagacacgtcataaaaaaaagaagaaaaaacaaacggactaaagggggataaaaggcatacaccgatactacgacagtgcacttaaactactagaccgatggggatggggcggttcacagcgagagtaaagaacagaggcagcggggaagtaaggaaatgagtagcgggaccgaccgactactggcaacgggaccgtacattgaacgtcaattaggacaccagctgcgggggggaccacataaggcactaagcacaaacgacatgaaggtgcaaatcaggggtatagtgcactgcgggcgaaaacgagtagggtacactcaacagtgagcaataggactgaacagaacgttgttgc

SEQ ID NO: 493107 - DNA, 825 bp, Homo sapiens
taggttgaatctgtgggttccgactcagagggccagctgtatgtggatttctttttctttggcaactgcatattttaactttctgatgctgatattcagaatttttgacatttaaaaattaccgttgttagtgggaactggagatgtttgaagaatatagaacagaagattattctgttgcatgcagactgagatagcagagtctatcagataccctggttctctgataaaagaagtatcttgatttctggagaactagcagataaccccaccatgccacagagggtcttcatgtcaagttcatggtccgcaacctcagaggagccttgggcgaggtcctcagacctctaacatacacttgctgtgctcttcatttgtttcccacggtgattagtccaaatctctacctctctccccctaccccctacttcatccttatcctttaggcctttccttctcaacagatgatgtcatctcttatttcactgagcaaactgggtatcccaggaggagactccatccacttcctgcccccttgccaaaaatgtatcttgatttttccttcctctttacttcctggctgcctgccttcaaggaagtcaggtccctccctttctccaggattaatttctccagctcattcttgattttgtccctgtctctccagggagcttgcctccatgattagcttcatcctttgttccacttatgacagtgtccgctgtgtcgacttctttcattcagcttataaagatcccaaggcttcccatttaaaaaaattaaaaaaggattttttttttgcccctacaccctccaatttctttc

SEQ ID NO: 493108 - DNA, 786 bp, Homo sapiens
tgcacagaggtaggagaaacaacttgcccttagccgaagagttgacaaaacactggcgtttaattggttggggtcagataagaagaggagtgacaactcaagccaacagctagatgatgactgaagaataccagtttaaataatacatacggatggatgtggcaagttggaatgcctcttaacaaccaaggggtatatttctcaaagagcaatcattggggaattgatttcacagttcgttaccttagtaggtaacgagtaaggttattctctttgttgatattacatgatcgggtgtatcggaaaactgtagcggtagctacaagttgactagtcagaaactgtggctataaggttgggcctggatagtctgcttttgggcaccaatttaaccaattcccacatcaggtcacatttgtgcatcatgcagccctgaggttgggtgggtcatcaattcggtggcagttgattgcagtctggctctgtgacccaggctgcagtcgcatgggcgatgactctgaaaaaactcgtgtcgccccgggggttcatagcgatccatccagtgtgcttcagtccttccctgaagaagtggacataacagggtgccgcggccaccacacgtggggtgtaagttgttgcggttgtatacagtacagacgggcctttcggagcattgtagggcaaagagccagggcatcaccctgaccatcagggggtgtattaggccaccttcggcttcacaaagtcgggggggattacagggcgtgaggccacctttgccaagcc

SEQ ID NO: 493109 - DNA, 144 bp, Homo sapiens
tgatacattcgtgtccagatgattggataaagggtagcttactgtgttgtccgtgccgattcaggcttacaatgagtgaggtctgcgagctaggagatcaataaagttgattggcttagtgggcgggacacgaatgttcagggc

SEQ ID NO: 493110 - DNA, 100 bp, Homo sapiens
  misc_feature (5)..(5): n is a, c, g, or t
ggaantgcttacaccagatactcccaccagagagaaagtatttgcctggaatgtaaacatttcaatcaataagtgacattcggaggtccgaagacagatc

SEQ ID NO: 493111 - DNA, 119 bp, Homo sapiens
  misc_feature (1)..(1): n is a, c, g, or t
ntgtaaggatccagtctcactcactcttctgcagctgtgtttgtaccaaatatttcacctgtttctttttttattttattctatttttttttttgtgtgtggggggaaaaaaaaaggag

SEQ ID NO: 493112 - DNA, 193 bp, Homo sapiens
cgaaaggctttctcatgtctactcacatacctttgctagcatactacacccatatccgcgtgtccgccggtcactctgccctgaatgataaccttcaataggtttacacatgctcattacgtcacccttcaagtatatcttcccggagccgataatcaccatggcttcagattcctccgtgtaacaaacaagc

SEQ ID NO: 493113 - DNA, 109 bp, Homo sapiens
  misc_feature (10)..(10): n is a, c, g, or t
ctgcactggnagctgcctggtgaccagaagtttggagtccgctgacgtcgccgcccatgatggcctccaggctgaccctgctgaccctcctgctgctgctgctggctgg

SEQ ID NO: 493114 - DNA, 179 bp, Homo sapiens
  misc_feature (125)..(125): n is a, c, g, or t
  misc_feature (176)..(176): n is a, c, g, or t
tgagcagtacggaaggtaattgtccaaatatgcacaatggtatgaaccaacaggcatatgcatatccgtgctactgcagcttgcacctatgattggttatccaagtgccaacaggatattcccanataagactttagacagtatatgtaaatgtcgtgtttttcagtaattgctcnttt

SEQ ID NO: 493115 - DNA, 322 bp, Homo sapiens
atcagcaagaaccccaaggacaagaggcttgtgtggttcagccagagcatgacccatggattccagttagagtatggcggccagggctcctaccctgccgatgtggccatacagctgaccttcctgcgcttgatgtccaccgaggccttccagattatgacctaccactgcaagaacagcgaggcctacatggaccagcatactggcaacctcaagaaggccctgctcctccagggctccaacgagatcgagatccgagccgatggcaacagccgtttcacctacaggggaactgtctaaggctgcacgagtcacaccggag

SEQ ID NO: 493116 - DNA, 105 bp, Homo sapiens
aacatgagaaattttgtggcctgataagtcatatttcctcaccctgtgagcttcttcttgggaagtcaacaaagacttttggcagttcctttgggttataaccca

SEQ ID NO: 493117 - DNA, 522 bp, Homo sapiens
tagcgactaccaggagacagtgtctaccaggcaggcatgatcatgaggaggactccgtctcacacaggaaaacagcaataagaagtatgccggctgattagtgtgacaagaataaaacagaatgtccatggaatgtacctgcccggtaaaatgttggatcatttacattcatgtggcagagaatccgacggctattaagagaaagtgaacaaattaagaatttaaaagacaggttcaggcatgtcataagtgaaaacaagaaggcttaatacaaacttgtggggttaggtccgtgtgtgtgtgtgtgtgtgtgtgtataacagagaatatggccagtgctagagttctttctccttctctctctctcttttttttttaaaataactcttggggaaagtgggtaaataagcctgtgccaggtgtacgtgtggtgaaatacccaccactaaagttttaaagtaccatattttctcaatagggccttcttatgtatgaacaagattatgcggggcacttaaaata

SEQ ID NO: 493118 - DNA, 366 bp, Homo sapiens
  misc_feature (45)..(45): n is a, c, g, or t
  misc_feature (66)..(66): n is a, c, g, or t
  misc_feature (107)..(107): n is a, c, g, or t
  misc_feature (360)..(360): n is a, c, g, or t
acaaataatctgggaaatgtgacacctccaaaggaacggaataangcaccagtaaaccaacactanagaaatgaagatctacaaacttcctgaaaaagaatttaaantaattgtcttcaagaagtccagtgagctaaaatagaacacagataggcaattaaatgaaatcaggggaaaaataaacaaaatgataagtttaacaaagagatagaaaccattcaaaaaaaaaaaaaaaaattctggagctgcaaaacacaattacagaactgaaagattcaacagagaacttcaacagcagacttgatcaagcagaaaaaaaaaaatcagcaaactttaagacagatcagttgaaattacccnagtgag

SEQ ID NO: 493119 - DNA, 797 bp, Homo sapiens
  misc_feature (55)..(55): n is a, c, g, or t
  misc_feature (61)..(61): n is a, c, g, or t
  misc_feature (66)..(66): n is a, c, g, or t
  misc_feature (70)..(70): n is a, c, g, or t
  misc_feature (76)..(78): n is a, c, g, or t
  misc_feature (579)..(579): n is a, c, g, or t
cttagttatgacgatccaatagctcttccactgtaaagcatgtagcacagaactnttcaanaggantttncagtannntaacggcagctgctattcaatactcctaagatttcaaagatgatgagctcaaacatggtgcaagaaaatgcaaacgtcacggagaagatcacctgtacaacatactgacgtatctgttaaaagccaaacagagactagaagttatttccttgtttaaaaactgaactgataacctccatctggttacaaggcagaaaacttattttgaggaaattctcaagtcattggaagtagggccacaacagcaacttgcctggagctaaagaaaaagatcaatataggtggcacttctgaatcttgagtaactattaccagcatcctcctgtggatgaagacttctgaggacaagaagatgaagtgacagggtcatagcgtgcacttacaattcctgatgccatactgacaaaaaactgacagattcctacataatggttaatgctcaaaggtgctacttaacactttgctgacactggactccgtgtggaccatccctagggaggntttaacgttctgccagatcgagatgtcacagttgccactttccttcagaccatccacctcctgcgacagttacccgctgaacataccgaaattgacccacatcgcccactttacatcagtactttttgctgagtaggtacactcctttcgaattgcaccgatccgcgtcccacccatcccaaacacgcagtcgtgtacgtataccacctctctctgtt

SEQ ID NO: 493120 - DNA, 474 bp, Homo sapiens
gcttgctctgccagcagtgctgggccggccctgtaaacgtcacctcttgcccccaccagctctctgctctctgaaagctttcttcttgtgcccttaaagtcagcttgccttttgatacaatttggatgtgtgtcccctccaaatctcatgttgaaatgtgactcccaatgttggaggtggagactagtgggaggtgttggatcatgggggcggctcccttgtgaacggcttggtgcccccacttcgtgatgagtgagagctcactctgttagttcactcgggagctggttgtttaaaagagtctggtagccctcctcccctctctcttgctccttctctcaccacatgacacacacgggctctgctttgccttccaccatgagtaggagcttcttgaggcctcaccagaagcaggtgctgccatgcctcctggacagcctgcagaaccatgagccaaataaacctcttttcttt

SEQ ID NO: 493121 - DNA, 379 bp, Homo sapiens
  misc_feature (55)..(55): n is a, c, g, or t
  misc_feature (61)..(61): n is a, c, g, or t
  misc_feature (66)..(66): n is a, c, g, or t
  misc_feature (70)..(70): n is a, c, g, or t
  misc_feature (76)..(78): n is a, c, g, or t
cttagttatgacgatccaatagctcttccactgtaaagcatgtagcacagaactnttcaanaggantttncagtannntaacggcagctgctattcaatactcctaagatttcaaagatgatgagctcaaacatggtgcaagaaaatgcaaacgtcacggagaagatcacctgtacaacatactgacgtatctcatagtctttaaacaattggcgcatgaagaaaagccacccaaatccaaaaaatagtatctgggaggtaatcatgatgctggagtcgatgaggaaactcatggccaagtgtaaggaaggctcctgcctacacttcccactccccgaggccacagcacgctggggccacaggccccctgacacggtct

SEQ ID NO: 493122 - DNA, 172 bp, Homo sapiens
tgagcggtctggtagagcggtctcaactctctagagacttacagcctgcctaaactgaatcaagaagaaatagatcaacttaatagaccaatcattggaaaccaaattgaatatgtcataaaaacactccctacaaataaaagtccaggaccagacggcttcacaagtgaat

SEQ ID NO: 493123 - DNA, 898 bp, Homo sapiens
caggagttgagaccagcctggccagcatggtgaaaccctgtgtctactaaaaatacaaaaaaaagttagctgagtgtggtggtgtgcgcctgtaatcccagctactaaggcaggagaatggcttgaacccaggaggtggaggtcgcagtgagctgagatcgcgccagtgcgctccagcctgggcaacagagtgagactctgtctaaaaaaaaaaaaaaaagaaaagaaaaaaagaaaatttgaagaacaataacttttctacttttgaaataggataatttttcaaaatggtttaacctccgggaaatccagggttattttttataacgggagtggagagataccttttcagaggaaaacaagaggctaattcccaggtaagagctaagtagaattattgttaaccaatttggacaaaaatttcttcatagtggagcaaaaggaactaagtctacataaatctagttttaaatatattagagggcaaatggtctttgataggtatatcctgtataataccctttaatgagatgaatatcccttatattccaaaaaggaaatgtgggtgtcagatatttccagggaaaggtgattgtggagtggggacaaacggttgaaattgttcgttcattgtcttgtgtgcttgtcccaagttgtgagtgtaggcaacaatcgggtggaaggccataatcgtaaaattttgcgctgagaggtgttgagggcctggaaacacaggggttgtgggatgcacgagatataaatgaggaggtgggtgagggttactgaatttgcgtgagtatttaagagctgaaggtacgagtgagatatgtgtggctgtgcattggtatgggagacaaaaatggggtgaagggaattgatgtatgtatatggttttata

SEQ ID NO: 493124 - DNA, 120 bp, Homo sapiens
tggtggacactttaccaggtttaatgatcacctctgctgcatctaccatgtactccactttttcccacaatgagctttacaccttctgcactgggacacatggtcctgcctgtgtcccat

SEQ ID NO: 493125 - DNA, 414 bp, Homo sapiens
cttagttccttctctaaatttcacaaacatgtaaaatgcaaccaggttaagaaacagaactttatctacaaccaactacatcagatgcttgtgtgtccaactccctggcaatcaatacttttgtgctaaacattcccttgtttttccttatacttttagaacctatgtgtgtgcatcccaaactgtataagtttgccttttgaaaactcagcataggccgggcgcggtggctcatgcttgtaatcccagcgctttggaaggccaatgcgagtggatcacttgagcccaggagtctaagaccagcatggccaatgtggtggaaccccatctctactaaaaattagccaggcatggtgttgcatgcctttagtcccagctactgggaggctgaggcaggagaaccaattgaacctg

SEQ ID NO: 493126 - DNA, 341 bp, Homo sapiens
attgcttgagtcaggagttcgagagcagcctgggtaacatggtgaaaccccatctctacaaaaaattttttaaaaagctggggatagtggtgcacgcctgaagtcctagctactctggaggctgaggtgggagaatcgcctgaacccaggaggcggagcttgcaaatgagacgagatcgagccactgcactccatcctgggtgacagactgagaccccttctcaaaaagaaagaaaaacaacaaaatatcactgagctccagccgggacagagtgagaccccttctcaaaaaaaacaaaaacaaaacaacaaaatgccacttgtaactgcagcttgctcag

SEQ ID NO: 493127 - DNA, 282 bp, Homo sapiens
aaaaatggaaagaaaggaaaaaggggtcttttggtttggtccccggccccccggggccaccctttttcccccgccctcccccggggtttttttaaggggggggttttcggaaagccccccccccccttccccgggtggatttgggggaaattacccctgggcccccaaggggttttcgggaatgcccttccttggtttgttttttttttttttaccttggggtcccttttttcctttggggattttttttttccttgttttaaattttttggggccctttta

SEQ ID NO: 493128 - DNA, 394 bp, Homo sapiens
acaacacacttgaggagatacttgaacaatttggattcagccgctaagatgattaatcagcttaactcagtatcaaatcattgaaagtcataatggtacaagctatctctctaacttccaggcccacggctcaggtcaatttgaatacagcatatacagtgtccagtaacacataacattgtatgcatcgacacatggaggaacagtatttcagtgtccttaacactctaaaccccgatcgcatttacagactctgattctacagtgatgattgaattctaaaaatggttatcattagggcttttgatttataaaactttgggtacttatactaaattatggtagttattctgccttccagtttgcttgatatatttgttgatattaagattct

SEQ ID NO: 493129 - DNA, 578 bp, Homo sapiens
  misc_feature (60)..(60): n is a, c, g, or t
  misc_feature (199)..(199): n is a, c, g, or t
  misc_feature (230)..(230): n is a, c, g, or t
  misc_feature (406)..(406): n is a, c, g, or t
gagatggatggaacagaaaataaatctaagatttggatgctgaacggcccattctggggngtgtcccttgaccgtctgcaaagcctggtgccgttgaggaagggggtcccccatgtaccgcgcatcatcgctagagcattggattggcaagctctgaagtcatcctgccagtcccggcggttcaagtggtcattcgaantggcgcggttctcatgctgggaacaagctgngccattgcaaggaagcttcgatgagtcctcccagtcggtgcagcaaacttcagggaagccatgcgcattgtgagcagacggtttttacccaacgaaagcctggaaggaactgtcatcacggagaaatatgggaaagatgccaccaatgtgggggatgaaggcgggtttgctcccanagatcctggagcaataaacgaagggccttggggaaggccttgcgttgaaaagcacctgtggcgtaattcgggggcaaaaggggcttgggacttaacgaacttggatacaggtggtcatcggcatggacgtagctggcctccggagttcttcagagtctggcgaacgtatgga

SEQ ID NO: 493130 - DNA, 365 bp, Homo sapiens
gtcgatctacacgatacccggattctcggtacactgatttccgatccaaaatcattatcttaccttgacttttcacgaatactgaactttctatcattcagaaacatagtggcacagccattgccttgggctccacttaaagggtctgaattttggtcctctggtctcttgccatgtttcccagcccctctagggagaacatatcgtgcagcgtttgacttcctcctgggctttcccgcacgtgcttcaccgtgcatgccctgcgcgtccctcagggcttcaatcctcgattacatttctgagacctccgggtccgcctggaggagaggcccaactgatttgtccctattgcgctctgccttttc

SEQ ID NO: 493131 - DNA, 1224 bp, Homo sapiens
aaacgccgaggaaccctggctgagcgcgggagcagagcatcctggccagaacaagccaacggatgccaagacagagagtggacacactggacaaacaagcagacagaagactgtactggccgctggactccgctgccctcccccatctccccgccatctgcgccctgtgaggatgagcccagacttcagggccatggatgtggagccccgcgccaaaggccgtccttcttggagccctttgtccaccaggtacgtgtggggcacctcatgcgtgctccgctacaatagagacaaacctgtagcaagcccctggtcccaaagggaacatcagtatcctacgagagccatccctgctgaagatgcgcaaaaattcactccccagaacaaaggtgtggtatctgtgcgctttgaaggaagatgaggacaggaaccttgctgtctacaatagcatatccatctgaccaggggacgcactggaactcgcggaccattgtagataactcccagacatgagaagcccagaacgcgtcacgcctcctacacgaggacaaccaaagaaaaaaccatcatgctctcagacacagccgaccacgagcgcgtcacggacctgggcgcgtccagcaccgcacaagagccgaggaccctcgacagagccgtcaagcgacgaagacaagacccagcgcagtggctaaggaacatctgaaggtcatgccacctcaccactgcgagcagaaaagcaacggcggaaatagcgcggtaccgcgacgccacagcaccgccgtacgaaacgcgtgtgggacccgcgcacgcggggcccccccaggcccacgagcgccacacgaggagatgcccgggacgacactgcagaggacaaccggcacaccgcaggtcgcagcctagaggcaccagcggggacagagacggagaagagcgacacgggcaaccgacaagccgccacgagggggtaccgatgcaccgcccagcgcaaaggcggcccccagcgaaaccaaaacaagaggggacgcagacagagagagccagacggagagaacggggccaacacggcccgacgagacgcgccacaaccagcaacacgcgagaccgacaagcagcccgacgccagcaacggaacgaccccaccacagcccacgcggacgacgacgcggaggcacagcaaacagacgcgcaccgcgacgacgccaactcacagaaccccaggcagcc

SEQ ID NO: 493132 - DNA, 107 bp, Homo sapiens
aaccaaaaccaccaccacaccaacaaccaccccaagaaccacgcgtatgtcctatgggcgctgcttctgaccgaagacgagcgcaggagtcgtgagcgaggaagcgg

SEQ ID NO: 493133 - DNA, 103 bp, Homo sapiens
cttaccacaggcacgtacttacctgtagccacgaagtcaccaagccacacgtactaaaggttgaagtcaaagatatgtacagggtataaaacaaataccaagg

SEQ ID NO: 493134 - DNA, 159 bp, Homo sapiens
gcatccgacaactgaatttccatgtcagctggggctctcagccgcccaaggggaggacaacagaggccagctgcggaggaaggctggcaccagccccaaatccaaacccaacctacaggctaatacatgcccctgggacggacccggtcccagcagcac

SEQ ID NO: 493135 - DNA, 197 bp, Homo sapiens
ccataaaagaattgggtgaccacgtgaccaatttgcgcaagttgggggcccccgaatttggtttggcggaatttctttttgaaaagcaccccctgggagacagtgataatgaaagctaacccccgggctattttccccatagccggggggtgatttccctggtcaccaaggcagtgcaggcatgtgggggtttcctt

SEQ ID NO: 493136 - DNA, 210 bp, Homo sapiens
  misc_feature (168)..(169): n is a, c, g, or t
tttcggcacagctttgatcgcagccttgaagaggactcagctaagccctgtccagattcctggcccacagaaactgtgagataatcagtgtaggtggttttaagccactaaatgtgtagtaatttgttatgcagcaatagaaaacacgtggcccggaagtttggggcnnatggagaactatggaaatccagcaaaaggacagtgcaggat

SEQ ID NO: 493137 - DNA, 203 bp, Homo sapiens
  misc_feature (153)..(153): n is a, c, g, or t
cgtcctcaagtgatccgtcatccaattccatctcgttagcatcgtcgtcatcgtcttcatctccctctatcagcttcatcatcctcctgatcatcttccgcagcttcctccgtcctcctcctcttcatcctagactatcatccgtcatcctcngttacttgccactgcgtgtccctcttcctgagatgtgctcactcctcatc

SEQ ID NO: 493138 - DNA, 992 bp, Homo sapiens
  misc_feature (886)..(886): n is a, c, g, or t
  misc_feature (992)..(992): n is a, c, g, or t
agcggagagcggctgcgacacccatgtaggcatgcggacctgtactctgagggagctgcgggggttccgacctgtcgcctggcgctgcatgacctggtagccataggatagccaggaggtaggacaccgctgacgactaggggtttgtgctcatcttgtcgtcagagcttggtcatccagtactccctgtgctcataggaagaagtcccaggctgggttcaatcctccccaggtgtgctgggatttacgttgtgtgaagccgaacactagcctcgagaggaaagatgagattggaatgatagactaagaggatgatcacattaggactacgacctcctcttggcatggagggcaacacaggggagggatgcaataatactcatgagattactgaataggaaacttgagttcaccttaactgaagcagtccatcagatgggctcgggaatacaacctgtgaagtcacagcagtaaggttctcgatccacgtgagtctacaggtcaaaagcctgaggaacgctgctcgagtgtaatactcatgctgggcgagagctgtaacacgctaggaccatcttaggacgagtgtaatcttcgagtatgcgtggtgtgtgcaccagcggatgaggtgtcgagtgtgcgtcaccgttgctagtggcctcgattgaccagtgtctcgaatcgtcccgcaggtgcatcgaggcgcactccctcgccgaccgtcaaaatcctccgcagaaaagtggctcgggggatttgacgcgagaccgttgatgctcacccttgggcgccacaagcaccccagtttccttggctcatccgtttcggcgcaacgggatacgtccatcctagtatcgcgagggccttatgtgccgtttaacgcgaaggntgggggaacgtttgaaagttcgcaccaattcccttgaaagggggccgagaaataaccctaagaattacagttactccgcggaaattgcttcctggccagcaataan

SEQ ID NO: 493139 - DNA, 544 bp, Homo sapiens
gggccgcgggtccgccaccccaagacccgtggaagaaaggccggccccgggtccatccatgaggaaaaaggacgtacacgccgccctgggcgcaacagacattcccccaccacggaacccagcgcgtgggtgcgaaggagaatctcccccattatcgccccacgccctaaaagactctcgcccaccaggatacggccagggtactcgtctacagccatctgatgaaagccgaatatccagaagaggccccagattaagaggtatcttctccatccagactgcccgagtaggagagtagaagaagaaaaagtagagcacccatgtatgttccctgaggtctccacacccttggatccaggagatttattgaaatagaatccctgcaccctaaggaaatgctgaagacttttggacttcgcccgatctgtcccaccttcaggtcactccagcctaccattgggatgaatttccaaaccccccggggacccgtttgaattttttctgtgggggcctgtattattttccataaatctgggacccaccc

SEQ ID NO: 493140 - DNA, 229 bp, Homo sapiens
aaaaaaaaaaaaaagccggaaaaaaaaaaaaaaacccctgaatgcggaagagctcggctcccgtttagccttttggacttaaggaaataaaaaacccccaaagggtttcccctttttttaaaaagtgaagattgctggatactatttattccacttataatttatgttaccccctgatttttgttttttgtcatggcaaagcctttttttaataaagttatgccttcca

SEQ ID NO: 493141 - DNA, 811 bp, Homo sapiens
atctcaatttgaattgtatctcccagaattcccacgtattgtgggagggcaccagagggaggtaattgaatcatgggggccggtctttcccatgctattctcgtggtggtgaataagtctcactagatctgacgggtttatcaggggtttccgcttttgcttcttcctcatttttctcttgccccttgccacgcaagaagtgccttttgcctcccaccataattctgaggcctccccaaccatgtggaactgtaagtccaattaaacctctttttcttcccagtctcaggtatgtctttatcagcagtgtgaaaacggactaatacacatggtaattccatgtttaactttttgaggaacagcccaactgttctccacagtggctgcaccattttacattcctgccagccgctcatgaagcttccaatttttccatatctttgccaagatttattattgtctgtctttttgattgtagcctttctagtgggtgtggagtggtatttcattgtggttttgatttgcatttccctagtaattaacggtattgataatcactttcatgaacttatttgccacttgtatgttttctttggataaatgtcttttccggtcctttgcctattttaaaatggtaccatttgtctttttattgacttatcataatatttatgtattctgggatactaggatccttattatattactttcatctgcaaattatttctctcattctgggttattgtcttttcactttcttgacagtgtcttctaataaccaacagttttaattttcaaacaccccaccact

SEQ ID NO: 493142 - DNA, 344 bp, Homo sapiens
ccaggtccgggtggtgccaaaggcgacaaaacgcctggcggtccgaagccaggtgacggtccgggcctaagtacgcctggcggacaccccaagccgacgcatataggcggcgatgagccccgcgggggccgtcagcaccacccgacctaccagcagcagcatcaccaggggccgtcggccggcgagcccggtggccgcatcgaggagaagatctcggactctgaggggttcaaagccaatttgcctctcttgaggaggcctggagagcttacacacagcgatgtcggctgcatgttgggaatctacctgctgatatcacggaggatgttcggattcggatttat

SEQ ID NO: 493143 - DNA, 297 bp, Homo sapiens
  misc_feature (41)..(41): n is a, c, g, or t
actcggcatgggtcagtatcaggacttatgtgatgcatgantagatctgtcaataaactatcatgaaaccataagaacccctaacaggaggatccaacgtagcctttgttgatcttagtttcttacaattcctcatggaaatacaaggattggctgggcatagtggtgcacgcctgtagtcccgggtacttgggacgctgacgcaggacaattgcttgaactccagaggtggagattgcggtgggccaagatcacgccactgcacgccagcctgggcaacagagcaagactccatct

SEQ ID NO: 493144 - DNA, 884 bp, Homo sapiens
tggtttttaaaattatgttaattaagcatatgtacacttaaaagaaaattggccctctgaacccacccagcaaaaaacatgcacaaccccaaggtatttgtggaagggaggggccccggccccaatttagcagttgggacgatgcaatcctgtgagtcgcaagcacccagtcaggagagagctggcactgaagtgtccagcaggctggattcccctgccgtttggccctaaaataagcgtgcgccatagccaaaggtctgtttaatgccctcaaagtagtacctgttgccagccctgtcgcgtccgctctctcctcaggagcggggatgcctcgaccttccatgccacagctcagtctctccgttcttgtcgactgacggtcacggtgactggtggcaacagtgtccctctggccaagatttaacgcctccatttcttcacagatttgtttctcagggcccagcatcgtaaatcccccagagacgtgccattctaaccttgtggaacttcccacctctgctctgcttctaactgtttgcgcgaagcttggcgtaaagcccttgtaccagcctctgtgggttggttaaccactctatagagctcctctggctgacgtccgaggaggtctccttaagagtgctttacaggtggggtatttgactcccacaggtctgcccggtttcgaaggagcaggttactgggcgcccccagttcggtgcggtgtccccggtttctgaccccttctgtggaaaatgcccggtccctgtcgggcggttatccctgttttcaagttcccttctcttaggcagattgtcggcttgggccatcttctccgttttaacgagtccttttcctcacgcttgctccgtaaccctggccattct

SEQ ID NO: 493145 - DNA, 552 bp, Homo sapiens
  misc_feature (4)..(4): n is a, c, g, or t
  misc_feature (6)..(6): n is a, c, g, or t
  misc_feature (11)..(11): n is a, c, g, or t
  misc_feature (38)..(38): n is a, c, g, or t
  misc_feature (48)..(48): n is a, c, g, or t
  misc_feature (51)..(51): n is a, c, g, or t
  misc_feature (69)..(69): n is a, c, g, or t
  misc_feature (75)..(75): n is a, c, g, or t
  misc_feature (89)..(89): n is a, c, g, or t
  misc_feature (95)..(96): n is a, c, g, or t
  misc_feature (100)..(100): n is a, c, g, or t
  misc_feature (102)..(102): n is a, c, g, or t
  misc_feature (107)..(107): n is a, c, g, or t
  misc_feature (109)..(110): n is a, c, g, or t
  misc_feature (124)..(124): n is a, c, g, or t
  misc_feature (131)..(131): n is a, c, g, or t
  misc_feature (135)..(135): n is a, c, g, or t
  misc_feature (137)..(137): n is a, c, g, or t
  misc_feature (142)..(142): n is a, c, g, or t
  misc_feature (148)..(148): n is a, c, g, or t
  misc_feature (163)..(163): n is a, c, g, or t
  misc_feature (170)..(170): n is a, c, g, or t
  misc_feature (178)..(178): n is a, c, g, or t
  misc_feature (180)..(180): n is a, c, g, or t
  misc_feature (182)..(182): n is a, c, g, or t
  misc_feature (185)..(185): n is a, c, g, or t
  misc_feature (195)..(195): n is a, c, g, or t
  misc_feature (200)..(200): n is a, c, g, or t
  misc_feature (211)..(211): n is a, c, g, or t
  misc_feature (224)..(224): n is a, c, g, or t
  misc_feature (227)..(227): n is a, c, g, or t
  misc_feature (232)..(233): n is a, c, g, or t
  misc_feature (237)..(237): n is a, c, g, or t
  misc_feature (242)..(243): n is a, c, g, or t
  misc_feature (245)..(245): n is a, c, g, or t
  misc_feature (251)..(251): n is a, c, g, or t
  misc_feature (254)..(255): n is a, c, g, or t
  misc_feature (257)..(257): n is a, c, g, or t
  misc_feature (261)..(262): n is a, c, g, or t
  misc_feature (264)..(264): n is a, c, g, or t
  misc_feature (266)..(266): n is a, c, g, or t
  misc_feature (277)..(277): n is a, c, g, or t
  misc_feature (300)..(300): n is a, c, g, or t
  misc_feature (317)..(317): n is a, c, g, or t
  misc_feature (320)..(320): n is a, c, g, or t
  misc_feature (329)..(329): n is a, c, g, or t
  misc_feature (332)..(332): n is a, c, g, or t
  misc_feature (336)..(336): n is a, c, g, or t
  misc_feature (338)..(338): n is a, c, g, or t
  misc_feature (357)..(357): n is a, c, g, or t
  misc_feature (364)..(364): n is a, c, g, or t
  misc_feature (371)..(371): n is a, c, g, or t
  misc_feature (386)..(386): n is a, c, g, or t
  misc_feature (389)..(389): n is a, c, g, or t
  misc_feature (417)..(417): n is a, c, g, or t
  misc_feature (422)..(422): n is a, c, g, or t
  misc_feature (437)..(437): n is a, c, g, or t
  misc_feature (483)..(483): n is a, c, g, or t
  misc_feature (486)..(486): n is a, c, g, or t
  misc_feature (514)..(514): n is a, c, g, or t
tggntnttaangggctgacctttattaactttaatatntcatctgccnggncctgggggaagggacttngatctntgggcattgggggnccttgnngggngnggggngnntcagagtgcccagngttcagngggntnggggngaagtntgggttccacgcctngggggtnttactccngngnganggggacagcngaggnggagagggagngcaggggggtagngcngcggnncccnctggnngnactctnggnntngggnntngngtgggggccgnggcggcaagtggaaggggggggnggggttcaacttgaccncgngcggaaacnggntttngngggggacaaagagcggggngaacttnaaggggnaaagcccgaagagtngcnggggttcgttctccttgggagggccggncagangcaatagggccgggngccccagggctgggctggggggtgccacccccatggggacctcgtnggnaacttctcccaaccgagttaacgggggncagagggcagaggtgggggcagggtagaggtgggggca

SEQ ID NO: 493146 - DNA, 170 bp, Homo sapiens
agccggtatagaggatccctgcgtactgggcgtatgtcttttttcctaaatcacaacaaaactaactaatactaacatctcagacgctcaggaaatagaaaccgtctgagatgttagtattcgttagtattgtggtgagtgtcaggacaagggcatacaggactaggaag

SEQ ID NO: 493147 - DNA, 101 bp, Homo sapiens
agtcggtacctacttttccacagtggtagagaggtatattgttaaattgcgattttggttgtttccccagacattaggctaagctagggagaagagggtct

SEQ ID NO: 493148 - DNA, 699 bp, Homo sapiens
gaaggaacccgagcctgggctgcacgcgtgtccaaccggtttcctgtcgcggagcttctccgggtcccgtattcctcgttcgaacgccctctcgtgcgcccgtcgtgtcccgtgtgtccctccggagacgcctgagccgcccgcgcacacctgaagctggcgggcctatggcgcctgctctcgatcctcagctcgtcctccccgaccccgtcacccggcacttcatgtcttggagcgggccccgtagcagtcgcagcagggcgcggctgtcggcgcgatcgatggaggctctccaggtcgtcccgggatattgctgctgcagttcctggacaggatgttctccaagttcacgctccatcctgcaacaagccggtggaggcgcttggaccttctcttcctttacaagaagatcccgtatatcacgtggaaggcaattacccattagctacatagagacttcagatgataaagccccagtgaccgatacaaatattccatcgcatctggaacagagtgttagatatactggttcaagaagaacaatgaacgggaatctggagagacagggccatgtatggaatatttgcttcatcacaagatcttggaaacattatagtaccttggggaaagctgagtgtaagttcctgattcacaccatgttcttgggcattagtacatgcattaatgtcttacgaataa

SEQ ID NO: 493149 - DNA, 545 bp, Homo sapiens
cttccttatagttaaataaataaaaatattcatcctcttaattttatagccacctctttataaaaaactaacttttttacaatcattctttaaataattttaaaaatctaccaaattctataattacacaaaattatgccaaaccccctttttataaaaactccttttatatatacctacatctccgattcaaatacaatgcccccctctccacataaaaaaacatattctttactaaactcctaaattgaaccacccttgtcctatttctttcatatctataaaacactatcccactcccatttttctgaggcccctttacattttgtttgcctcaaccaccaccaataaactcccttaaatcttacaccaaaataacatctctttaattattaaaaaataaaatattttttattattactttatcgtacttcttcactattataactaacaccctttcatataaatactaaacctctcttaactctcctataaattctcattaactttcgtggcgaaaaatctaaaataaaatttaattatcc

SEQ ID NO: 493150 - DNA, 1030 bp, Homo sapiens
ctggggagcgccagaaggggagagccaccagagatacctgaggaacaaggagttgtccttcttggaggttaagtttgtccacatctccgtttccaagacctttgacagcgtgcccgttgttaaagtctcttgattttcagcagccactgtcaagcagtgagtggctactcagaccaggttgtccatcagcggagatcagctacctcctcgctgcgtcgctgcctgctcactgagctgccatctttttctgtgtgtggccagtccacgagttaccgcagtgccatcggattcttactgcacatgacccgaagtgcagaatatgaaacggcgagtactgacacggacaggagggagtctggcagccaagcagtgtctgttgaatggggcccctgaactggctgcagactggctaaatagacgatcacagttcttcccagagccagctggaggtctgtggcagcatccgacgctcagaactggctggtactacatccaggattccaggacaaggagagcctacatcactgacagatggaacgctgtctgcccttgatgtcctgctgactcggactccagtctcacagggcatacgggtaccctatctactaccagatgcaccacggacgcatcgaccaactggaaggactccatggaaaacaggaagacatacccacctcgcggctggcacgcgcaccactcaccaatccgcgcagaacaacgcccaccaccatggatagccgaagacccacacaaccggcaccgcacactctcggaacaacccagtgccatcccgccaacacccaaccaccgccacggcaccacggggccaccaccagcccccaccgccctcgcaaagcaaaccagcgcgcactacacacacactgggcctgccgcaccgcgaccgcccccccaccgtgaggcaaccaccgcaggccacaagccacaacgcgacaacgcgccaaggggaccacaacaaagcaggcaaacgaagacccccgccaacacacacaaacagaccacgcagactacc

SEQ ID NO: 493151 - DNA, 232 bp, Homo sapiens
gagactggttaaatggctgtgacaagaaatgctgacaaaaaacatggacagtgaaggccaggctgagggggcctcagataaaaataagaagctttctggaaaatgtctctcttttggatatggaaagcttacacaatgcctgtaccatcattgtaccttagacgcagtgaacttgctttttatttcagagacttgtaggcaaaagagaatgtagccttgacccagaaaaaaa

SEQ ID NO: 493152 - DNA, 647 bp, Homo sapiens
aaaaaagaatcccatgaaatacggtgtttcacttttcaagttccaaggaaccatggtgaatatggtttccccttccaagtaacccttgtgaatgtggttatacacctccagcctgggtgacagaacaagactctgtctctaaataaataagtaaattcagtttggaccaatgaagaaggtaatatgtaaatatggaatattgggaaaaattgaccacgttatttggagttaatgttaaggaatcaagggaaacattgaactaattggacttagactcatctctgctatgactatcattctactttagatccctaatgccaggcaaatagtccctccttattaagaataaatgtactggctgggcatggtggttcatacttataatcccagcactttgggaggctgaactgggaggatcacctgaggccaggagtttgagactagccctggcaacatagcaagaccctgtctctacaaaaaaatttttaaaaaattagctgggtatggggtatgcacctatagtcccagctactcaaagactgaagcgagaggatcacttgagcccaggagttcaaggctgcagtgagctatgattgcactaccgcacaccagcctgggtgagggggtgagacctggactcaagggga

SEQ ID NO: 493153 - DNA, 870 bp, Homo sapiens
cttcatcgacaaggtgcggttcctggagtcagcagaacaaggttctggacacctagagtggaccctgctgcagtgagcagtggaccaagactgtgaggcagaacctggagccgtggttcgagcagtacatcaacataccctcaggaggcatgctgtgacagcatcgatgggggaacggtggccgcctggagtcagagctgagaaacatgcaggacctggtggaatgacttcaagaacaagtatgaggatgaaatcaacaagcgtaccactggctgagtaatgagttagtgatggctgaagaaggatgtagatgctgtcatagatgaacaaggtggagctaggaggccaaggttgatgcactgatggatgagattaacttcatgaagatgttctttgatgcggagttgtcccagatgcacgacgtggtgtctgctgagacctcagttggtcctctcgcagtgggacaatgagaccgtgaatctggacctggataggcgatcatcgctgaaggtcgaggcccagtatgacggagattggcaaactggagccgggcatgaagccgtagtcctgggtatctagaccaatgtatgaggagcttgcagtcaagacagctggccggcatggtggatgtacctcacggcaagtaggtcaaggcatgagatctgctgaagattgaaccggatgatccagaaggctgagaagccgagaattgactagtgtcaagaagacgagtggctgcctaatcgtgcagaaacgccattaggggaatgccgagcatgcgtggggaagctaggcctcaaggggattgccagggaaacacgctgggtcgaagctggaggaggcctgaggaaggccaaagcaggaccatgg

SEQ ID NO: 493154 - DNA, 160 bp, Homo sapiens
agctcgccgaacggcagggcgcacggaggaagggctgtgaggtactgggtgcagggaactgagtgtttagcggcatcccccggtagtcgatccaagccccttcctcctcctcctcctcctcttccgccccggaaagttagcgaacctccggcagcggccg

SEQ ID NO: 493155 - DNA, 111 bp, Homo sapiens
tcaccgagaggcgttagtaatggggttggtggggtttgcttctaagccttctcctatttatgggggtttagtattgatgttagcggtgtggtcgggtgtgttattattctg

SEQ ID NO: 493156 - DNA, 794 bp, Homo sapiens
agcgggggaaccggggataggcccgatagcgcgaacgaaactcgggcatgggcatgcccacagtccctgtaagactctcgtgtagtgctcctggctcggcgtactcttgcctcgtgctgacaagacgccagcacgcccagagagcttcagcagctgcacactgcaaggaggcaaaaagcccttcgcaatgctacattactctctgcacagacggccgtgtatgtaggactctactcttgcaactggatgttcccagtttctctatatgtaacctgtgagttctccttcacgttgacatactctcagcgaggagacctcgtgtctgcggtacaacgtgagcaacagcaaacgtcactctcgaaactacgctgaaacacaaaagcgcaggaagggcggaccgggaaggcgcgagaccggcaagagaggggagaagggcccggggaacgacgcatcgggaccaagatgcggggcccgggtgcgagcagctgaacctctcgggccccaggcagtggtgacctgggtggcgacgctcgtggaggccgaggagcttctggaccggcgcttcgggggaccaagtggagaggctgctggagtagtcgctgagtcctcccttagttcttcgcgccggctcgcccacgggtccagggtcccagacgcacttgcagtctccgcagcaccgagcggggctccacgaatcgcgaactccagactccagctcaagggcagggagcgcggctgggtctctggaaagccatttttacatcactggctctgatgcccatgtgaggtcggag

SEQ ID NO: 493157 - DNA, 978 bp, Homo sapiens
  misc_feature (127)..(127): n is a, c, g, or t
gaatgcgtcactaacctcgtactcttagcttgttggggacgtgtaaccgggaaaccggtgtctgatcctgatcggacttcgcgcgtcctaatcgccgtagaccacgtatgcagtgaggtgcgaatcntccactccatccgttgtgtgaccagtgactggatgctccaagagttggcggtcgaaatgccatgcatggagaggcttcatagctgtacttggtaacatcgagcatcactgcgccggtatggaccagggaatgccatatgtgacaataggacccatcggggggcagtgcagaatgatctcactttacaacacacttacttcagatgtagacaggcgcgcgtggacaatgcactgtgaacccctgggacgtgttgattctcgtagagcattgcgaagcaccactagtcactctgagtgtaagcttctgcacgtggacacctgaccgaccaagcgtgcttccacccactgagacagtctgcatcaacaggtcaagagaaggatgtctgccaagtaggagctatgactccgagggacagctagcacacattggccaagggagatcatctgaccttgctgttggaaccagaaattcgcaagctggtctgaccagtgcaccggtcttcagggcgttcgtagagtttaccacagctgtggtgcgcgggaactggttctggggttcaccgtcccgtgctcatggacacgtcctctcagttgattatggccagaagtccaaagctggagtgctccatttacccaagacccagggtttccacaagctagtaggtggaggcacctactgaagtccgattcgctcagcaacaaaagccaagccatgggagcatgcctgattgggtgccttccaggggtagaacgcaaggagggccactctatggaaggtctggtcgagaaacctcgatatcggagcggccaagcttaactaaccttaccggcttattagccgaagggtctcca

SEQ ID NO: 493158 - DNA, 433 bp, Homo sapiens
gtgcagtgagcgagatcgcgccactgcactccagtctggcatagagtgagactctgtcagaaaaaaaaaaaaaaaaaaaatgggggttgtgttctgaccaaccaacatttttattaatttggttcctttttttttccaatttcttttgggtaacatcttttcaaaacaagattccttaaaaagaatcagacagagaaagggagaaagaaaatcgggttcaaagaaattatgctattcagttagaatagctccatttttatgatggtaaaattaattttacatggtggtcctcctttatacaagagatattccaacaacagtttcctcaaaggtagtcccgggttaacccgggacctcttttggagaccaatgtagtccatctgataaataagatgagaagtcctggctgtcctgcatcagggtccaccggtca

SEQ ID NO: 493159 - DNA, 223 bp, Homo sapiens
gactctacaggatccccatttccgatttgtttttcaccaaaatgcgagttgtggtttaaacattcgattcagtacttgatacggctgtggtacatatatctgaaaatggtatatcgcatttacaatttcacattgttagtgatagacgcaacatctaatactgtattaaatggtcaagtcacactatcccattctaggcgatgttatattagttccacgacaa

SEQ ID NO: 493160 - DNA, 404 bp, Homo sapiens
  misc_feature (101)..(101): n is a, c, g, or t
  misc_feature (172)..(172): n is a, c, g, or t
taagaatatggcaaaatataccttgccccgggccttaataaaggggaacaacaaagcctaagatgaccagcaccacctgttaatgggcatggatttaattngaatattttgaggcccactggtgagaccctcttgcctcacaaaaaaagatttccttttaaaatatcactgnccattgacaatgaaccctagacacctgagagctctgatggaaatgtacaaggagattaatgttttcatacctgccaacacagcatctgttctgcagcctgtggatcaagaagtcatttcaacttatgagtcttattatttaagaaatatatttagttatttagtaaagctatagctgacatactttcttgagatggaatctactcctggtgaagatgctgtgaacatttgaa

SEQ ID NO: 493161 - DNA, 187 bp, Homo sapiens
caaaggacgagatgaccgcatagaaaagcgagaagagatccgagaagataggaattcaagagatggacatgatgaaagataatcaaagaagcgctatagaaatgaagggagttccagccctagacagtccccgaagcgtcggcgtgaacattctgcggacagtgatgcctacaacagtggagatgat

SEQ ID NO: 493162 - DNA, 693 bp, Homo sapiens
ggcactgcagagcaaccactttgaactgatgcctgcgcactgagtgccacgcaggggctggtgctctgtgagtggcaatggccactggagcgggcagactatgtggcactggccattgtggacgggcacctgcaactgagctacaacctggtgctcccagcccgtggtgcttgcgttccacctgtgcccgtcaacaccaacctgctggttgcgtggtctgtggcacatatgtggatgcatgatgggaaggttccctgcaggtgggcaatgatgtgcccctgtgacctggctcctccccgctgggctgccacgcagtctggacactgatggagccctgtggcttggggggcctgcctggagcttgccctgtgggcccagcatcttgccaatggcctacggcacagggcttttgtgggctgcttgcggggacgtggtgggtggggcgggcacccgctgcacctgctggaggacgccgtcagcaagccaagagcttgcgggcctgcccaaccccatgagcttggcaaccagtaggccccgtgcccgcgtgtaatcttatccccgtatctgtgtacaacttgtcggcttttctgatctgagtttccttgccgtgagtgtcggccgggaggcacttcttggcctggcttccttccgtccaggcagccgtgcttgagacagacctattgctgcgggatg

SEQ ID NO: 493163 - DNA, 340 bp, Homo sapiens
aaccaatagtctcaaagtaaaacaccacacatcacaaaggatacgtctgcatctttctacttactatttctaaacacttgtggagcatcagcagtttgctcagttgatttatctttttgcctttgctgtcacatcataaccagctttacatccatttagaatctgcacaattaagagagctgattagcataggcaatgctgcaactccatatgtcatatcgttttctgacaatgagggctatatgacagcaccattgtggaactagtggatgagttgctcatccctatgctgcaggagcagtggcatagcacattggagtccttggctgaggattccctt

SEQ ID NO: 493164 - DNA, 772 bp, Homo sapiens
gtcaccctattagttttttccttgcagcatttcacttgcttcttgcttttttaaaacaaaaatttatgcactaccctccctgcatccatgttcctgctgcctcatattcattcattcttcagtctggtggcaatcagcattcagtttctctccataaaactgttattagacatccaaaacagaaaaaaatgaatactaagaaatacaaaactactgttgttcggccgcacgcacggggcccctcagaaaaaagctattgtggtacgagcaatgtaggttgggcggccgcgcgcgggcccccttaaaggactactggaggacacagtgggtcaatccctggtgtgtccccaagaaggagaaaaaccggcggactccaagcaatagacggtgcatgagtctttgcccgcacccaagcgaaaaagaatactcgccccggaggggcgaaaacccaggacggcggtcgctcgagcacgcgaattccccagcgaaggcacagactcccagagcggcgccaacacaggggtgactaccctaaacacccagtggggggatctcgcacaagagagcagacccacagggaccctcaaagagagtgataaaacaccccgtaggcgcgtcggggcggataccagcggaaaggcatcgaaacgtgacaggaactccatgggcggacaccaagagtgtgggtagggaagaacccaagggaaaagacagggaggcaagacggacacaccgtgcgcacaggagaaaacctagagacaagatcaaagtg

SEQ ID NO: 493165 - DNA, 533 bp, Homo sapiens
catgcgtagtcgatctaaggatccccctcaggatacctcaacctccagttgggttaccttctgctccatataagtagtctgtgttatctcctcatagtccttctctcatgcgtacagtcaagttatctctcttctgcttgagatagggtactcgttgtcgaagttcttctgttccaagtactgataagtttgctattggtcctgtcaatgctcgcatgctctaatccaggcatatctcctggcctatgtagtgggagggaggaagtttcagacctctgcactttacttgccgacggttctatggactgagtagcataatgcattttagcttctgagggtgggtgtagcaatgatgttcaccatcgccttgggaatcatgcattatagcagcattcagtgaaatggcactgtgtggtcttctgtgtgagcgctctgatagctgtggaggcctcttccttgcttcttcctggtcatattcctcttgggatatcctaggaaataccctcaggatgacatctcttcgagttcaggtc

SEQ ID NO: 493166 - DNA, 934 bp, Homo sapiens
  misc_feature (383)..(383): n is a, c, g, or t
ttttggctggtcagcggcagtcgtaggtgcctagcaccgttggacgctcgccggtcgacatcctggagtggcatggaagagtccaggttctgtgggacagctgagagtagcagtggctggtgtacttgaaaactaaactattaaccgaacacggtataatgcatatgtttgctgaacctcatcttacgacacacgacgagataaattggacctagattgtggcattatgcttaaacatgaggacctatgcaacctgcgtttgccctatacatccgccagtgatcctgggcctctgtggaaggttgaacaacggcgtggttctaagactccctagagatgccatttgtcgattcgtgcacggattcactcatggtcctcggatnggactagtccttccatgtgagcttgggttgtcgacgctacccaggagtattatcgcgtctccgtaaatcacgctgtgagcgcttggcttggaaacctcgttacttgtggactcctctctttttgtgtacctcttctctgatgaacttcacgaatggctttcctacgcctttgcgcttgggggaagcaccactgagcggctctcttgaagttatgttcccacgcctgtcatacttcggagacctgtgtagtgcaatccagtacaggatcaatgcccttggttctcgatatacaatcttgtgcgcttgagtagttcctaagcacaagaaacactttactacaaagatgaaagaacagtgacgttgtgtagatcggccacacatagtgtgcaatgcaaattttccaggggtagatggaatggcgacccctggttgtggaagcaaacgaaaatttaacacaggttgcaagacaaatctcttacctcgtgtgaaagttgccaaggaggtaagaagtgtggcgaatacaaagcattggttcaaggaatttgctggca

SEQ ID NO: 493167 - DNA, 282 bp, Homo sapiens
  misc_feature (25)..(25): n is a, c, g, or t
  misc_feature (52)..(53): n is a, c, g, or t
  misc_feature (100)..(100): n is a, c, g, or t
  misc_feature (211)..(211): n is a, c, g, or t
  misc_feature (214)..(214): n is a, c, g, or t
  misc_feature (222)..(222): n is a, c, g, or t
  misc_feature (267)..(267): n is a, c, g, or t
caataactatattaccatacaatanaaatactccatgaatagtttcccaagnnctggagcgaccacatagggaggaaatgtaaatgtctcaatttttgtncacaaaagtatattttatcaaattgctgtaagctgtggatagcttaaaaggaaaaaagtttcctgaaatctgggaaacaagacatttaaagaatcagcaaaatttcaaatnaanaattatgnaaatattatcctcactagttcatttagtcccatgaaattaattantttctctgcttgatc

SEQ ID NO: 493168 - DNA, 142 bp, Homo sapiens
aggacagagcacgcgacagaacccaaacaaatacatcccttatggcagaccatggcaatagagaaggagaggctggaatgacacttacttacgacccaactacagtctgctatacagaacggcttttatccttcaccatact

SEQ ID NO: 493169 - DNA, 182 bp, Homo sapiens
agctcggccctatttacgcctaggagaagataacacgtctttattttgacacagatgccaggatttccctctaaagggtttaccagatcatattctcatgaattgtatatgaatacattggatactatcaatttcagtcttaaattatttcctactgttgttatcatttgcatgcgttcctc

SEQ ID NO: 493170 - DNA, 551 bp, Homo sapiens
gacgctctctctgtgggtacagcgagaggacgagcagaagcagggtggggcatcacctcacccgggaagcacaaggggtcggggaactccctcccctagccaaaggaagtcataagtggactgtgccatgacggaacagtgcattccagcccagataccatgcttttcccatggtcttcacaacctgcagtccaggagattccctcgggtgcctacaccaccagggccctgggtttcaagcacaaaacgggggggccatatgggcagacaccaagctagctgcaggagcttttttccatatcccagtggcacctggaatgccagcaagacagaaccgttcactctcctggaaagggggctgaagcaagggagccaagtggtctagctcagtggatcccacccccatggagccgttcaagctaagatccactggcttgaaattctcgcttgcagcacagcagcctgaagtctgaccggggacgcttcagcttggcatcttgcattactgaggcttgcataggtggttttccccccacagagagagcgcgggt

SEQ ID NO: 493171 - DNA, 466 bp, Homo sapiens
  misc_feature (15)..(15): n is a, c, g, or t
ccctaggaaggaatnccttcaaaaccctttaaggccttggggtaatttaataaattctggaggaaaacctttggggaatagtgagtaaaaagtaaattcagatgatgaattctgattgaaggcccggaaactggagaaataagacttccatttaagggatggacatcagtccacatgaacttgtacagaagggatgttttgaggctgggtgtggtggcttatacctgtaattccaacactttggaaagccaaggcaggaggattgcttgagcctaggagtttgagaccagcctgggcaacataatgagacgtcgtctctacaaaaaaaatttaaaaattagcattggtggtgtgcccttgtagcccagctacttgggaggctgaggtgggagtatcacttgagcccaggaggtcgaggctgtttgtgctactgtactccagcctaggcaacagagcaagaccctaa

SEQ ID NO: 493172 - DNA, 1218 bp, Homo sapiens
tttccaccttgttcttaaggtcccctgtttatatttcttctatgtgggttaccttgtcacacgtccagtagttgggggagactaatgctgctcgtgttcctcatgtccccagatgtctgtcccgtcgctttccgtgagtgtgtgggtgtcacactggtccgacacgaggatttgttgccgcgctggtcctcggtgggacacctgcgagtgtagagaggtggttttttgtcgccttttataagggggtagagcaatgacgttgttcctggcttgcattttgatttttccccaacagtgtgaacattgtcgcaacgggacgctgttgatatttttgttacgccaaagccagaccaatggggcaccactcgggggggggacacaattcgtcactctctaatattggggaaataaagaggtttcgaatgatgtgtgagaaccttgtgtgtttcctccctagcagctagtcggggggacccccgggtgttaatatattcccactgtggactcacatcactttctgtgcccccccacaacacacccccactggggctgtctgcacctgtgttttctctcgagcacttgtgccacaagaacacggattgggctttgggagttgcgcacaacccactttgttgtgtgttttggaagagggtgcacccgcggaaggcctatagaattttctttggccggcacaatttttgaaggggcccacgggcacactcaaaggatccggtaaagctccaaagcacgaataggtgggattctttctcccgccttctttggggaattaacgttgtggaaggtcggcaccttttcttctgctgttctccccttcccctgtttggaacccgtgcaatattcccggaaaggaatctttccacagcctcacagaaggagaggcacagcacccgagagggtgtccctgtttgaaccacacgccgcacatttgggaataatgtgcccttcctcacagggtcttgcttggaacacgctccttttcacaggcaccagccctggaactaatttccacggcaccacagctgtgggccccaggaagcccagctcacaggtgctccccctccacaccacatgggcacaggctgtgccaaaaagccacctggcttttttcagcactttgctgtctggcggcctctcactgggactacccctgtggcttttacgggttttttttgcgttaaagttaaccctaggtttctt

SEQ ID NO: 493173 - DNA, 379 bp, Homo sapiens
  misc_feature (179)..(180): n is a, c, g, or t
  misc_feature (233)..(233): n is a, c, g, or t
  misc_feature (379)..(379): n is a, c, g, or t
cggttctcagcgtgaatgatgcaggagtcctgagggtacggtactatacccatgcactggcagctacctcatctcatcaagtacggcgtgccctaccacattgtgtggcagccctcttcaaggccaaagtcacaggcccccgtctcgtcagcaaccacatgcctccacgacgacatcanntcagtgttctgtagactctctgaccaaggccaccttgtgccccccatgcatgnggccccgggtccctgtgcctgctgacgccagctaggtggtggccaagggcctggggctgagcaaggcctacgtaggccagaagagcagcttcacagtagactgcagcaaagcaggcaacaacatgctgctggagggggccgcgcgn

SEQ ID NO: 493174 - DNA, 711 bp, Homo sapiens
  misc_feature (671)..(671): n is a, c, g, or t
acatagacattatggtaatgataaacgttatatcaacgtaatgtatataacatccagagtcataagtgaacgtaggttacaacagatggaagttgtcagtgtatagttgatcatatgtatgttgtggacaaacagaattttgagaaaagcttaaggtcaggcagtgctagagagtttctgtatggcaggcaagaattcttccttttgaacaagaccgaaaaacctcaggacaaagagaaagtatatcttttaaaaactgatttcatagtaatgtttctacatattttgaagcacctttatgtatttagagcatatcaaattaattcatttctttccctgttaataaaaaaggtacattcacagaatcagtgtacttagaataaaaaataaacagaggaaataagaactaactcgagttaataacaacatctttaaggacaagtttggtcatttaaaaactaagtctagtatagttttgctagtttttaattactcctttcatacttaatatttcaaatatagctgcttcagcaggacagcttttcagtatcacagtaagtacagcccaatacaggatcatccaaaaacacgttgacacttccaagacactggcacggggtccacggagttttgcgcgtaaaatttaaaaaaccttctacggtgatgtttangcccggagcatcattctcacctgtatcatccggatcctcg

SEQ ID NO: 493175 - DNA, 436 bp, Homo sapiens
ggtactgcgctagcggcattagtgaacggattcggcgttaccatgagcgtggtggaggtcacagatgcggctcagatctggcgttgctgtggttgtggtgtaggctgacagctgtagctctgattcaatccctagcctgggaacttccatatacaatgggtgtgcacctccccccgcaccccccgccgaaaaaaaagatggggtagagggagacagtgagatgtggggtgaatccagggcctatggtgaacatgcattctgaactccagggcaggaaagggaccctggggtctcaggccgcccaccatgccctcctcagttgggtcttgggaacattccatgtagaaaaagggtcatgtgtctcatgtgaactccatgctcttgggatcacaccccatactctgcgagtaccctcgttcacttaatgccgctagcg

SEQ ID NO: 493176 - DNA, 476 bp, Homo sapiens
cgttcttcctcccccttcgtaggagctggagctatttctgagctacgtagtgcgtgagagaaatgcagagcaaagcggcagtccccggacaggcatgggctctgaccaggaggacagcaagcccatacacgctgagacacgacctgaattccagtgagagctttgtcacctcctggcgtgtacatgtgtcactagagctcatccaagtgtccctggacaccctgaggtgactaggaacagtgacccaacttactccctgggggaagctgcaggggcaccttgggcatacgacactgaaccacagccaagcacatggcctcagcaagaacgctgcccagacacctcctaccagagggagcaagctggcataaactcgggcatcgatggagtgcaagactgttggacacgagcccttggcggcgatatactacacttctgcacagctcgccacacgagtagcagcccgcaacttggac

SEQ ID NO: 493177 - DNA, 136 bp, Homo sapiens
cgaccgttacgctgaagaaacaggcaggaactgcttcgctcttgggtactcccagatatatctgcaacacggtggataggcacttccttctagctatgcaatccctatgccattcttaactagctctggtcctctg

SEQ ID NO: 493178 - DNA, 279 bp, Homo sapiens
tttttttagacacagggtctcactcttgctcaggctgagggtagtgatacaatcatggcttcctgcagcctcgaatttctgggctgaaacaatcttcctgccttagcctcctgagtagctgggactacagacctaccccaccaagcccagctaatttttaaaactttttgttgagatgggggtctcactctctcacccaggctggagtgcagagacacaatcatagctcactgcagtcttgaagtcctgagctcaagcgatcctcctgccgtcgacgcg

SEQ ID NO: 493179 - DNA, 663 bp, Homo sapiens
  misc_feature (107)..(107): n is a, c, g, or t
  misc_feature (114)..(114): n is a, c, g, or t
  misc_feature (118)..(118): n is a, c, g, or t
  misc_feature (125)..(126): n is a, c, g, or t
  misc_feature (135)..(135): n is a, c, g, or t
  misc_feature (143)..(143): n is a, c, g, or t
tcaagcaaaatgggctagctcggaagctgccgaggggcggaggagttgccgaagcaagtccggaagctaccgagcgagtccggaagatgccgaaagggagcagcggngaagagnaggnggatacnncgcaagacncgggagangggatccaaaaacgtgtgatacaggaaggccgaggagagctcccggactttcaagatgggaccaaggccacgttccactaccgggacgctgcacagtgacgacggagggcaccgtgctggactgacgagccgggctcgtggcaagctccatggatgctcatcgacttggcaagaagtgtcaacgcgtgccgtgtgtgggagaccatcgtgtgcaccatgcgagaacggggagattgcccagattcctctgtgacatcaaagtcagtgtggtcctgtacccgattggtggtcaagagtctccgtaagatcgcggtgggcaaggaccccctggagggccagcggacttgctgtcggtgttgcacagatgcggtgaacacgagctccctgggccatgctagacctggacgccctgcagcagaagccccagaacccatcatctatccacatggagatgctgaaggtggagagccctggcatcgtacgcatcaggacccatgggccattgacagacgaaggagaa

SEQ ID NO: 493180 - DNA, 274 bp, Homo sapiens
  misc_feature (53)..(53): n is a, c, g, or t
  misc_feature (255)..(256): n is a, c, g, or t
ctggtacttctcttcatctctccttagacattaacactatctcaccagaaccntcctaggcgacccagacaatataccctgccaacccttaaaaccctccccaatcaagcccgaagattttccatcgctaaaattctccgatccgtccctaacaagctaggaggcgtcctgcctattactattcccaattcctcatcctagcaataatccccctcctccatatatcgaaacaacaagagcataactatttcggcnnccactaaaggccaatcac

SEQ ID NO: 493181 - DNA, 172 bp, Homo sapiens
ggactcttacatactcaattcccatcctataaagcactcatacttaatgcatcccgcagctacacacacacaacacacagcacacgcattaacacagcacacacacgagcacaggagatacacaaacgcacagcatacacagcacacagatgagcacccgtcgtgcgaatcg

SEQ ID NO: 493182 - DNA, 167 bp, Homo sapiens
attcatcagcggcatgatgtgcgtgatactgaggaagctcaaatagagttccggagctgggttgattgtgttccagtacagaatccacattcagatatgccattttgtatttaatcattattttttgagttttttgtggcaaagagtattgtttcctttaaaagcca

SEQ ID NO: 493183 - DNA, 287 bp, Homo sapiens
gcattacaagccgcagcagtccccattttcaaatcagaggcatagtctgatgtgtttatggtaaactgccatctggcttgggtctatctgttttcctttctttgctgaataggacggggggactctgaagagtcgaggtcttcacagtgtggtttatttctcaagtgtgaatattgcacaccttcatggcttgaaccattacaaatgtaactatgctggcaccagacttcataactgtcgacttagttatgtcatcattaaaaagttagaggcgttgtaatcccaga

SEQ ID NO: 493184 - DNA, 559 bp, Homo sapiens
  misc_feature (296)..(297): n is a, c, g, or t
  misc_feature (328)..(329): n is a, c, g, or t
  misc_feature (363)..(364): n is a, c, g, or t
  misc_feature (366)..(366): n is a, c, g, or t
  misc_feature (383)..(383): n is a, c, g, or t
  misc_feature (396)..(396): n is a, c, g, or t
cgagctcggcaccctgattgctttataccctctgaacactgctttagcgatgtcccagaaattctggcatgatgtgtctttattctcattgggttcatagaacttattgatttctgccttaattttattggctacccagtagtcattcaggagcaggtagttcagtttccatgaagttgtgcagttttaagtgagcttcttaatcctgaattctaatttgattgcactgtggtctgagagagtacttgatattatttcagttttcttaaatttattgaggctcgttttgtggcctnncatatggtctatcttggagaaagttccatgnnctgttgaatagaatgtatattctgcagttgttgnntngaatgttctgtataatntgttaagtccatntgttccagggtatagtttaaatccattgtttctttgttgactttctgtctcattggcctgtctagtgctgtcagttacatattgaagtcccccactattattgtgttactgtctatctcatttcttaggtctattagtgatggttttataaatttgggagctc

SEQ ID NO: 493185 - DNA, 459 bp, Homo sapiens
ggccgctcgcgcagcgcctcgcgcacactgcggactgcgggcgtgcacataatccgcgagcaagacgaggccggcccggtggagatcagcgcctgagccgcctcgggatcccctgagaggcgcccgcggtctgcggccagtggcccgggggaaagctggggctgggaagcccgggcgcggcgcgctggggacgaggggaggtcccgggggggcgctggtgtctcgggtgtgaacgtgtatgagcatgcgcagacggaggcgggtgcgcggaggcggcagtgttgatatggtgaaaccgggtcgcatttgcttccggtttactggctgtgtcctcacttggtataggttgtgccctcttaggaccacatagattattacatttctggcccaatacccaaaagggttttatggaaactaacatcagtaacctaacccccgtgactatcctgtgctcaacca

SEQ ID NO: 493186 - DNA, 546 bp, Homo sapiens
  misc_feature (23)..(23): n is a, c, g, or t
ctagcggtggcataaagcggtcncgtttagaactacgggacacccggcttagtgcccgaacaaggaagtcccttaacattcgggcttacgacttgtggaagtagcactgtcctgcctattcctcttcagcacgtggctaatgcgcattacagcgagcgtactattgtgcgttcaggctgggtttttcatgtcaaggcgttgtggaacggcgctcattgatattacgtcagctggcgaaataggaatgttatgcaatcgcattaaggtgggtgtcagcatggttcttctagaccggccgctgtatactgctgtccggtggattgaatttagctgacggtatatgaaaaatgtccggtagcatgtccgggccagttagcttggttcctccagagcgtccggggtcttatagtacctgtctcagacagtgaaactgaaagggcagggtgggccttggtgggtatttggagcggagtggtggtatgccctcttgtccctcttggtcttttggatcgtttagtttccgtatcaaatgagtaggatgggcgc

SEQ ID NO: 493187 - DNA, 620 bp, Homo sapiens
gcttcccgtgcctcatacgcgagcatctcctctactggttgccgtccgtagcgaacagacatccatggcgcatgtagacacctattaaaatatcaggacaagtctgaaacaaagtagtaaaatgtatataactcttacctgtagtcattcttttacttttaaatttgttgctaatctctgataatgaagatacttactctgatactacagctgagctgtgagggcttccagggaaaatggaaacaaaatggtgtacttaggtaatgggtagtagatactgagtcttcctttcctttactgacccttctcgaggacatttgcttaactcaaactataagtagtactctctttacatattactataatggaaatgaattgctctgtgctgaaatttgaagaccagataatgaaactgaaaagcaaacaaatttactgcatctgtctacccttcattcatgagaactccagaatgagtgttgaccactgaagcatctattaagtctgtgtaccatagtgccatacaggtttgctgtctcatatgcatcatctgagatcattgaaatttttgacaataaaatatctggattgatcctgaaggaactagtagatcggtttagggt

SEQ ID NO: 493188 - DNA, 640 bp, Homo sapiens
atctaagctactaatatagtattagcccatagtaagtgcttagtgcaatgtagttactgtagtatcatttagtattattatctcagtgttgtttcttaactactgtatcctcagtgctgtcacagtgcctagcatctacttgggttcaataaatattcgttgaataagatgtattcatctggcctttaaaatcctggcgattagtaagatcataatgttgcatacagcatatggtgcttactaactaagaagaagattccctgataaatagaatgcatcttgccttgatagaataagtaataggaggctcctactgctgtaggagcagtgtgatcacagatatcaggatagtacagcaatgtgcgaaagctgggtgaccttgaggagagtgcttaaggagcctctctcagcgtagggtagttctagttcacttcgcctttcaaatgtgagtgagaggcaccaggcaaaagtagagtttttacaatatttggcgaattcacaatatgttcaatagccggacagttgaccttggtaggtgtattcaacacatacagattcggctcctttgaaagaatcccgtgtgttggctttgcctgtaatcgcagcaatacccaagaggtgcggcgaggaatggtttaac

SEQ ID NO: 493189 - DNA, 142 bp, Homo sapiens
ggtacgtggtgagacggccgctggacccccttgtgctcctggtgctcctggtgcccctgacccgttggccctgctggcaagagtggtgatcgtggtgagactggtcctgctggtcccgccggtcctgtcggccctgttggcg

SEQ ID NO: 493190 - DNA, 122 bp, Homo sapiens
gcttttatgtgaagcatggcaatcctgggttggtagagaaggagctactatccataattgaaggtggtatcatcggtcctgcagcttggaaatatcgtcttcaagaaggacagaaacacaga

SEQ ID NO: 493191 - DNA, 381 bp, Homo sapiens
tgggtagccgaactcgacatacgtatcctggtctttgctattacctgtatcagctgataacttctaaaatattctacctatgtgatcgtaaagatcagtgtggtcagcaccacctcctgaccacttgagaaccttttgagccgcgtcataaggaggcactctgtcaccctagcacaggtctcccgctgtaccactggctcacccacatagataagcagagtgcacaaaaaaataaaacttctattaaagaatcattctgagcccaagatcagacacggagtgacattgcaaactcactaaatgcagggagcctaagaaactggagttctccaacgggcacccaaacaacatctctactctaatttctgtgcccataacaag

SEQ ID NO: 493192 - DNA, 500 bp, Homo sapiens
tccttagagcactataagcgaagagcagtcagtaagataataaggacttctgtatacctgtacgagtttgctaagtcgtagccccaaactatacattctgcttcaatgcgctttacctcttcatctttcttgctattaaggaaaaattagtttcctttgattccgtaaaaacctaagagagatcagtacaaacacaatgcacaccaaaatgcagcaggatacggagaggcaacattgaagagggcggctaatgacagaatggtgtttggttctacctactggtaagagaagtttactggtgtcatggggcttcatgcatccactctatagctgatgtgtaacttatgaacaacactcacaaactacaacagtgatttctgaaaatattctatgttctagcctcgaaaatgttgtgcaggctaatgcctaggcaacactgaatagttcagtctgcatatgtttagcagatactggccgccctgtacaccaagtcttatctg

SEQ ID NO: 493193 - DNA, 381 bp, Homo sapiens
aaggttttagaccctctggaaagtaaacatctgcattaatcagtgtttgttgaacacccggggcttatgaaaagcattccctgggagcagatttcccccacgtccaacatcagagcaaagcgttttgctcagcacaggatgggcattagaggcatgttagccagttttgatcccccctccccagttttttgggtcaagtgtttttaaataagagaaaacagctttgggaggaagaaaaaattcagcaacataaactaggggcatttcatcaacgaactgttccctacataactcagagcggcccaagagaacccggatttttcagcaccaagttgaccagtcccagctccagtccattaaaaaaaaaaaagtgccatgtta

SEQ ID NO: 493194 - DNA, 291 bp, Homo sapiens
  misc_feature (269)..(269): n is a, c, g, or t
gaaacctatcctttgggagcaaaatatgtggttctaaattatctctcctcctctttctcaagtttccccaaaagaacttgagaattctcttcatgttcctgaaaaaaactgtgttaaggaggagaggagcaggaatcagaagatggttccaattccttctctggtccaatttccttgcgatcaaatgatctttgaggttgttccattgtctttttgaaccattgttccttccctagtaaaatggagtgaaaatcattttactgacttgnttacttaacaaatttttgtggg

SEQ ID NO: 493195 - DNA, 185 bp, Homo sapiens
  misc_feature (33)..(33): n is a, c, g, or t
ggatcttagacagcggaccccacctccccgggncctgttgcggtcggagtggagagtctctgagctgtgagattgatcttgcctcttattggagaggaagccgggcgccagacacacggggctcctgctttgggagccaggtccgcggccgagattgaccccagtaggggggtcgggctgtctga

SEQ ID NO: 493196 - DNA, 274 bp, Homo sapiens
  misc_feature (92)..(92): n is a, c, g, or t
  misc_feature (107)..(107): n is a, c, g, or t
tcccagaccctgagggcacctgtcagggtcatcccatttgggtgctgctttgagggctactgggggactgtgggcactggacgtggctggangcaggtggtgtcacntgagtacattctttgctagcagacagtggatgaggccccttcctcttccctcaccaagcctggggctgtgccagcctgtcttaggcagggctttgcagaggcgctcagcgtgaacacgggtaaaggcgtgtgctcattgccctgcggaccaggcgcagcgggcgccg

SEQ ID NO: 493197 - DNA, 346 bp, Homo sapiens
ttatctctcctatcaaacacggatgagtaacgactgctgagacatataagtacttaactcaagcaacaaaaacatcatcagacaagttaagaaattagctccaagaagaagtaaatcggtcttaacttaggattcaaacatgagtttaaatgaaccagtatgccattactcctagaacatgaggacatatcgcctaaaaggactcaccaaaagcatacatacaggtgggaaatcctaaatctatgcactgacactaagcagacatccatatccagcaccgagaggcacaacactttgcaaagatatcctcaaaaatattttacacgagtttctaccctgtatgtgt

SEQ ID NO: 493198 - DNA, 582 bp, Homo sapiens
gagctcaacaggggggaaggaatggctagttccctgcataaaccaattactataaatgataaactcctgtttgagtgaactaacatccagctaaatatttttacctgcacacctacatgtaaccgacggctcttgtgtggttggtcttcccctcctcccttttcttctctgtccacccgtcttcacattttttttctctctctctcacttcttttctttctcttccgtacgcccgcgctcgatctaatatcaaccacgtttattcttttattatttattttattttttttatttttttatggagttttttgtagcaacgttgtaggtttatatatttcttgcaacatctttttttgattttggtcttttctcacttttttttactcttactcatccggacgcctctcctcccggtctcttactttctttcctcctttactagacgcacgtttttctttatttaacatctagtgactgtatactttttatcgagtcagttgctgggacgactccgcgtcattcgctggtgcatctgtgtacgacccttctattcctccccggatctaccattatcctttcctg

SEQ ID NO: 493199 - DNA, 1342 bp, Homo sapiens
  misc_feature (98)..(98): n is a, c, g, or t
  misc_feature (107)..(108): n is a, c, g, or t
  misc_feature (294)..(294): n is a, c, g, or t
  misc_feature (296)..(296): n is a, c, g, or t
  misc_feature (318)..(318): n is a, c, g, or t
  misc_feature (323)..(323): n is a, c, g, or t
  misc_feature (330)..(330): n is a, c, g, or t
  misc_feature (334)..(334): n is a, c, g, or t
  misc_feature (339)..(339): n is a, c, g, or t
  misc_feature (348)..(348): n is a, c, g, or t
  misc_feature (353)..(353): n is a, c, g, or t
  misc_feature (357)..(357): n is a, c, g, or t
  misc_feature (359)..(360): n is a, c, g, or t
  misc_feature (366)..(366): n is a, c, g, or t
  misc_feature (377)..(377): n is a, c, g, or t
  misc_feature (380)..(380): n is a, c, g, or t
  misc_feature (397)..(397): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (413)..(413): n is a, c, g, or t
  misc_feature (621)..(621): n is a, c, g, or t
  misc_feature (852)..(852): n is a, c, g, or t
  misc_feature (900)..(900): n is a, c, g, or t
  misc_feature (907)..(907): n is a, c, g, or t
  misc_feature (940)..(940): n is a, c, g, or t
acagggttgcggcgggcggaacggtgtctccttcactccgccctccagcagctggagcagcagcccgaccgcgagcgtgccaagcggcttcagcagcnagcggacgnntggcggcggccccccccaggacaccaccagactcccctcttcccgcggcctcgccatggcgacccacggacagacctgcgcgcgtccaatgtgtatacccccaccatatgccgaccttggcaaagccgccagagacattttcaacaaaggattcggttttgggttggtgaaactggattgaaaacnangtcttgcagtggcgtggaattntcaangcccggntcanctaanacagacacnggtanagtnanngggacntggagacaaanacnagtggtgtgagtatggncnganttncacagaanagtggaacaccgaaaacaccccgggaacagaaaacgcaattgaagaccagaatagccaaggtttgaaaccgacattcgaaaccacccccccaccaaacacaggaaagaaaagcggaaaaaacaagtcttcctacaagagggagtgtataaaccctggccgtgatgtagaccttgaatcagcaggaccagcaacccaaggctcagccgnccccggttatgagggctaggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttnggcattgcagctaaatatcagttggatcccactgcttccatttctgcnaaagtcnacaactctagcttaatggagtaggctatactcngactctgaggcctggtgtgaagcttacactctctgctctggtagatgggaagagcattaatgctggaggcccaccaggttgggctcgccctggagttggaggctttatccccgctgaaagaaacctttgggaatggatatccagaagatttgcccctaatatatttcccttgtgacccagcagcaaggcttttttcccccccagaagatgatccaaaccaaggatgatctccaccagagctgtattttaagtatttagaccgttctttgttagctggtttttagttggttatctagttacccatgctgcagtcctgccgtcacctatacattatttaaatgtatttaactgttaaatgcgctacccccccataatggaatagacccttatggaaactgtgga

SEQ ID NO: 493200 - DNA, 1380 bp, Homo sapiens
  misc_feature (98)..(98): n is a, c, g, or t
  misc_feature (107)..(108): n is a, c, g, or t
  misc_feature (294)..(294): n is a, c, g, or t
  misc_feature (296)..(296): n is a, c, g, or t
  misc_feature (318)..(318): n is a, c, g, or t
  misc_feature (323)..(323): n is a, c, g, or t
  misc_feature (330)..(330): n is a, c, g, or t
  misc_feature (334)..(334): n is a, c, g, or t
  misc_feature (339)..(339): n is a, c, g, or t
  misc_feature (348)..(348): n is a, c, g, or t
  misc_feature (353)..(353): n is a, c, g, or t
  misc_feature (357)..(357): n is a, c, g, or t
  misc_feature (359)..(360): n is a, c, g, or t
  misc_feature (366)..(366): n is a, c, g, or t
  misc_feature (377)..(377): n is a, c, g, or t
  misc_feature (380)..(380): n is a, c, g, or t
  misc_feature (397)..(397): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (413)..(413): n is a, c, g, or t
  misc_feature (890)..(890): n is a, c, g, or t
  misc_feature (938)..(938): n is a, c, g, or t
  misc_feature (945)..(945): n is a, c, g, or t
  misc_feature (978)..(978): n is a, c, g, or t
acagggttgcggcgggcggaacggtgtctccttcactccgccctccagcagctggagcagcagcccgaccgcgagcgtgccaagcggcttcagcagcnagcggacgnntggcggcggccccccccaggacaccaccagactcccctcttcccgcggcctcgccatggcgacccacggacagacctgcgcgcgtccaatgtgtatacccccaccatatgccgaccttggcaaagccgccagagacattttcaacaaaggattcggttttgggttggtgaaactggattgaaaacnangtcttgcagtggcgtggaattntcaangcccggntcanctaanacagacacnggtanagtnanngggacntggagacaaanacnagtggtgtgagtatggncnganttncacagaanagtggaatcagtgatgacactctgggcaacagtagatcagtcgctattgaagaccagatttgtcaaggtgggaagcatgacaatttggagtactactcatttacacgcaaaacacaggaaccgaaaataggtataatccacgtcgttcgttgtcatagagggatgtgtactaaaccgttgtgtttgctgagggtgcgaggtttagattatgcttggaccgatgcaagtccatgggttcagcatgtactacggttatgagggctaggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttnggcattgcagctaaatatcagttggatcccactgcttccatttctgcnaaagtcnacaactctagcttaatggagtaggctatactcngactctgaggcctggtgtgaagcttacactctctgctctggtagatgggaagagcattaatgctggaggcccaccaggttgggctcgccctggagttggaggctttatccccgctgaaagaaacctttgggaatggatatccagaagatttgcccctaatatatttcccttgtgacccagcagcaaggcttttttcccccccagaagatgatccaaaccaaggatgatctccaccagagctgtattttaagtatttagaccgttctttgttagctggtttttagttggttatctagttacccatgctgcagtcctgccgtcacctatacattatttaaatgtatttaactgttaaatgcgctacccccccataatggaatagacccttatggaaactgtgga

SEQ ID NO: 493201 - DNA, 823 bp, Homo sapiens
  misc_feature (98)..(98): n is a, c, g, or t
  misc_feature (107)..(108): n is a, c, g, or t
  misc_feature (294)..(294): n is a, c, g, or t
  misc_feature (296)..(296): n is a, c, g, or t
  misc_feature (318)..(318): n is a, c, g, or t
  misc_feature (323)..(323): n is a, c, g, or t
  misc_feature (330)..(330): n is a, c, g, or t
  misc_feature (334)..(334): n is a, c, g, or t
  misc_feature (339)..(339): n is a, c, g, or t
  misc_feature (348)..(348): n is a, c, g, or t
  misc_feature (353)..(353): n is a, c, g, or t
  misc_feature (357)..(357): n is a, c, g, or t
  misc_feature (359)..(360): n is a, c, g, or t
  misc_feature (366)..(366): n is a, c, g, or t
  misc_feature (377)..(377): n is a, c, g, or t
  misc_feature (380)..(380): n is a, c, g, or t
  misc_feature (397)..(397): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (413)..(413): n is a, c, g, or t
acagggttgcggcgggcggaacggtgtctccttcactccgccctccagcagctggagcagcagcccgaccgcgagcgtgccaagcggcttcagcagcnagcggacgnntggcggcggccccccccaggacaccaccagactcccctcttcccgcggcctcgccatggcgacccacggacagacctgcgcgcgtccaatgtgtatacccccaccatatgccgaccttggcaaagccgccagagacattttcaacaaaggattcggttttgggttggtgaaactggattgaaaacnangtcttgcagtggcgtggaattntcaangcccggntcanctaanacagacacnggtanagtnanngggacntggagacaaanacnagtggtgtgagtatggncnganttncacagaanagtggaatcagtgatgacactctgggcaacagtagatcagtcgctattgaagaccagatttgtcaaggtgggaagcatgacaatttggagtactactcatttacacgcaaaacacaggaaccgaaaataggtataatccacgtcgttcgttgtcatagagggatgtgtactaaaccgttgtgtttgctgagggtgcgaggtttagattatgcttggaccgatgcaagtccatgggttcagcatgtactacggttatgagggctaggcttgctggctaccagatgacctttgacagtgccaaatcaaagctgacaaggaataactttgcagtgggctcactgtgagaagacgttcaaccggaaagaccacctgaaaaccacctccagacccacgaccccacaagcgcctgg

SEQ ID NO: 493202 - DNA, 221 bp, Homo sapiens
cccgttcagaataaatatacacccaatgtatgggcaggattcaaagtggatagtggcttggggtgcttagacagtgttatcgcttgggaccctggagtccttggggaaggcagtggtggcctcctaggccatggttgggattttggagggtttgttaggccctctcctggagtgtgcctggcccccctgcagcctgcttctctaaggtgtcggcacacgca

SEQ ID NO: 493203 - DNA, 634 bp, Homo sapiens
ccggcgtttcagtgtacattactggccctcggcctccaatttgccactcaggcgagatacttatggacccacaaagccagtatataggaggggatgctcagtgtctacctgcagtgccagaagttggcttgaacagccctactatctgccgcgcctcccagctccaccccctatcacgtgggtgctaggctagcttctagcgtagaggagcttcctactagatacacctagtagcatctatatagtagcctatcgtaccagatacggactagcaaatcccatattacccagagaggcttgggcagggcccactatgcccactatggccctgtgcccagagcgtaagggaggcagatggcagccaggggaagaagggaggtggggaagggccgccaccgcattgagggtcccctcccttgagaggaggccccatggcagttttcctgagttcttgatccacttaggtttaaacaacttatgtgaagctatgtgagatttgactgcatttcaaaagacaaaagcacatgttaccttctgatttgctctttgcctttcagcgacgctttcagatactttgtgagtgtctactctgtgctaggtgctgcgtagactgggatgtgtgtggctccatccg

SEQ ID NO: 493204 - DNA, 150 bp, Homo sapiens
tatataaacaatacatatacataaatatagataagaaaaatcactaaaatatactctactaacaccgaatacctaaaaacccatgaactaaaattaatttataatttgatagctaatccatgattcaaataaaattaacaataaattata

SEQ ID NO: 493205 - DNA, 126 bp, Homo sapiens
tctctgctcccagattcgggcaattctccgctcagactcctgagtagctgggactgcggacatacaccaccatgcttggctgttatttgttttttttagtggagacagggttcccctatgtttgcc

SEQ ID NO: 493206 - DNA, 250 bp, Homo sapiens
cgtcgacgtcggggtttcaaaccacagcccgtcgacaaacagcatcagcccggcgatgccgatgggcagggtgttgtaggtgatcacgctgactgcgctgccttgtttcttggtaatcacgtagcacaaggcatgcatgatcgcggcggccaggattgccagcaccccgaagaactcggcatggtccaggtgcaggccctggctcttgatgatcatgtacaggctgccgaaaccgatggcgatgtcgacc

SEQ ID NO: 493207 - DNA, 207 bp, Homo sapiens
ccaaaccactcacttactacagacaccttagccaaccatttaccaaataagtataggcgatagaaattgaacctggcgcaatagatatagtcccgcaagggaaagatgaaatttatacccacgcatattatggccaggcctaccccttataccttctgcataatgatttacctggaattacctttgagggggcccaggctagccccg

SEQ ID NO: 493208 - DNA, 104 bp, Homo sapiens
tctcatgtcttcctgctggtctggctggcttggccagagggagatgattccgggaggtgcttatgtctgtgctccttctgagggaacagtgggggccaggaact

SEQ ID NO: 493209 - DNA, 391 bp, Homo sapiens
atcgagaaagcgcgcagaccataggtacgagttcgagttcggataataggccatcccaaacagacactccgttccgactataaacaacagaaataaataaaggaaaaatcaaaatacctcatatccccatcttaccacaccacgatcccccgacgctctagcccatactcccccataccactcacattccaataagccgtcgcagccacccagagggggagtcccccgaccccgaccccctccccccccgagacggggctctatctcgctatttaggccggaccgtagagagtcgagactacgttatcgcatcttagttcgggtgatagcgagatctcgctccaaataaataaatgaaaataacgacgagacccaatactatcggccgcgg

SEQ ID NO: 493210 - DNA, 267 bp, Homo sapiens
cccccatattaaaaactttttttggaaggggaatttacaatgcttttggcttttgtcaatttttaaatttgccaattttaaaaatttcccagggggggggattttttaacctttttttgggaaagcccccccccccccatttttcaattcagttgggtttaactcacccccattgaaaccaaaaaaaagtttttaagggggctttttgccaggttccaagaatttgagtgaaaggggggcccctttttcaggggctcaatttctaag

SEQ ID NO: 493211 - DNA, 148 bp, Homo sapiens
ggctgtagaactggcaaatgggagagccaggacccacattcaggcctgtctgggctgggctgtgtgtcagctttgttgggttccagagtggtcagggtgaaggagcccttggatttggtaattaggagtcactcatggacctgtggcg

SEQ ID NO: 493212 - DNA, 139 bp, Homo sapiens
cccctcccctgaaagtttgggaacctaaaagtcctcggggaggggttctggatttaataagggaaagggggattgggggatccgggaggggggggttgtttttgacttgacattaaaaagtgttccatgtcccttttca

SEQ ID NO: 493213 - DNA, 940 bp, Homo sapiens
cgctggtagaagggtgggctttaacggggttgagaccgtcgttgtgccccccgggtatgtcaggtgttcgcttgtttcggaaataaggggaacccttcgcctgcgttttgagaccgcctttggccgcttgtattataagcgctgtggtgattagtgtgtgtgggaggcccaccggtttgttgaacagcttataaggggtgtaaccacagtcacacacaatgggtggggggaggtcttttctctcatcaaaaggggttgggtggtagtttttatgagagtgcccacccgtgggtgtgtttcgttgtggggcgggcacccactgtgttcttcataaggtggtggtaaaatggcctatgcgcgcctgtttatgccccctgtccgtaaaggtccctcgctcgttgctggccacccggggtgagcccccctgctgtgtgctggatgaaggccgcgcaccaccctctagcggtggggggttttttatttattataaggggcttcttgggagcagaccgccggttttgttcccaccccgctcgctgccttctgtgaaccgaccagtcttctgtgatactacgtgtttgggcacagtctttgccatggtggtttgtggtgggtggtgctcactcattatcaagggctggagggtttttgctgcgctctctgctgaggggacccctggccgcagttgtcctttttgtcctgtgggcccggtgttgttgtagtacaacttccgttttgggggagggaggcacctcacttcccgcccccctcgaccttctcgccccttaatgatgggtgttggggtatgggtaacatcctgggtctttcccggggaaaacctttttaaaaagagggccctcccaaggggttttaattttctgacaattttttggtccattaattaatgtggcacaattcccaaaaaactgttttttcccca

SEQ ID NO: 493214 - DNA, 885 bp, Homo sapiens
  misc_feature (1)..(1): n is a, c, g, or t
ngctatgcttgttgctactatacatgccgcggttgtgcatttacacaattctgcgtctatgcgtctctccgcggataactggtgacaccgccggtgccgccccttgttagtatttcacccgccttggttttaacccaggcgcaaaattttggggttcgggccacccccccagggatgggcccttctcgctcgattcacacacttggggcttctggttcaccgccttgtggtttcaggacgacctcgccgctggggggggcttttaaatcccgcggcggccacccggttgaggggtcctttctccctgctttctccaggacgacgacgccacctcgataaggtttaaatttaccacgggggtgggtcaacaccacaaacaccgataactgttcataaccagtaaatagttcttagtacagcccggtagtcccggatatgattgggaacgcccgcttgtaccgatgcttaataacaccccccgtacacttggggcaattatcaccctcctcccccgttaccagcaggcggtaccccccggccccgcgagttgtgcccctctccgccttgtgtcacatcgtgttttactgtgtcaagagccctggatccaattttgaaccacggttatcacacctccggcccacacagcggtgagaacagacacatatgttgtagtaggtcagctcttcggagaagcccccctaaccctacacacagtcttgtgtgtataatcacccctccagttggttctttaactcgcttctttcataaatgaagtttcacacggcaagattatcctattctgaaatagtttttccccccttcggtgaactcatatacccggagtatttttttaaaaactcaagacctttaatcccccacccccca

SEQ ID NO: 493215 - DNA, 311 bp, Homo sapiens
aactgccttttccactgctccacactggctgccgactcctgcagggctggggtcagccgtgcattgctctcccgaagggtctgcagctcgatctcccacttcttcacgttggctgcgctctgcgtcaaggcaatcttcagcttggcattctcagacttcaggggtgttttgggtggacccgcgtgagaagcccttttattggccggtccgttggcactgggatccctgggaagattacttgggggctccaatttttcccgcgctttggtttggggattttgggaggtttttttaccccccgggatattctt

SEQ ID NO: 493216 - DNA, 389 bp, Homo sapiens
ttagttcccatgcatttggctccagaaagaccccagtgccttttgacaatggccagggttttacctacttcttgccagtctttcccaaaggaaactcattccaaatacttcttttttcccgtggagtccgagaaggaaaatggaattgtggttcattctgtggtcccttgtaacctcaggtctttaatgtgctcactttcagatttaaaagatccaggtgttaatattttgggtatagtaatcattcctctaaacccctggattcttaaccctgttatatttcagtataaggggtggctttttcttttcatgtctttgatctggtttccttcctgtaattcagccccctgattttgttaggggggggaataatatgtggtttttgtaca

SEQ ID NO: 493217 - DNA, 223 bp, Homo sapiens
ctagaggatcccttcaagtagaggtggctgagaaagtgcagaaatcgtctgcccccaggaagatgcagaaggctgaagaaaaggaagtccctgaggactcactggaggaatgttccatcacttgttcaaatagccatggcccttatgactccaaccagccacataagaaaaccaaaatcacatttgaggcagatgtcagcgttgtgggtaccggagctcgaat

SEQ ID NO: 493218 - DNA, 298 bp, Homo sapiens
cccgttagctgggattacagggatgcgccaccatgcccagctaattttttttttcttattagagagggggtttcaccattgggccaggctggtttcgaactcctgacctcaaaggatccacccacctgggcctcccagagggctgggattacaggggtgagccactgttcctgccctcaaactgatcttaaatttaactgattggttagaatgaacttatcctcgttcattaacacctctttggccatgtagagctggggtgcaaaatgttctacccggggaggggggggcaccgagc

SEQ ID NO: 493219 - DNA, 115 bp, Homo sapiens
ggatttgctggtgcagtacaactaggcttaatagggactgctgaagacctggagaaagcgttggaactcactggtttgaaagtctttggcaatgaaattaaactagaaaaaaaaa

SEQ ID NO: 493220 - DNA, 110 bp, Homo sapiens
ggccgatctcctgcctcagccttctgagtggctgggactacaggcatacaccacatgtctggctcatttcttaaacttttgtagagacagagtctgtttgttgcctaggc

SEQ ID NO: 493221 - DNA, 653 bp, Homo sapiens
  misc_feature (653)..(653): n is a, c, g, or t
ttggtctaggtacgaggctggtttaatcggccgaggctgtcgccgcctcgtctgggctgttggctgcgggctgcgcccccgctgcttgccagctctgcacggctgcgtggctctgcggctgccctggtgctctgcaacgctgcggcgtggcgtgcatgggataacgcggccatggtgctgccgagatcgcctccgcagtgatgagggagtggtgggtccaggtggggcttgctggcctgtgcccctgcttgctagcgtacctgcacatcccaccccctcagctctcccctgccctatcactcatggaagtcttcagtgcaatgtttatcacttacaagggactgcgtatcttctaccaagactctgtgggtgtaggttggaagtccagagatattattgtgcttttacacggtttatccaacatccagctacgactggtacaagattatgggaagtgtcttgacctatgaggtattacatcggggtagattgcccttgatatactatagggctatgggcttacagtagagcaaagcctgagagccagcagtcaactatttcccagtaagtttttgaagacgagtggccaggccatacggttggaaagcgctatatttgcgggcatctcggaggctccaggaaccggcaggatn

SEQ ID NO: 493222 - DNA, 439 bp, Homo sapiens
  misc_feature (171)..(171): n is a, c, g, or t
gttccattggtcgatctgtctgtttttatgacagtaccatgctgttttgattattatagctttgtagtagactttaagaccaaggagcatgatggttccaattatattctgttcaaaattgctttggcgggttaggatcttttccggttttttttttttttttttttttcnaaagaaatttagcattattttcttaatatgtaaaaaatcctattgggaatttttaatagggaaatgccatttgaaatcctgttaaataaccaaaaatcctaacaggggtaattgggaataagttgtgggaccatttttaaaccaaataatccaaatcccttttccaaatggaaaccaatagggaaatggtccctttcaaattttaaataaccaatccggcttttaaattccttttttccaaaggttttgtagttttcagtagagattt

SEQ ID NO: 493223 - DNA, 401 bp, Homo sapiens
  misc_feature (151)..(151): n is a, c, g, or t
  misc_feature (243)..(243): n is a, c, g, or t
gacagaatctctccttgtcacccaagctggaatgcagtggtgtgatcttggctaactgcaacctctgcctctgggttcaagcaattcttctgcctcagcttcccgagtagctgggactacaggcatgcaccaccatgcccagctaattttngtatttttagtagagacgaggtttcaccatgttggccaggatggtctcgatctcttgacctcgtgatctgcccacctgggcctcccaaagtnctgggattacaggcatgagccactgcgcccggctgacatcgtttttaaaagtgggttccaagtccacattccttctgcaggttccataatctggtttttggggtttgcacacctttgtccctcttgggtgggaaagacgggtttccttgaccaggggt

SEQ ID NO: 493224 - DNA, 158 bp, Homo sapiens
atggtcactgtcttgcccattgcccactgcatcacagcagcaactttcagccacattcttaggtgccccatttgtcttcatgttacacacagttctaatcagcttggttatttggtttccaggtgccttgtctcttccacacagtgcatgggacgggg

SEQ ID NO: 493225 - DNA, 140 bp, Homo sapiens
ctgttatagaggatcccggggtagctcttgcggtataaatctctgggctacagacagtcatgtgtacattccctcctccccagaaagacaaggccacccagtcaaagcttagtgttcactgggtggcatcgataaacacc

SEQ ID NO: 493226 - DNA, 486 bp, Homo sapiens
  misc_feature (33)..(33): n is a, c, g, or t
ccacagaaacacagatgccaataaacgcacacnacatccaacatggctagcagagaaacaaacgaaagcttttgcatccacctgtcaaaaatggaaagctctgactatatcaggtgctgagggacagaggggatctcggcaggtgccaccccactgtggtcacggcccgatttggggagcagcgaggcaccctctagtaaaactgaaaatgggctgggtgcgctggctcacgcctgtaatcccagcagtttgggaagctgagacgggcggatcacttgaggtcaggagttcgagaccctgtttctacaggagtttaaaaacttaggccaggcatggtagctcgtgcctgtaatcccagcactttgggaggccgaggcaggcagatcacctgaggttgggagttcgagaccagcctgaccaacacggagaaaccccgtctcaactaaaaatacaaaaaattagccaggatgatctcgggtggtatca

SEQ ID NO: 493227 - DNA, 116 bp, Homo sapiens
agcggcgaacagtcactttgttgatgttcctttgctgtacataagcttgttcacttcatgtaatcctatttgttcacttttgctaggttgcctagcaaaagtgattgttccccgct

SEQ ID NO: 493228 - DNA, 1047 bp, Homo sapiens
gcggatgacgtccgtgtgcatgcggggggtgcccgggggccctggtggccctgggatggggaaccgcggtggtttccgcggaggtttcggctgtggcatccgggtgccgggttgatctgcggccagtggtacgtgggtcgcggggtcctgagtgccgcaggagactctggcggagcgcgaaaggtccagaaggcataatggagtggattgcccgtcaccaagttgggccgcttggtcaatggacatgaagatcaaggtccctggatggagatctatcgtcttctccctgctccattgaaggaatcagagatcattgatttcttacctgggaggcctctctacaaggatgaggtttgcgaagattatgtccagttgcagaatgcagacccgtgcccgtgccatggcgcaccaggttcaaggcatttagtggctatcgtgggactacaattgtgccacgttcgagtctggtgtgttaacgtgcatccagaggaggtggaccatccgaccgagtcgcagtggtgcgccgattcatctcattggaccaagtctcgtccatcgttccccagtgcgcagatggctactgtgtgggaacaagatcggcaagccccagactgtcccttgcaaggtgacaaggccgcttgcggcgtctgtgcatggtacgcctcgatcccttgcaccctaggtgggcactggcattcgtcgtccgcaactgtgcctaagaagctgctcatgatggctggtatcgatgactgttacagctcaagacccggggcatgcacatgacaaccttgggcaacttcggcaaggccgccgtttgatgccgattctaagaactacagctagctgaccccgacctcttggaacggaggactggtattcaaccaaggtctcccgtattcagcgaggttcactggagccaccttcggtcaagaacccacaagcagaagtctccgtggcagcgggacctcaaggctcccaggctggtgggtaccaacataaggaggtttaatacaagaacaaactaaggtgacttacggcggtacacac

SEQ ID NO: 493229 - DNA, 1505 bp, Homo sapiens
cccacgcgtcgaccacgcgtcctgaccacgctgtacgcccagctgctgtccgaccgtggtatctgtcagccagaacacaggtgtctgtgaaaactacccctaaacgccaaaatgaggaaagtgaaaagactcatatcaacattgtctgtcattggacactgtacgattcgggcaagtccagccactactggaccagtctgatctataacctgcggtggcattcgacaacaagaccccaatgacaaacgtttgatgacaggacggcatgctgagactgggaaatgggctcctatcaacgatatgcctgtgtgatctatggcataaacctgacaacgctgagctgtgacactgtgaggatatacacacactatgactatacatcctatgctgagaaaactttgaagaaccaagaccaagatacctaatgctgcacataatcacatctgagtgaccaccaagtggaccaaagaagcacctatcatacaacacacacagtgcattaacaatgggcacaatcatacagtgcatgaccatggattggaccataggaaacccatggcacctaatgatcatgcataggcatcgcgattgatacggggattgaaaaattctggacaaagacattgggataatcatacaccaaacgcaacattggtgagcaaagaaaccccagcaaacacagcacattgacctcatacatcatagggccatttacaacaaccaacgtgggatgatgatacaaaagacccacaaacacttacacacattagggacaagaagatgccattaacagcacaaaacacccatggagcaacataccacatcctaagtgaagaccacacaggccacatataacgagtcaccacagcacacgaccactcctcactcgaacgcgtaccccctttggcgttacaagtggaacacgttcaaagaccagcacctaacatacctttacactgcacaaacaatctggtgtctatactacaacccaccgcaacaaaaaagcaacaccgatcccgcaaggcccaaaacaggtcagggaaatagaccaacctgagatcgacccaacccacgtgcctagcacgagcacaaaagagaccaaaacaagaaagcccctcggcgcccaccaagaagagagggcacaacgaaaaccaccgaaaccaaggaactggccgacaatggccaaggatgaaacacacaacctagacagcaaaaccaaccgaggcacaagcaataactacaaccaacagagtgagcacaacatagacacatgcacacgtgcgtccccagccacacacacaagcaagagctaaagacaaatgcagttcgtcattaggacgaggaaactcgataatagcaaaaaagaatctagcattgcaaaaaaccaaaaatagcaacacaaaatactacgacattagtataccacacaatcgagaacggcacacatcttaaataacacataaaaactaataacactaaaatacgcaatcatgataaaaacttaa

SEQ ID NO: 493230 - DNA, 208 bp, Homo sapiens
aaagacatattaaattgtcaaactgatgtgatttccactgtaagaactaaaaacagaaggatggggaagattaagttaaaggaaggatccccgtttactcaactgcttctgaacagtggcagagttgggtgagaagtgggagatgaaggcagaaataagacaaagaagaaaggcaaagaaggcttcaactctgattgaaaatgagtgg

SEQ ID NO: 493231 - DNA, 384 bp, Homo sapiens
agagagaactgacgcaggaggcattttcccatgctgttctcatggtagtgaataagtctcatgaggtctgatggttttataaatggatgttcccctgcacatgctctctcctgcccaccatgtctgactaaattttgtatttttactagcagacgggctttcactatgttggccaggctggcctccaactcctgatctcgcgctccgtccaccccgacctcccaaagtgctaggatcataggcataagccaccacacccggcctcttttctctttctttttacttttttttactctggagactgagctttggcacatcgctggcccagcgctggagtgcaactggctgcgaatctccagcctcacatgcagccttccaccctta

SEQ ID NO: 493232 - DNA, 274 bp, Homo sapiens
cctaggctgggccacaaggcagactctctctcaaaaaaaattttttgagaaaaagagtaacagctgggccaggtgcaatggctcacgcctataccccagcactttgggagttggaggcaggagactcgcttgaggccaagagtttgagactaacctgggcaacaaagcaagacctctgctgttataaaaaatgaaaaaattagccaggcatggtactgcgagcctgtaatcccagctactctggaggctgaggtaggaagactgcttgaggcta

SEQ ID NO: 493233 - DNA, 367 bp, Homo sapiens
ggcctgcccatccagcactgcagatgcccccttgcccacctgctgttggtcccaccctccgtgcacctagcaggagtgccaggccccaaccggaacagccaggccattacccaggggagccagggttgcccccccccccagcgctgccagggagccgccatccgagctttagctgggggcccaaaggggccccccaggatttgtggccctgtaacattccctcgattttgttttcccgttcctccccccagtggttttgaaatcccagacctcgggtatataaaaaatgcagaacttgttttccgttcccccgccagttttatatttttggtttttcaaaaaaaaaccttaaaaactggaaaggaga

SEQ ID NO: 493234 - DNA, 350 bp, Homo sapiens
  misc_feature (17)..(17): n is a, c, g, or t
actgtggctaaacctcnaacctttcctataggaaatgtgatcagatcagagacacttgatcggttgggagtcagccctcaaggcctggcgacttccaggatcttggagttgctagaggaaaagtagttatgccctataggcggcatgagagacaagggatcagtttacctgccaactcctaccgtggaggaggagttccactgaccttgtgtagaaagatcaggaatccaggccagggtgattgaatgctgacaagaaatcactgtatatgtctctccagggcagtttcttaataagatgtttgtatttatttccagaccaataaatttgtaactttgcaaaaaaaaaaa

SEQ ID NO: 493235 - DNA, 932 bp, Homo sapiens
tgctgggggaacggggggtcggttgtcttctttgtggccccaaaaaaaaaaaaccacctcgtagtggttgggccgggggcgggggagggggggcccccggataaaacccccccggggggggggggggcgggctcgccggggtggtgtccgctggtccccaggtgataccccgcgtaaatagaggaccccctccccagcattctgtgggaggaccccagaaggagtgtcacctgtcggaagagggtggcgcccccaaatatcaccttgatggggggagaactgaggaacatcacgaagcgccatctccccacgagcgttcgccgtactttttttcacaacccagggccgaggagagaagtcggtcgacttatagaagagtcgtgtgagcccccgcctgagaaaccccaagtgttcggccccaggtaggtatccaacgagcgcgcggctgtgagtaagccccccaaaagagggcggatgacgaccacacggggtatcccggggggggctcgccggaaaaaaaccgagtgcgaaccccccacagcccaggggagatcccgccgcctccaaagacctccgggagggggacacacaaggtcgaccgggcgtgaacgaggcacaccgtcgcgggtcactccaacatgtggccccagtatacctgtttgcgcccgcatgaaagggcgccaccatgccgaaacagggggggcggccgctaggcgcgacccaccggagtggagtcgtaaatggggcccgaggaagaccgggaattggaggccccccaccagcggcgggcagggaggtcccggccaaacaaacatcactgatgtgggggcgataccccgttccagcaaggatggccccaactatgaggcgaagtgccgccaccgcggggggagggaacgccctggctgtcgccccagcgagagatccgccgg

SEQ ID NO: 493236 - DNA, 223 bp, Homo sapiens
ggttgatttaaaagaagttgagtttgggagatttagaaatgggagatttttaataagggcaaaagaaattcagtcacacctaaggattaacagaaggtaggggtgtattatctaaacagaaatcgggcggatgtgccataataaatggtctattagtaaaaaaatacactttagggcacagcatggtatcacaaattacagtagggacacttggcatccagag

SEQ ID NO: 493237 - DNA, 403 bp, Homo sapiens
gttgcttacagctttgcaccccggcatcagcacaggggtccctggcccaccctacggcagctgaggcagtgttttcctgtgaggactcccccatcagtggaccatagggagaagcccgatgccccattccgtgtttaccgtgacgcacaggacacgtgtgcaattcataggaacggaccagatcgtcctcatgagtgccatctggtacaggtgggtggcgctcacgtctctgtcctgcagcccatcgtggagccacagatagttctcccggtctcactcccagttcatgttgactttcggtagctctcgcatgcagttctattatacagccgtctacaagcgatgctttagtggcctaacctcatgtgatatacagctatttctagcagtcaggcagctctgc

SEQ ID NO: 493238 - DNA, 235 bp, Homo sapiens
tttttttttttgaaatggggtctctctccagcctgggcgacagagtgagactatgtctcaaaaaaattaaattaaaattaaaattgagcctgatgtggtggcacatgcctgtagttccagctatgcaggaagttaagatgggaggatcccttgagcttgggagatcaaggctgcagtgagctgtgattgtaactactgcattttagcctaagaaacagaaagagaccctgtttca

SEQ ID NO: 493239 - DNA, 399 bp, Homo sapiens
acctcactccatgtcacaagcgatcctctcccaggctggtcttgacttctggcctcaggcgatcctcacacctttgcctcccaaagtgctgggattgtaggcatgagcccctgcatctggcgcattttagccatttttaagtggcattaattatattcacaatgttgtgcaaccattatcactatttccacattttttcgataccccaaagagaaactctacccattaagaactaactccttattttccccttctgctagcccccttaacctcaaatctactttctgtctctgtggatttgcccattctagatatgtcatataaacaaaatcatatgatatttgtcattttgtgagtggcttagtttacttagcatgatgtttccaaggttcatccctg

SEQ ID NO: 493240 - DNA, 422 bp, Homo sapiens
  misc_feature (393)..(393): n is a, c, g, or t
  misc_feature (404)..(404): n is a, c, g, or t
  misc_feature (419)..(419): n is a, c, g, or t
gttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtaggaatttgccagtaagcctatctggtcttggggtctttgggaggattttgattcgattcaatctatgtatttgttataggatcgttcgggattgtcccatcccccgagtcagttgctagcntgtgtgtttcntgggagtttttcccnttt

SEQ ID NO: 493241 - DNA, 144 bp, Homo sapiens
tcagctctgtacatctaacaggcattccccatgatatataataaactcggcaagacagagtctgggagccatggtgtgaccctgacctacccaggatatctaagtaacaactgctgaatatatacatcaagctgggtgttgcag

SEQ ID NO: 493242 - DNA, 175 bp, Homo sapiens
agttcatgcctgtagctctcttccttttgtttctcacccttcagaaacatatttttcagtagctccaggtagatgagccttttatatattttttaaaataccatttgcagggaaatcggctgaatttaaaaaggcagcccggggtgtacctagaatggcaaggaactgatgtaag

SEQ ID NO: 493243 - DNA, 331 bp, Homo sapiens
aagctcggccctgtgtatagcacaacctagggtcagtcttgcaggtggtaagccatttaccaagatagttgtaggtcaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 493244 - DNA, 126 bp, Homo sapiens
ctgaagcacagaaacttggtaatgggatcaacatcattgtggccacaccaggccgtctgctggaccatatgctgaataccccaggatttatgtattatgaactgcagtgtctggttattgatgaag

SEQ ID NO: 493245 - DNA, 119 bp, Homo sapiens
gtggttcatggatgccagcccagcgccaacccggaggtacaggtgccgcgctgtggaagcagctcgcgtgtagaaccagttctcatcgtatggagcaagctctttgtgcttggccagct

SEQ ID NO: 493246 - DNA, 474 bp, Homo sapiens
gttaattgaaattagctcctggaaccttagaatgggagctactaatcccatctggcgcccttctccattaaatagataaggaagttgaggcctgggatggcgccaagatccacccaaagccactcactctgttggtagtgactttgggcctcctggcttgagacttcttgcctctggggctcttctgcctgaagacccattctgagtgctggaagtgcccaaacagtgagttgtcagggtgcattgggtaaatcacattcgcttcctaaacacaggtgctgtgagtgctctggcgaagtttggagcccagaatgaagagatgttacccagtatcttggtgttgctgaagaggtgagtctagcccaggggccctaatggggacagtgttcccttggacccaagcagctttcctttgtcttttttttttttaactgaaaagggagagaaaagttatacagctactgattgtagaaa

SEQ ID NO: 493247 - DNA, 224 bp, Homo sapiens
  misc_feature (54)..(54): n is a, c, g, or t
  misc_feature (115)..(115): n is a, c, g, or t
ggatgccaaatctgtcaagatcaagaaaaaactaaggaccaacgtgaagtttanaagttccgatgcccagcagataccctttacacccctggtcatcactgacaaagagaaggcnagagaaacctgaagccagtcccctgctcccccggtttggcagtgaaggaactgaaatgaacccagacacactgattggaactgtattatattaaaatacctaaaaatcc

SEQ ID NO: 493248 - DNA, 1186 bp, Homo sapiens
  misc_feature (116)..(116): n is a, c, g, or t
  misc_feature (121)..(121): n is a, c, g, or t
cgtctcgcggcggtaacggcggctagaggagcccggctgaggcgccagtacccggcccggtccgcatttcgccttccggcttcggtttccctcggcccagcacgccccggcccgcnccagncctcctgatccctcgcagcccggtccggccgcccgcctctgccgcgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgactcacggatacacgacctactagaccaccagagtgacccctgttaccaacgcctcggcaaggtggaagagcttctggatggccaaacgaatacgagaagtaacacggacgagatggtccacacagcaacaggagcccaacaccaagacagtacacatcagggaaccagaaagcgacaaagaaaggaacaagacagcatggagatacccaacgcacaggacgcagaagaagaatcgacacagcagaagtaacactgccgaggacacaagaggacatccaacaagagcgcagatcaaacgaaggaaaccacggccaaatggacgacacgaaaaacacagacagagagcaacacgacaaaccgccccgagcgccgaagagtagaacacaacgcaccacgacgcaagatgaaacgcccaatgacgaaaaccgacaaacaaaaaagacaccagcgagaagcagtaagaaacccaaccaacacagaccaggcgaccaagaggaacgaacacggaagagcagaaccgaaacgccgagcagaccaaacgaaccgacccacccagcaagaccacagacaccgagacgaaaaggaacgaagacaaaccagacgcaacacgggaaagagagaacaaaacggcccaaacaaccagaaacgcggacgaacaaagaagcggacgcaaaagcgaaaagacaagacaagacaaaacgccgacaagaagcacagacagcacggacaacaatcacgacacacagcacaaagaaccagacacgaaaacgaaacagaacaacaagacaaaagccgaaccgacaacaagacg

SEQ ID NO: 493249 - DNA, 538 bp, Homo sapiens
tgaacccagtgacgcaagctggggcacaccacgagccaaagggacctgtagggcgtatcgcggcggtggaaagaaagacgagcgctcctggcagaggcggggagcgacgaagcaatctgttccggaccaccccggggagcaacccccgtagcgcccgctcaccccgggaatagtgggagagtgcgcgaaaaccgggggcacccatatgggctgggtgataatgtgaggaaaatcaaaatccgcccggcggttgtctcccacaccaatggggaggcccctccaaatatggagagggctatggcgcatagaaatgtgggtcgagtgcgacgattactgggttttaactggtgggggacaggtaattgtccgttgggagtattccatcttgatttatgtgtactgtttgtcgcaaacgactcccagcttgaacaccctctctttcgtacgggcacagtggtatgagaacatgggcaccccgttctttgagagaatataacaaacaactgttagaaccgccacaacaaatagcaaaacaaac

SEQ ID NO: 493250 - DNA, 260 bp, Homo sapiens
ctgagactgcaggcatgtatgtattcagtcttacattaatcaaggatgctgtgataatgtcacaattttattggctctgtaaatctatcccaagagaaggtcacatgtggatttcaagtttgtgaaaaaaaaaaaatcacttttccccataacatatactagtgtaagccaggtgcgctgggccaggagcttggagctcagtgaggaaaagagttagaccaggctccgcaaatctgtcagcaaagacaaatatgagagag

SEQ ID NO: 493251 - DNA, 720 bp, Homo sapiens
  misc_feature (116)..(116): n is a, c, g, or t
  misc_feature (121)..(121): n is a, c, g, or t
cgtctcgcggcggtaacggcggctagaggagcccggctgaggcgccagtacccggcccggtccgcatttcgccttccggcttcggtttccctcggcccagcacgccccggcccgcnccagncctcctgatccctcgcagcccggtccggccgcccgcctctgccgcgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccacacagtgtagaccctgtcaaaaagcctcggaacgtggaagagatactggatggcaacgatgcagaagtacaaggctcgtgtccatcagcacagagcacacacactacctcagggaacagaaggacaggaggaacagacagagagtacaccacccctgaccgaacagatcacaacactataaatgccgagacctgctccacaacatcaaccggaaacagcatgggacagagacccgaaacagaaagtccacacttgctcagcgaccatgacccagtgatcaccagaaaggctctcg

SEQ ID NO: 493252 - DNA, 799 bp, Homo sapiens
actcgcgtcggttggcgactcccggacgtaggtagttgtgggccgggttctgaggccttgtttgtctttactttgtccactctaggccagggatgccgtggtaccagacactggagaggagtgtcagtctgggctgtcgagaagccttatagctcgatgacctatgaatggcaggtgtgggattctcaaatatagggcatatctgatgggaacttgtgtgttagagtaacagatgatttaggttggttgggtataaaagagacctaatgctcaagagtgtataatgaaggattgagaaatgtcctagaggtcaagtaattgcgacttatgtgtagaccatggtaatgccgcgacaagtgttaccatggaatactgatgtgaatggtttgaaatgaagactttgtcgtgtacttaggaagtaaatatcttttgaattagagaaagtgttgggacagaaagtactttatgtaactaagtgggctgttcagaagcttaggaggtcatttttgtacattttccttttttagattacttttagaagagctagggatgccacatggttttccagtttagaacaggccttaattaaaccttttggaacatttgacaccaagaaattgcatctgtcttagaaactggagaattaattggatggttaggtcaaacatgtacttgggttttctctgtggaaatttgtatcagtacttcgaaaatgagatcttacggaaaacacagatttttttaagttagtcatgcttctttaatgaccctagtgtacacttggtgatcaggtttggga

SEQ ID NO: 493253 - DNA, 148 bp, Homo sapiens
cacgagggcgcacaccatgacggtgttcgatgtgctgggccacttcggcgtcaaccagagtactgggctgatcctgtaacaggtcatgaagcttacggacagatggggctctactgagttaccggttgacaaacgaaccaccttgctg

SEQ ID NO: 493254 - DNA, 281 bp, Homo sapiens
aagacagaaagtggtgcaaaaagtgcgtttcaaagatcttggcctatctgcacgtctgtccttcagttgccaatacggattctctttcgcagtctgtgtgcaaacgttctggaacagagtcttaaccagattcacactgatcgccttctttatgagctccctctcatatggcagagtcgcgatcatatgtcggccacctctgtaataacagatgacaatccatgccggttctctggtgtcgctgtaaaaatgagggtgagtctcatataaagacacaccct

SEQ ID NO: 493255 - DNA, 853 bp, Homo sapiens
gagaaagatgcctactaaaacagttggagagagcagaggttcggctggtaaggggatagataccaatgtttaaaatgtatctggtgagcaagagtttcttgaagccttcgcatctgtgccgtatgctggatgtgagtggatgggaaagaattatgcctgagggaatcgatataggggaacctcttactgatcgtgtaaaggatgtgacttggatcccgccttttaatcggatgctgcatggaaggttcgacctttggcaagctgtacgcttgggctgttcagaacattcgaaagtgttatggtggatgccagtgccatatttaaagagcttggtatccagccggttgccccgtgcaaacccatcaccaagtgagaacccatcgggaccgagcttggggaccatcccgcaagcccacttcctcctggtgatgctcagcgatgctcaccctgcagctgcagggcaaacaacttgacctcctgctcaagttccggcacgctgggcctcgctcagacggcactgcggcctgattgggcccagttgtgaacagcgtgtgaggacagatatgaatgcttctgtcaaggtggttcttgcacagttaggaagaacacaaggaaggaaacgggtcctgtgcagctgccctgttccagggccagaaatggctggcatggatggaagaatggcaacaagggtcacgagaggttgtggactgggcaacttggggcggacagattggctcctccaggccttaagccaagtggtggtgagctggaaaggacgggggatagagagcacgggagcaagggggaacaacctacggaggggaaagaggagtcaccaagggaagtgccacca

SEQ ID NO: 493256 - DNA, 614 bp, Homo sapiens
tgtgggcaggctggttcctcctgaggcccctctcctgggcttggagacgccgtcttctccctgtgccctcacagggtcatccctctgtgtgtgtctgtgtcctcatctcctcttcttatgagatgtcttagtccatctcaggctgctgtcacagaataccagaggctgggcggattagaaacaaaacacattgattctcccacagccctggaggcttggaggtctgagatccaggtgtgggcagtgctggttcctcctgaggcccctctcctgggcttggagacgccgatgcttctcccgtgtgccctacagagggtgcgtcccatcgtgatgatgtgtctgatgtccatcattctccatcgttctaagtgaagaatggcgtgtaggttcgcatcgtcacgggggctgtcttggttgagcgagtaaaggtaaagccgatgcagggggcctgcgtggcctggggagttaataacggaatagacgcaaaaagaatgatacgaattggaagttgtcattggcgtgaagcaggtgcgcatgggcaagtgggcctgggtgaaggggtttcctggcaggaatttccgcagggggtgctggagggccagtgtgaactgtgc

SEQ ID NO: 493257 - DNA, 127 bp, Homo sapiens
tggggtttaaatttttttggtaattttacttaaaacagttatttcctatttttacgcagataaattattggtggcttaaaatggtaaaatatagtaaactggagaaaaataaaatctattatacagt

SEQ ID NO: 493258 - DNA, 543 bp, Homo sapiens
gggaagaacgtcatgaaatttagattcttattaaaagttcttgaacatccctgaactatttaatattatttcttgtccagcagatcctgaatcttaaattagaagttggtgacaggtaagtgggaattttccggggagggagaacacggatatactcaaatctcaaaatattacactagtcgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattctttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatag

SEQ ID NO: 493259 - DNA, 459 bp, Homo sapiens
  misc_feature (39)..(39): n is a, c, g, or t
  misc_feature (71)..(71): n is a, c, g, or t
  misc_feature (81)..(81): n is a, c, g, or t
  misc_feature (97)..(97): n is a, c, g, or t
  misc_feature (102)..(102): n is a, c, g, or t
  misc_feature (120)..(120): n is a, c, g, or t
  misc_feature (149)..(149): n is a, c, g, or t
  misc_feature (163)..(163): n is a, c, g, or t
  misc_feature (168)..(168): n is a, c, g, or t
  misc_feature (170)..(170): n is a, c, g, or t
  misc_feature (178)..(179): n is a, c, g, or t
  misc_feature (183)..(184): n is a, c, g, or t
  misc_feature (197)..(197): n is a, c, g, or t
  misc_feature (203)..(206): n is a, c, g, or t
  misc_feature (217)..(217): n is a, c, g, or t
  misc_feature (271)..(271): n is a, c, g, or t
  misc_feature (277)..(277): n is a, c, g, or t
  misc_feature (322)..(322): n is a, c, g, or t
  misc_feature (385)..(385): n is a, c, g, or t
  misc_feature (391)..(391): n is a, c, g, or t
gttcattaacaacataggaagccttgttctgtataaccngctagattccttaataatttgtcactagaggnagcccaaagncaaatattgggcaggnaatcngttctcactgggcccggnttccatgtaaaatctctgtgggggggggnatgggggggaccanctaangngaaggggnnttgnntttggttttgggnggtttnnnnggggggggggnatctgtgtttcacttcaaaatattggtttactgctaaacatcactctgaatttntgatgngggtactaacttcatacatttatcggcattgtccaaaatattttnttctttaatggaaaaagccattaatattcaaatgagggggtcacattaaaaaaaacccatacntaaganacagcctccaagaccattcaagccgcagtcagagagaaaaatgtttcgacagccaggttttcttcaaa

SEQ ID NO: 493260 - DNA, 87 bp, Homo sapiens
agccgggcccagcgagctcccgggaggtgtgtggacatcagccctgacggggaaggcgagccaggagcctgcaggcctgaaccaggg

SEQ ID NO: 493261 - DNA, 205 bp, Homo sapiens
accaggatgcaagccaagtcagtgctgtcagttgagcttctataacaaactctcccacacggggtgtcttaaaaaatacacattaatttctcacagggctagaggctgggaagttcaagatcaaggtgctggcagattgggtgtctggtgagagccagcctcctggcttgcagatggccaccttctaggtgtatcatcacatagt

SEQ ID NO: 493262 - DNA, 90 bp, Homo sapiens
tgagtagctgggaccacaggtgcaggccaccacgcccagctaatttcacttgatctcagctaaaaggtcgacaaatgataccagctaatt

SEQ ID NO: 493263 - DNA, 346 bp, Homo sapiens
taaatttgcggccggtctgacctaggaaattgttagaaacgtggattctggccaggcgtggtggctcacgctgtggtcccagcactttgggaggccaaggcgggtggatcacgaggtcaggagatcgagaccatcctggctaacatggtgaaaccccgtctctactaaaaatacaaggaaaaaaaaccaaaattagctgggtgtggcagctggcagctgtggtcccagctactcaggaggctgaggcagcagaatggtgtgaacccgagagccggagcttgcggtgagccaagatggcgccactgcactccagcctgggcaacggagcgagactctgtctcaaaaa

SEQ ID NO: 493264 - DNA, 1638 bp, Homo sapiens
  misc_feature (1288)..(1289): n is a, c, g, or t
  misc_feature (1298)..(1298): n is a, c, g, or t
cctgttctccgccgggcaccgctttgtgctcattgccgcctttgtttgggggccagcatgattgatgctacgcatgggttgtgcccacagaaagaccgagtgttggtccctcgggttccggggatttccctcggtgatattttcgtgtacgacgaccacgcgctttcctcgtgcccacagcaccccctattgccggtgtgggccaaagacacccacgcccccccttttcccggaagggccgcgcccacaaaaatgggggcgccccctacaggaggaaagagtgtggttgtggcaccaccagagttgttcgtaaaagaagaagaattatgggtaaatgagaatgaggttgagaaacggccaccacgcccgtagatagggtcgccgccaagaaataaaggagaaatatagtttgggggaagacgaaccacgcggttctggtccacatccccccgggggctcccctcaaggggggacccccacgaaatgttggccacaattcttgggaaatggggttctttccacaaagggtgttcctcgttgggtgtgtttttttggagaaagtggaaggttcctctttgccgtgtgtagatttatcgccccaaggaaaattgtgatttgggagaagagtttggcgccatttgttattatgggggaaaaaaatgcttctacaagatccctgggagagttgtatttctcgtagaaaggaataggtgttgttctccaccgcggcgttattaaaaaaacctcttgcccccctctggaagccctataaaaccttttcccacacctggggcgccactcggggagttttctctgaatgaccccgcgctggtagcccccagaaaaattgggtggtgtttcacaactcgggtttcccacacaaaatatttgggcccacagagcacccaacttgagattttgaaaaggccttctccacccctctgtgagagtgtctcacacagagctcatccccccgagcttgggtgtgatactctgggactctttctgtgtctctgtgtatctctgtgtgttttgggtgttttacactcataaaaaaaaaactctctcacccccactttcacagagttaccccggagaaagacgcccttctctttattttgtctctcacgtcactccccacacacgggtgtcccgcgcacacatttccgccgagaatgagaagagttgtagtttggagaattatcactggagaccccgcagagagggtgtggtcacagacccacacatatgagactcttgagaaagagaagtgggggtgtcacataannattggagtntcccacgagcacgccacttggaggaacaagacacactatggaaaagggctctgccccactgtctatttgtattcctctctcccactcgagaggttctttcggttatgagaaaagtataaaaatgtctcgagaaggaggccccaagtttgaaattggggaaagctcactggaggctttcactggtgaagcgcacgtaagtttctggagaaaaccacctcggggaacgagaccacggtgctataaagttgaacgcaggctgaatggatatgaaccccccgtcccagaaatctgttttaagttcagacttccaatagtggccaattaaaagtgctatttgtga

SEQ ID NO: 493265 - DNA, 784 bp, Homo sapiens
gattcctgaagctgagcagacattcgtgtccgagatgtctcgctccgaggtccttagctgtgctcgcgctactctctctttctggcctggaggctatccaagcgtactccaccagattcacggtttactcacgtcactccagcacagtaatggcaagtcaaatttcctgaattgctatgtgtctgggtttcatccatccgaacattgaagttgacttactgaagaatgcgagaggagaattgaaaaagtgcgagcattcagacttgtctttcagacaaggactggtctttctatctcttgtactacactgaattcaaccccactgaaaaagatgagtatgcctgccgtgtgaaccatgtgactttgtcacatgcccaatgatagttaaagtgggatcgagacatgtaatgcagcagtcactggatggtttgaatgatgccgccatttggattggactgaacttccaaattctgcttgcttgcatttttgtaatattgatatgcttatacaacttacacttttatgcaccaaaatgtacggtttataactaatggttccacatggaccatgatcttcctttaataattctaacttttgagttgctgtctccatgttctgatgtattccgagcaggttggctccacaggttagctctaatgagggctggcccactttacaggtggtggagccacaaaattctctttatccacatcaccatcttgttccgatttgcctcttcaactcttgcctcaaactgtaacaaaataacctgctaattaactcc

SEQ ID NO: 493266 - DNA, 203 bp, Homo sapiens
  misc_feature (134)..(134): n is a, c, g, or t
  misc_feature (140)..(140): n is a, c, g, or t
  misc_feature (194)..(194): n is a, c, g, or t
tgtaagaggtaagtaaaagatttcaatttgattcttctagagggggaaaagtagttgaaagtaggtcttcattttgcagtcatcaacctgtacgaattcttcatagttgaccttgtcccgtcgccaacaaatancctgcnttcccctgatcatttccatcctacttcttcaacctgttagcttttcccccaagnttgtcaatg

SEQ ID NO: 493267 - DNA, 663 bp, Homo sapiens
  misc_feature (19)..(19): n is a, c, g, or t
  misc_feature (69)..(69): n is a, c, g, or t
  misc_feature (71)..(71): n is a, c, g, or t
  misc_feature (82)..(82): n is a, c, g, or t
  misc_feature (85)..(85): n is a, c, g, or t
  misc_feature (93)..(93): n is a, c, g, or t
  misc_feature (98)..(98): n is a, c, g, or t
  misc_feature (121)..(121): n is a, c, g, or t
  misc_feature (142)..(142): n is a, c, g, or t
  misc_feature (144)..(144): n is a, c, g, or t
  misc_feature (147)..(148): n is a, c, g, or t
  misc_feature (151)..(152): n is a, c, g, or t
  misc_feature (154)..(154): n is a, c, g, or t
  misc_feature (182)..(184): n is a, c, g, or t
  misc_feature (188)..(188): n is a, c, g, or t
  misc_feature (237)..(237): n is a, c, g, or t
  misc_feature (262)..(262): n is a, c, g, or t
  misc_feature (271)..(271): n is a, c, g, or t
  misc_feature (274)..(274): n is a, c, g, or t
  misc_feature (276)..(276): n is a, c, g, or t
  misc_feature (288)..(288): n is a, c, g, or t
  misc_feature (301)..(301): n is a, c, g, or t
  misc_feature (307)..(307): n is a, c, g, or t
  misc_feature (312)..(312): n is a, c, g, or t
  misc_feature (334)..(334): n is a, c, g, or t
  misc_feature (340)..(340): n is a, c, g, or t
  misc_feature (383)..(383): n is a, c, g, or t
  misc_feature (427)..(427): n is a, c, g, or t
  misc_feature (429)..(429): n is a, c, g, or t
  misc_feature (441)..(441): n is a, c, g, or t
  misc_feature (468)..(468): n is a, c, g, or t
  misc_feature (503)..(503): n is a, c, g, or t
  misc_feature (512)..(512): n is a, c, g, or t
  misc_feature (648)..(648): n is a, c, g, or t
gcagggtggacagcaaganttaggacaagctaaaatcatcccctatttagaaaaaaaaaaaaaaaaagnanacaccagcaantantcccgggngggangtgggggcagaataaaaaaaaanctgcaatgattcctaattgtntnggnnggnngnagcgtggggggggggggggcggccaggnnngggnggataggcacaacttccaggtagtttttgggaagggtatgaggtccgangcaggctggccccttatcccccagntgccaagangangnctactggcagcncccccaaacttcnggctgncaccngcattgtcactgtgtccaaaancagcanccgggggcgcgccagggtgtcatggccaccccgggacacaccngccaggagcaacgtgtgggggttcttgttaaccggcactttgtntnacctctcacaanggtgcattcccaagaacttcacaatantacccacagcctcttcaagtgtcttgatggtaganaaggggaangtttcctccttctcaaattcatcccctacctcatcccaggctgcttcgaagttcagtttcatgaccttttgaatgtgatcagctacagtaacttccagatcttccagcacatactcatcctcatagccttcgtcancagtctccccagcgg

SEQ ID NO: 493268 - DNA, 329 bp, Homo sapiens
cccctccccgtgtatatatatttttttacctttataatttgccaatcttctctagtgttccaattttagcataggcactgccgaagagagcacaggattggcgcatttttatttttttttggagatagtctctatctcttgcccaggctgggttgcagtgccacagtctcagctcactgcaacctttgtctcccggtttaaagcgattctcctgcctcagcctcccaagaaactggtattatagtcgctttgccaccacgcccggttaattgttgtatctttagaagaggcaggtttttgctgtgttgcccagcttggtcttgaactcc

SEQ ID NO: 493269 - DNA, 323 bp, Homo sapiens
  misc_feature (34)..(34): n is a, c, g, or t
  misc_feature (37)..(37): n is a, c, g, or t
  misc_feature (47)..(47): n is a, c, g, or t
  misc_feature (65)..(65): n is a, c, g, or t
  misc_feature (70)..(70): n is a, c, g, or t
  misc_feature (102)..(102): n is a, c, g, or t
  misc_feature (130)..(130): n is a, c, g, or t
  misc_feature (136)..(136): n is a, c, g, or t
  misc_feature (285)..(285): n is a, c, g, or t
  misc_feature (299)..(299): n is a, c, g, or t
gattcggctcgagggagcaactgcccatgctggncgngcgcctgggncccggagagcaagcgcancgcgnaccctgtacacaggcttttccatcctggtgantctgctcctcgctggccaggccaccacngcctancttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgnccatgggagccctngccccaggggggccattgcagaat

SEQ ID NO: 493270 - DNA, 564 bp, Homo sapiens
cgctggcggcgaaaagcgctccaccgccccttcggccgcagcctcgtgcctctgcctcagccgcggcgtcgtcgcccgcggggggcggcgccgaggcgctggagctgctggagcactgcggctgtgtgcagagagcgcctgctgaccctgagagggagccccgcctgttgccctgttttgcactcggcctgtagtgcctgcttagggcccgcggccccccgccgcgccaacagctcgggggacggcgtgggcggcggggcgacggcacctgtgtttggacttgtcccgttgttcaacgcaaacagtgcttctccaaagactatcggtggagaaattactttcatgctgtgatagttggcagcaaggctgccaccgaggcccaggattgcgaaccagttgctgcacttagcttgttgaggataattgccccaagccaccaagcttactgtgttggaagtgctcgagaagccctcttgtgtgagaaccttgtgttagaggcggcaaacagcggggtgaagttacaccaagggaccattactgttgcgctctacgtggggccatgca

SEQ ID NO: 493271 - DNA, 488 bp, Homo sapiens
agttgaagctggcaggtatcagtagcgatggtgtgtgtagggcctgcaatctctatcttacaccaggtcaacctttcggtactatagaaactgtgcaggcaggcatgtatgtatatggcggcactattcacaatagcaaagacttggaaacaagccaaatgtccatcaataatagactggataaagaaatccatttatggataatgcagccataaaaaaggatgagttcctgtcctttgtagggacatggatgaagctggaaaccatcattctgagcaaactatcgcaaggacagaaaccaaacaccgaatgttctcactcataggtgggaattgaacaatgaaaacacttggacacagggtggagatcatcacacaccagggcctgttgtgcggtgaagggagtggagcagggatagcgtaaggagatatacctaatataaatgatgcagttaatgggtgtagacacaccaagcatggcaccatgta

SEQ ID NO: 493272 - DNA, 426 bp, Homo sapiens
  misc_feature (18)..(18): n is a, c, g, or t
ttttaccatctcaaccanggggactcttagcaaaggattttttgttgtcaaaataaagttaaattttgtccattagtttttgccattaaatgtattttatgagactaggtcattaacctaaagcatttaccgatggtttttaatttaccagaatatttgaacacccaagaataccctgcaacccctggctgtgccagttaactatctgactatttcaattccaggaagtttgaactattgtaaataataatgactttttctagtatttctaggattcatcaaaatccagcaaccactctgaaattaaactttctcttttctctcggcttttctaaaaagagttaatggtttaataattagattttatattatctctaggttttcagtgaagcataatggattaattgatggctactagaatttatt

SEQ ID NO: 493273 - DNA, 1146 bp, Homo sapiens
agcggggcctccgtgaggcggcctgggctgatggcggcggagtttttgtccataacgtgggcaaccggcagctggaggatggcctcactcgggccatgccgcagcttggggagcatggcgtctggggcgcttgaaggctggatgctggtgcccctgctggtacccgtgtctgcctgccggcgccttgcaccgtccgtctcatgggggcccctttggtccctcacttgctagacggtggaactcttcgtcataacaacttggggcaggtgcgatctctaacgagcggtcggcttgaatgtgaggcgcgttccggccttgtaccttcttacaagctcggaagccttgtctgaagccgaatagatgacggcctttccgtaacgctggggcacaggggatcggcggtgccgcctcggcgccgctccggattgggtaggggaccacggacatggctgacaaatttcccacccgggtatcacatacgcacaaacatttccggcagtgccataggggactgagcacctggtgctcaagctcctgtcaccggatcacttcgtttgtgaaccggaccccgagttgtgttagcaaacgctgaggtacaggaggcatatttgggactctagaccctaatacgggtttccggaggcacaccaggatagagaaatgccgcgtagtggtacgtggccgcgtgggccaacctgtttgtgtgctagaggtccacctccggcgcactagagcgccccttattcaccacatatggcgtcgaactgaccgattgggcgcatgtcggaagggaacttgttcactcagtataacgttaagttttcccacgcggaccgtttggcaacaataggtcattgcccaagaacaagctgtggggggggctcacccccatgggtaaacaacacacatacatgggctgtacatgttggagacccccgacacctctatcctatcgtagtgtacgttaaacccgtgagggcgccctctagctaaggtaaatagagacatgtacgcgaggcgcacagtgtggtcccacgaccagagtgccaccgtttagtgcgggcaacagatggctccaaccatcaacgcagtgtggagttaggtgctaagtcggaagaagctgtgttgtcaacttaccagacagaa

SEQ ID NO: 493274 - DNA, 158 bp, Homo sapiens
tgtaggagtagtgcaaggacttgcaaggacatacccctagagtagtacagtaccacggattcctagcctccctgagaccctgagtacctgccatctaactagtagatcatatgccccacccgctcgggggatcctacaagagtacgacctagcaggca

SEQ ID NO: 493275 - DNA, 256 bp, Homo sapiens
  misc_feature (54)..(56): n is a, c, g, or t
  misc_feature (78)..(78): n is a, c, g, or t
  misc_feature (81)..(81): n is a, c, g, or t
  misc_feature (119)..(119): n is a, c, g, or t
aaattattctaattcggctttaatctcctttaaggctttagtatatattacttnnnataaataggacggattaggtgnctnccttttcctttccatcccttgccccacccatcccactnaaccctagcttcattctccgcagctcattgaacaaggtcagcagaaagcagtcagactaatttcttctttcctgcactttcccactgtatctttaactgtgttcacaaggatcctctaaaccctctctgtgcccaag

SEQ ID NO: 493276 - DNA, 167 bp, Homo sapiens
ggttcatccatgttgctgcatgcgttagtacttctttttttttctgagacggagtttcgctcttgtcgcccaaactagagtgcaatggcgtgatctttggtccctgcaagctccacctcctggattcaagcgattctcctgggtcagcttgccgagtccgctgcatt

SEQ ID NO: 493277 - DNA, 92 bp, Homo sapiens
gcgataacagtgatagtttttaactctatggtcattgtatcacttctggaaaaatgtggagtagctgtaataaatctactccctgtattaaa

SEQ ID NO: 493278 - DNA, 555 bp, Homo sapiens
  misc_feature (312)..(312): n is a, c, g, or t
  misc_feature (376)..(376): n is a, c, g, or t
ggggggagggatagcattaggagatatacctaatgtaaatgacgagttaatgggtgcagcacgccaacatggcacatgtatacatatgtaacaaactggcaggttgtgcacatgtaccctagaacttaaagtataataataaaaaaagaaggtgtggatggttccttgaggttcgtcaccgttgtcaacagagcagcacagggtagcagtggacttctgaagtacacaagtgctacccactttcacatggaaaaggcaacccaaatagtgaatcaaatctgtatatttactggaccatataccatcttagtnacctctattctgagtacattgatgaaaaaaaatttttttagtaaaaataaaattgaattaaggntacataataaacaacaaaactcatcagggtattttcattttaagattaatgagggccgggcgcagtggctcaagcctgtaataccagcaatttgggaggccgaggcgggcggatcaggaggtcaggagatcgagaccatctggctaacacggtgaaaccccgtctctactaaaaatcca

SEQ ID NO: 493279 - DNA, 250 bp, Homo sapiens
ctcttcaggatcttctggcgcgggatcctggggaacggctgggcgaaggagcccggcctggtcttgcgtggacgagtgtggctagagctgggggaggacactccccacgtgtactgggagcctgcaggccaggcctgctgtgtgcactctatgcctccctggctctcgtatcagtgactgagcgagtgagccccgctagcctgtgtcctgtgcctggccttgtgagttctccatctagggcagagtgtat

SEQ ID NO: 493280 - DNA, 105 bp, Homo sapiens
tgttactgacttgaaaaactagatgacccaccaaaaaaacagacaaacaaaaaacctgttagaaatgaaaaacctcgtggtacctgagctctgaattctgtaatc

SEQ ID NO: 493281 - DNA, 454 bp, Homo sapiens
  misc_feature (229)..(229): n is a, c, g, or t
  misc_feature (252)..(252): n is a, c, g, or t
  misc_feature (256)..(256): n is a, c, g, or t
  misc_feature (261)..(261): n is a, c, g, or t
  misc_feature (264)..(264): n is a, c, g, or t
  misc_feature (279)..(279): n is a, c, g, or t
  misc_feature (284)..(284): n is a, c, g, or t
  misc_feature (307)..(307): n is a, c, g, or t
  misc_feature (325)..(325): n is a, c, g, or t
  misc_feature (334)..(334): n is a, c, g, or t
  misc_feature (342)..(342): n is a, c, g, or t
  misc_feature (367)..(367): n is a, c, g, or t
  misc_feature (369)..(369): n is a, c, g, or t
  misc_feature (387)..(387): n is a, c, g, or t
  misc_feature (398)..(399): n is a, c, g, or t
  misc_feature (422)..(422): n is a, c, g, or t
actccccataaggcattgatcaggattatggtttcccgttctgaaattgacatgaatgatatcaaagcattcttcagaagatgtatggtatctccctttgccaagccatcctggatgaaaccaaaggagattatgagaaaatcctggtggctctttgtggaggaaactaaacattcccttgatggtctcaagctatgatcagaagcctttaattatatattttcatccnataagcttaaataggaaagtttnttcncaggnttncagggtagctccctncatgntgaaaaatatagcctttaaatcntttttatattataactcngtataatanagataagncccttttttaaaaatgttttccccnanccataaaaccctatacangttgttttagnnccaatacatgagaaagatgtttntgtagctgaaaataaaatggcgtcccaagcca

SEQ ID NO: 493282 - DNA, 357 bp, Homo sapiens
gtcttgctatgctgtccaggctggtcttaaactcttgtgctcaatgcagttctcccacctcggcctccccaagtgctgggattacaggcgtgagacccagtccattgcttctttttttttttttttttatggaaacgcatttttgctctgccgcccaggttgaattgcagggttccaatctcagctcactgcaagtctccgcctcccaggttcatgccattctcttgcctcagcctcccaagtagtctggaactacgaggcgcttgcaaccacgcccagttattttttttgtaatcccagaaaagtataagtgtaccaccgttaaagccaggatgttctcactctcctgacctcatg

SEQ ID NO: 493283 - DNA, 706 bp, Homo sapiens
ccagcgtacgcccgagtaggaatcgcgaccacgcgtcgtctagaatatactatatcgctcacactcatatctcgctactatgtctagaaggaataatacatatcgtctgtcattatagctactctcataagcctcaacaccattccctcttagccaatattgtgcctattgccatactagtcttggccgctgcgaagcatcggtgggcctagggcctactagtctcaatctccaacacatatggcctagactacgtagataacctaaagctactccaatgctaaaactaatcgtcccaacaattatattactaccactgacatgactttccaaaagaacacataatttgaatcaacacaagcacccacagcctaattattagcatcatccccctactatttttttaaccaaatcaacaacgaacctatttagctgttccccaagcttttcctccgaacccctaacaatacccccgtccgtaatactaagctacctgaggtcctaccccctcgagagatcattggcaagccagtgccatcttatccagtgaagcgcactatcaggaataaaagactctacgctcgtctatagctaagtctccctacaaagtctcctgtagtgataacagtcacaggcagagaattaatccatatttgatatctggttcgaaaccacagcttatcgcaccgttgggtatcatcacccg

SEQ ID NO: 493284 - DNA, 138 bp, Homo sapiens
cgttataactatccatgatggtgactgtccatgctattctgttcgatattcctgtctttcacccgctagttgatcccacctcatgtgagactggcatgtgaatgagagcatttgccaaatgtgaggcggaaccattat

SEQ ID NO: 493285 - DNA, 313 bp, Homo sapiens
  misc_feature (5)..(5): n is a, c, g, or t
  misc_feature (7)..(7): n is a, c, g, or t
  misc_feature (9)..(9): n is a, c, g, or t
  misc_feature (15)..(15): n is a, c, g, or t
  misc_feature (148)..(149): n is a, c, g, or t
  misc_feature (306)..(306): n is a, c, g, or t
gttancngnaacaancacttaagagaaatatgttggtttgctgaatgcaggctacctaaattgatgcaagttagcttgagggagtgacgttgattgcatgttttgtatcaaaagaagaggtcattttaagcatttttccttcacagcnntttaaattggtctctgtggacacatggcttttaaattgctgtatgttgcagcagggatgttaactgtttgatgtccaagacttatagataactcattaaaagttatcttcaggctgaacaggtgtttaatttcaggagataaagatgataggaatgncccgggg

SEQ ID NO: 493286 - DNA, 437 bp, Homo sapiens
aaatgcttcactggttcctgggatatgtgagggcgctgcatatgtacatagatgtctttctgcacagcttcctcattgagtgacttgagtacttccttcctcgtgtgctggttgatgctagggcacaagcataggtcagcagtgctttggtatatacatggctgccttggtcaccgtcttgtgttgtcatccaggctgactacaggcaaaacagggcattgcgcacatcagggttagtgactgtaagaggaatctccgatagcgcgatggtgatatagtcggagaaggtcgcttcatcttctactcctccctgtatggcattgttgagcagtgatctatagctcctgtgtacagtcactgtccttatgcctctgggagagccatattaaggcttgggtaatgtgtgcgtgatcgatgaagatgtaggctcgagcttg

SEQ ID NO: 493287 - DNA, 95 bp, Homo sapiens
  misc_feature (12)..(12): n is a, c, g, or t
  misc_feature (26)..(26): n is a, c, g, or t
  misc_feature (29)..(29): n is a, c, g, or t
  misc_feature (40)..(40): n is a, c, g, or t
gccagcaccaancagacatctatctnctncatgtgcagtnctagcggggggacagatacgcagtattttggcccaggcacccggctgacagtgct

SEQ ID NO: 493288 - DNA, 217 bp, Homo sapiens
  misc_feature (5)..(5): n is a, c, g, or t
  misc_feature (7)..(7): n is a, c, g, or t
  misc_feature (9)..(9): n is a, c, g, or t
  misc_feature (15)..(15): n is a, c, g, or t
  misc_feature (148)..(149): n is a, c, g, or t
gttancngnaacaancacttaagagaaatatgttggtttgctgaatgcaggctacctaaattgatgcaagttagcttgagggagtgacgttgattgcatgttttgtatcaaaagaagaggtcattttaagcatttttccttcacagcnntttaaaagccatgtgtccacagagaccaactttaaaaagctgtgaaggaaaaatgcttaaaaatagct

SEQ ID NO: 493289 - DNA, 644 bp, Homo sapiens
  misc_feature (598)..(598): n is a, c, g, or t
  misc_feature (611)..(611): n is a, c, g, or t
aggaagtcgattatgatccagcttttcttccaggatgtcctcccgaattgctgtgccagcaaaatggagaagtactgttgagagagtaacatacttttcaagatgatgatttttgttgataatgctcccacacatcctcatttcattggtgatcttcatcccaatatcaaagtgttgtgtctccttccatataccacctctttgatccaaccaatgaatcaaggagttgtagcagtttttaaggcctattaaaagatcctaaggaggatctttgcccaggctattgctgcaactgaaaagcaccgagaggacactgatgcaattctggaaggtttacaacagctatgactgcatcaagaaccttgcttgggcatggactgatgtcaccaaggagtatgtgaatgacatctagaagacactgaagaagtttgttcatgacttcaaagaatctgctaaggatgaagaggttgcagaaatggacaaggctgtggttgacatggcaaacaactttaacctagatgtagatgaggatgacattgagaagctcctagatgtggttcctgaggaattgactaatgagctgttggaactggaacangaacacgccagcngaaagaaaggtgcaagaagaaaaaggaaactgc

SEQ ID NO: 493290 - DNA, 505 bp, Homo sapiens
gtgtagtacgcagctgtcacccctcctaatctagcactgatggctacgtcaagagttggcagcacaaagtgagatcgagaatcctggcgcacatagtagatagtgcccacacccatctctctactgaatgcctactccctcaaccagccactcatctctgactcgtgaggctcaaagagaacagatggcccctaggtgctctggttgggggtacgacggtcctaagagtcagtctttcaggcagtgacggctggcctgaaagtgtcagaagaagtggtaggtgggctcttacatccttgtgcacggtgggctcaaagcaaatccgtattgaccacgagtcatctgagtggaactatgaaacatgcctggcgacgcctgtgtccttggccccagaagtcactcatggaaacaccctatgacgtacttgttccgagacgcggcactgatgcaggcctcttggggcgcaccggccgggaggctacacacaggggatgggaccggccgt

SEQ ID NO: 493291 - DNA, 112 bp, Homo sapiens
tcactctgcaggatcccgacagcacagaggaggtggacagcacggaggaggactactcaaaaccatacctctctatgctgtccacctcctctgtgctgtcccacagaggagg

SEQ ID NO: 493292 - DNA, 127 bp, Homo sapiens
ccccaatcggccggccttcttagctgaggtctgtgtctggttattagcatcgttttcactttccttgggtcatctggaaaggccttggtcacccactgtgttctcacaccacagagtcaggcagtag

SEQ ID NO: 493293 - DNA, 194 bp, Homo sapiens
acacttgaggatcccgtgtgtcgagtaagataactgctcgaaatgtgatcatggttgtttaaaatctttacctctgcaattacctataaggcctttaagatcctgtactgatctgcctacccacaccacttcttcaaacctactctggccttgtcttttattcactcgtttcccttagtcaccattactctgta

SEQ ID NO: 493294 - DNA, 466 bp, Homo sapiens
  misc_feature (65)..(67): n is a, c, g, or t
  misc_feature (95)..(95): n is a, c, g, or t
attccagctcggtactcctaattggttcttcgatgacgccttcccccaaatacatacgttgaatnnnatcaagaggaaacaacattgtaaatcanctatacttcaggagttcccatcatggcacagaggaaatgaatctgactaggaaccatgaggttgcgggttcgatccctggcctcactcagtggattaaggatccagtgtggccgtgagctgtggtataggtcacagatggctcagatcctgctttgctgtggctatggcgtaggccagcagctgtagctcggattcgacccctagcctgggaacctccatttgccgtggatgtggtcctaaaaagcaaaaatcgatcaatcaatcagtcaactatacttccataaaataatttttcaaaaaagaggaaacaggagttcccgctgtgatgcaatgggatcagtggcatctcagcagcgacagcatggactcg

SEQ ID NO: 493295 - DNA, 250 bp, Homo sapiens
  misc_feature (65)..(65): n is a, c, g, or t
cttgttcatgggttcctcatggattcctcatggattcttcatggagtcctcatggattcctcatngacttcctctctggagttcctcactggattcctcactggattcctcactggattctctcatggattcctcagtggattcctctctggattccttcctggattccttcctggattcctccatggattcctccatggattccgtcctggattcctccatggattcctcactgaattcctccatggat

SEQ ID NO: 493296 - DNA, 481 bp, Homo sapiens
  misc_feature (21)..(21): n is a, c, g, or t
  misc_feature (51)..(51): n is a, c, g, or t
  misc_feature (60)..(60): n is a, c, g, or t
  misc_feature (62)..(62): n is a, c, g, or t
  misc_feature (73)..(73): n is a, c, g, or t
  misc_feature (89)..(89): n is a, c, g, or t
  misc_feature (97)..(97): n is a, c, g, or t
  misc_feature (135)..(135): n is a, c, g, or t
  misc_feature (152)..(152): n is a, c, g, or t
  misc_feature (154)..(154): n is a, c, g, or t
  misc_feature (158)..(158): n is a, c, g, or t
  misc_feature (214)..(215): n is a, c, g, or t
ccccgcctaagagggggccgnggctactacaaaggcacccctttcactagntttaaagcntngtttttaaagncttacatgctgttcangaccacgnaaaaaagctagaaacgggactacttaaaaattaatttngatagatgatttcttantngccnttcttggtctaaacttattaattttggtaatatttgatttaagtgtcttagatccnnttattttatacggaaagaaagatttagtatttcttacctgctatatgtaagttctgccatccggcatttaaggcgatcctcatccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtc

SEQ ID NO: 493297 - DNA, 304 bp, Homo sapiens
cagagtccaaacagtgcccatagcccaaacagtgcccagagtccaaacagtgcccagagtccaaacagtgcccagagtccaaacagtgcccagagtccaatcagtgcccagagtccaaactttgccatacctcaacctgtttttttgattccacctgttttttactttggtcttttagaagcaggactttaattggatcaggtttttgtgttttaaacagtatctcagttttaacagtttgttcatttttatcatcctcttgttgttttactgtcacttatacttctccgttgtattggctttt

SEQ ID NO: 493298 - DNA, 428 bp, Homo sapiens
agcggggcttcaaatggaaaacgacgggcgccgcggggctgcaggcgcttccgcccccgccccgggcctggaccttcggggtcacctgactccgacctgcccgggccgggcggcacggggggtaaagtccgggccggggtcaggagcgcggctgcgggccgtggggggcggggtcccggagttctgcccctcgcagctccaggctcctcctcagcttccctctcctgcctcccacccccccgggggcggggcgaccctgggcaccgagacagacccgcgggtgggagatgcggggagaccctgggcgggggacccgagggtggagtgggcggggcgacttgaggcgctaggcctcagctgcgggccctggagccaggtgcacaggcatcgccgaggctgtcacgcctgtcgccaccaatgtctggacc

SEQ ID NO: 493299 - DNA, 120 bp, Homo sapiens
agggatacctatccagctaacattgtaaagcactgatcgtatagatagtagatgttatcaccatcagcaatttggattcccttctgaaaatccaccagtatattttggggaaaccaaaat

SEQ ID NO: 493300 - DNA, 130 bp, Homo sapiens
ttgggcagtctcacctaggcctgcagccatctgtcctgcctgaggtcaacggttccacagcgcaccaatagcggctgagactcgacggtgctgagcgcttgagtgctgctccacacccgagtgctagccc

SEQ ID NO: 493301 - DNA, 116 bp, Homo sapiens
tcctccatctctaatgtcacactataattgaaaacagttatctcgcctacatgttcatcagtcatattctgaactcatttagttctgaatcattaagcagagagtctctcttgtgt

SEQ ID NO: 493302 - DNA, 176 bp, Homo sapiens
ctgttcaccactcggtgcagctgcggccgcccactcacatgcccctaggccctgagacaggcggccttcattgagcgcctggcagatcgaacaggccccgaaggcctagaaccccccggagcagaagtccttcttcgccagactactggatgtacatcattcccgtgccgcacccg

SEQ ID NO: 493303 - DNA, 371 bp, Homo sapiens
ccctcttggctcattccaagcttggccaaaattggggaagtgggatggaggttgccctgcatcccccactcctctgcctgagtgtgtctttgtaatgtcagctggcatcatacaaagagcaggagaagcaaacacccagaactcttttgctggtcagagattcccacacccggaacgcccgcacaagcctcctccggagcccaattcacaagacttgagaccccgggatagaaatggggaaggggggccgggggaaaggtgcccgtgggactgctccccatccctcggtcctaatggggtcctgtttttcggggaggttgggggttggcgacagcttgaccttgtgtcttcgtcaataaactcacatttac

SEQ ID NO: 493304 - DNA, 128 bp, Homo sapiens
gtcaatgcttgggtcaggcttctatctgctcatctatactgactcaatccttacttagatctaccaggtctcacatcaaattttaattcctcagaacaactttccgaaaccatgctatctcaggtggg

SEQ ID NO: 493305 - DNA, 319 bp, Homo sapiens
cagtgagaatgtacttgcctagtggaacctgtactgcgttcaggagtcctcatccacagtgatgtgcagcagtggcacatcctacttcctgggacatgggctgctccacttgtaacagaggctctaaacacccaagaacaaaagaaaaccgccttgctggatgtttgggaagaatcagcaatgggacccagaagctgctggccgtgtggtgggtgtgcatttaacctgcatggagccttgttccccatcggtgtcctggggccaatgggagcaattgtccatgctccctggactctgttgtatactttgccagtgactg

SEQ ID NO: 493306 - DNA, 123 bp, Homo sapiens
gcgtgtatggtatgttgtgttggaagaagaggaggcgaggaggtggcctagatcgaatttccgttactgacgctatactgaccgcttactgatgctcgcttactgatgctccgcgtacttaaa

SEQ ID NO: 493307 - DNA, 104 bp, Homo sapiens
cacaaatcaggattcctccaagcgatgcagtacagagagccaaagaggtattgggaagaaatttcatgttaccctgagaataacggcgcaaagaaactaaagcg

SEQ ID NO: 493308 - DNA, 90 bp, Homo sapiens
  misc_feature (18)..(18): n is a, c, g, or t
ttttgggggggggggggngggggccccccccccccccccccccccccttttcctgggttttttggaaaaaatttggtttttttttgggga

SEQ ID NO: 493309 - DNA, 1014 bp, Homo sapiens
agcggagtgggcgggctgacactcattcagccgagggaaggtgatggcagagctatgagtgctgtgtgcttggaacttgccgtccccatacagacgccaggggggcataagcccatgaggccgagggctagacaaaacgacggccgcctcgagtaggaaggcacggccggtgcgtgcggcggtgagcagcatgtggatgagccgtgtgcgagcgggtgcagctgctgcgtgctggagactctgctagccgtggcgcaactgggctagccttgcggagtgtgtgtcctggcgcgcctgaaaggtcaccaagagatgcaccaggtgcgaatgcacctgcagcgtcgaggagcaatgatgcgactgagcggcccggatgagacttgccaggccgggaaagggaccagggcagtgctacctttaccgcaggtacccaacccgctaaactctcgaattcatgaggctgaggaggaggcatccagttagtaccaggtggtagcgccttgcagagtgacaacgcgtcaccatccacgcctgccgcttttacaacaccgcgctggtggggccgcacaagctttcggatgggtgtccgtgcgagtcttccctggcgtcactccgaagcgtgttcccgaaacaaaccccatgggccgttgccatggaatcctcgtggctgaaggccctggaatttcaccacttacatttgggcgacactatgcattggggaaattgaggggctgctgtggcacggagaaacctgcgtcatatgtgcgttgggcccacaggtagccatactgcataccgaaactcaccgagaacgggtgaaactgaagacacatttgggtgcaaccctggaatccagcaggtatcccgccattcctcacttcaattgcccttcccctgcaaccccagaatgggcttggcgagaaagggccgccggtgctcagtccctggggtgacatctcaagtgcactgggatatgggggagagtcgtgaagcacatgcccccgggcacattag

SEQ ID NO: 493310 - DNA, 933 bp, Homo sapiens
ataatcccctgggccaaaccgtcatctactctaccatctttgcaggcacactccatcacagcgctacgctcgcactgatttttacctgagtaggcctagaaataaacatgctagctttatccagttctaccaaaaaaataaaccctcgtccacagaagctgccatcaagtatttcctcacgcaagcaaccgatccataatccttctaatagctatcctcttcaacaatatactctccggcacaattgaaccataaccaatattaccaattcaatactcatcattcactcattccatacatggctatcgcaataaaacctaggaatagccccctttcacttctgagtccagagtttaccccaatggcacccctctgacatccggcctgctttctttctcacattgacaaaaaattaagcccccatcctcaatcatataacccaaatctctcccctcattaaaaagtaagcctttctcctcaatctctcaatcttatcccatcatagccaggcaggttgaatggtgattaaaccaaacccagctaacgcaaacatcttagcatactcctcaataacccacataggctgactacttagcagttctacctgtacaaccctaactataacattcttaattttcaactcattatatttatctacttaaaccgattcctacatactcattaagtcagacatgacctatcatattgcacttgaacaggcaactgtttaaaaccttatcatacgctctttctgggggtgcccgaaaacggttttccatggctatttaagcattcgacacaagctttttccatatatgactaaccctaaaaaattcaggataccacaacataccctaagagaaagggtaaccctcccccacgactttattaaaaaaaggtggatcgtgtgacccgatctctctcgataagcca

SEQ ID NO: 493311 - DNA, 895 bp, Homo sapiens
gatcctcatgcggcctcctgacgagcagcggctgtgcaaggatgaccaactcttggcctgatggcaagaccatctggacgagtgtggttcaccagtcaaacagagggcacaggcccactaagcacatagatgggcgctgcggttcccgggaagtatgacacctgtgtgagtgccctgtgcgttcggaggccgtttttcccaccgcctcgccaggaggcttgccctgatggtgattgaaaggccccaaggactcgtggaaagcaggtgccaagtgaaacaagccgtggcgggtgagactccagcaaagagggcccgttgccccaaaataaaagagattgggacggccagtcaaatttaactgtaaacactggggaaactttgaaaatggtcgtgtacaaggcaaaccgagaattcaccattgggggggggtgggaaaataacacacgcaacaaagtggtctataaacgggtttgccagtggtggcgcaggggcccaggtagcactaattaaagaaggaccgaggggattaaggtaagcttgtgagagggaaggaatgcagaagccgagaacgatgacgggctggccgaaggactgtgaaacgtcgtggggggtggaatcagggacaggtgggttctagaccccatgaaggatggtgttaggaggggtttccaccaggaatgttaaccgttaaaacggtgggggtgaggactggacgattgaatgaactaataatatgacagcaggggggcgggtgaatgaaggttcatgattaatgactaactatgtgtgcttggtaagcgaaaaaaatggggcagaaaaaatgtggtagtggcaataacaggctatatgtcatgagttccaaagatggacagtataagctatacaccaattagag

SEQ ID NO: 493312 - DNA, 883 bp, Homo sapiens
gtcttgcagtgggccggtgttgtgaccttttaggcgcctgcgcgccttcggtatcccctcggggggtcccaccctgtgcgagccgcgtttgaaggccctgccccgtgaattgaggatgctccggcgtacatttcaaggggtcacaaccccttccctggggcgtacaaatgtcccccggggggaaagatcccccctcttttggcgctcgggggacaggtggcccgcggttggctgtcttggaagattctgcccgtccgtccaaggcgggctcccccgacgcgtcgccccacacccgggggctgcttcgtcttctccgggcgcccccccgggtgccccccccgcggtcgaggctctgcgggtgggcgcaccaaactcgactgtggggataaaccgtcggtcggcggattcccccccctgcttgctccgcgagcgatcgttcggttctgaagcttccacgacggggagcccccatactttgttgtgtggcccggcgcgcccctaatgttgtctgatgacggtggagggtctcctcccccacgggtagtatggccttcctgccccccggattgcgggccctcctttcccctcccctcctaatgaggggcccaaggatcttccccgaaggaggatatcttatcatgggggcggcataaaatgaaatgacgctgattatagtggaggcccgaacccatgtgctggtcggttttctggggaagacaccattaatccccgcgatcttttaaaaggtctgctctatacgagcctccatccgccccttcttgtcttctttacttggtagcaagtcgacgggtctaagaacgaaataaaacgcgttctagcgtctttcccccaaaaaaaaatttttttcgcccacataatcaaa

SEQ ID NO: 493313 - DNA, 779 bp, Homo sapiens
tggagacagtctcgctgtgtcgcccaggagtgcaggggcacgatctctgctcatgaacctcggcctcccagattcaagcgattctggtgccttagcctcctgaggggctgggacttacaggcacgtaccattatacccggctaaaattggtattttcagtagagacgggtttggccatatgggccaggctagtcgtaaggtctctttttaacactgaatatgtagggggttcctggagggattagggttaacctagttaataataaatggtttccaggtaattatcaagtttggtcattttataaatctgaagagttaatatgggtcatcggatacaaataagcggtgaaatctggacggaggctaaaaaaaaaaaaagaaaaaaaacaaaaaacaaaaaaaaaaaaaaaacaaaccaacaaaaaaaaaaggggggggggcggcaaaaaaaaaatcccccggggggggccccaaatttatggcggcaccccgttttgcctggacacaaaagggggcccaaaaaagggggaccacataaaagaccgacaggcaccggggcgcccacgtctaaaaaacacgcccgtgggggcgcggggaaccaccaggctgccccggggaacctgggaggaagcagcccccatccgggcggcggggcaccctaggcgacaccacccccggagaaattaaacgccccgggaaaacacaacgcgcggggtacgggtgggaccacccgacaataccgccgcgagaaaatcccacggatgtagaaaaaatatcta

SEQ ID NO: 493314 - DNA, 670 bp, Homo sapiens
  misc_feature (273)..(273): n is a, c, g, or t
aaaaattagccggggcgcggggggagggggctggaatcccaggctactcgggagggtgagggaggagaatagcttgaactcagaggggagagggtggagtgagccgagggttggcgccactggaactccaggcctggggcgaacagaagtgggaactccggtctctataaaacaaaaaagaagatggcgtaactccgaagttgatattctggctattggattctggcttctcccctgggggtcttcttgggtccctgaagcccctcttccggngattccggcctctatcgggctctggctcctggttcttttctggtattggacatggatttttggctcaagggattaaagggaccacttcattgggcttctttggggaaacttggcaatctccccaaacagggcccctctggagaatttctctctttccatttggttctggtccccctttctccttttggcaacttcgatattttctccaggtttccttggattcctttggatacgtcccattcagggcactctgggcctccattcaaactggcagaactttttccacttcagcacttcagtcactttaacattaagggtccctggcctaaagggactccaaattctggaccagcttatgattagcacagctacacacaactcgagggggggccggtcc

SEQ ID NO: 493315 - DNA, 262 bp, Homo sapiens
  misc_feature (13)..(13): n is a, c, g, or t
  misc_feature (30)..(30): n is a, c, g, or t
  misc_feature (79)..(79): n is a, c, g, or t
  misc_feature (137)..(137): n is a, c, g, or t
  misc_feature (204)..(204): n is a, c, g, or t
  misc_feature (233)..(233): n is a, c, g, or t
  misc_feature (246)..(246): n is a, c, g, or t
gcaagggcgcccncaacgcgggaggcccantgtcgatggttgcttacgccagcagcgagtgagagcgagccggatgagntgagccgagccggagaagaggaggcggtggctcctacatctgggcccgctttaggggnattgttcgcttctctccctgcgcccaagggtccggccttgctgcctccgccccctcagatgctggcnccacttattccccgccgctgttgcttttnccacccaccgganaccccaggcttcagct

SEQ ID NO: 493316 - DNA, 103 bp, Homo sapiens
agcggtcctcccatgtcttgtgtgaggagcagagagaggtactggtcaggaaggaaaagtagaagggtcctgaagggcaaattagggtggtccaggttgtgct

SEQ ID NO: 493317 - DNA, 359 bp, Homo sapiens
gcgtcgacgatggatttgattatggcgaagaaagagcctgagggggaggtggatttacctcatgtgcacgctttgcttacccgtctgcgcgtagcctgacaataaacgtttttttttgtgtttttttgattaacgactcacctcttatctgaaggaagagccatgactaattctgaaataaaagcaaccctctcattctctgatggttcccaatccttagagatgccaatttacaagggatctatcggtcctgacgtgattgatattcgtaaattgtacggtgcgactggcatgttcacttacgatccgggttttatgtcgaccgcggcatgtaattcttcaattacttacattgatgg

SEQ ID NO: 493318 - DNA, 183 bp, Homo sapiens
gtgaatacatgaccaaatatttggtatcggagaggctttgagcaccagttaatctcattcctccctttttttcaatggcaccagctttttcagcttctattttcctaagtagcatttattcctaagtagcagggtattctagtagcatcttcctagacgagccatttgttcctggagatagca

SEQ ID NO: 493319 - DNA, 133 bp, Homo sapiens
gtaattctgcaccacagcacacccgtgggcttctgcaggtgtgcgaactgaccccattcccatggcagtgagggctggtgcctctgtactgctgtgcgctgagctccccaaagtcctgaggaggagcgccagt

SEQ ID NO: 493320 - DNA, 846 bp, Homo sapiens
agcggaatccgcagtgcacaacggttgtccgcggccgtaaggtgcatgggtaagccttgcatacatcatcaaagtgcatagcctttccaagatggtttatcagacatcactttgttcttgattctgtacatagcactccgagatgcctcaagcagagattttgcttgctgctacagaatgtctgcaaaagaaaataacaatgaggagcgtcgcgctgggccccgaccgccgggaggcgtcttgggctcgccccggagcttcctcccatgagtggcacaggtgactgctagcccgagtgcattgtctcagtgttccatacgactggatacccagaggacttgatatatcacgtggaccacaggtgctcacttaccccagaaactgtcaacactccttgtatcttgatctagtccaacaccgcgaacgtgttcatgctagagtctcacagctgggatatgggactgggaataggacagaccagagtggcctggattccatccatgtgttgcttcaccattgccactagaccacttgtgtttgcgcgatacctcgggtgcctattagctgtagttctatgcagaagaactgcgatcaagaacgtcgagaactgagggtggtacggagcaacacagcgcgctgccgttttgcaaggagcgccgcgaaattctcgattatcacgataagaaaccggggatgcgaccacaaaatgtgctcccacagtctagcagttaatcgtgccgacgaagaaaagtggtcgaaaccttgttcaacctccaggggcgtccgactctcgaaacaaatgtcggcaacacctttttctcaattcctcggccggaaaaaccccaa

SEQ ID NO: 493321 - DNA, 468 bp, Homo sapiens
ggtgaatgagtgagaccctgtttcaaaaaaaaaaagttggtggattcatgctctatattttatcccaaataaggaattagatgcagagcagaattaaaaggaagtaatttcaaaaaagattatcaacaatttaaaatgttgattcaatgaagtgattttttaaaaaaataaaaagccatagccttttctgtggcttttaatttaatttctacccccaagccatctacatatacacccaggcacttgcacatatgccttgcttaatatcttaagtatccggaataagcctcagtttaaagataaacttacagccaggcgcagtggctcattttaaaacacataacagcactcctaaactgcaccattcggttgccaggatttacaggacaattcccttggatgagagtctaatagactggtttgagaattgagtcggtgaagggaacgaatgctgttgctgatctgaag

SEQ ID NO: 493322 - DNA, 548 bp, Homo sapiens
ggatagatcgccatcatgaacgacaccgtagagtatccgcactacaaagttcatgagcaatgcgagcatacttcagaggaaacaaatggtcattgagtgtccttactagcccgtggaaggcgacagtgcctaagacagaaattcgggaaaaactagccaaaatgtacgagagagcacaccggatgtcatctttgtattgtggattcagtaactcattattggtggtggcaagacaactggctttggcatgatttatgattccctggcattatgcaacagaacaaatgaacccaaacgatagacttgcatagacatggcctgtatgacgaagaaaaagacctcatagaaagcaacgaaaggaacgcaagaacagatactgacagaaagtcatgggggactgcaaaggccaatgttggtgctggcaaaaagtgagctggagatcggatcacagccgaaggagtacaaggtgctgcaatgatgttagctgtgggcccaactggtggaatttttccgcaacgaaccattaatcaaactaaaagaacttcagg

SEQ ID NO: 493323 - DNA, 843 bp, Homo sapiens
tgccgctccacaacccttgctgctgcactcgtttgtcccccagttttgttttcccccctgtcacacgggggccccaaaaacttttgggggcctcttcccgaagaaaccttttacagcgaaacccttctcgggtaataccgcgcttctaccccgacctaagtagcccccgttcttgacgcgaggtcatatcaaatccccctcgttttaaaaatttctccggtcgattctttcccccaatggggcccccttcgcgtccggttgttttaccccgttttcccctagagagcgttgtgtgtaccgattaccccaatgtttccctgtcatttcatctgggcgggttttcaaagggtgtcacacttcaaacccttggttggtccaaacggggcaaatggcttgcggtaaattcgggtttgtctgagtttccgttttaacaagggtttctgtgtttaaaaaaggcttcaaggcctattctgaacaagggtttaactttgtttttaaaaacttgggttggggaattttcattttttttacccagcctacctattgccaccagtgtggaaacctaacaaactgggcggcacgacgttgtcctgttgtattgcgcaataaagctcataagggtcgctagcctgccctgaacttcaagagaaatatttctacatgtttgttcattctagtttatattagtcatttaaaatcctttaggttaagtcttaagactttattaaaagttagttttgagaaattgagacacaatactaatactgtaggaaattggtgaggcctgacgtaaaacgttctttgtaactgtgatttcctttggctatctcccgtggatgaaat

SEQ ID NO: 493324 - DNA, 255 bp, Homo sapiens
cagttcagtcgtgactggaaagatgcatcctcattctatggctgagatggaaaatatcaccaatggcttcactgaagacaggctctatgatatgcggggacataactcctccgaccttacagcagatcctgagcctactcgaatccaacaacgactatgctgatgactagctcatacctgtctgattctggttctactgtgtgagcatacaaaatccctagtcacacagtatttgaatgccacatggaaatcgct

SEQ ID NO: 493325 - DNA, 930 bp, Homo sapiens
gtaatttatttatgatgtgtataagctttgtatcattatgggtggttctcttttgtggatgtatttgtgtgtgtttcttgatgtattgtatgttgtgtgttggtgatgtatgattgttatgttgtagtgtgtgctctgtgtttgtgtgttgtcggtgtggtgttggcgtagtgtgtgttttagtgtatcttgtgtgtgtatctgttagtcaggtgttggtgtgttgatgtggtacaactatgtcccgtatctcgcgtttgtgtgaagccctttcgcctgttcggggtgttaccccctccccccccaattttgtttaccgctccttattggtctttttttccccgcgctatctgtctgggttgcgcgtattcttgtgccagggagcctgtcccgccaaatttgtttgtgtgcgcatccctttatacatgttttcacttgtgcctgttcccggaaaatattgtcccggtttttgtgccctttctcctcgggggcccttattcgctgggtgttgaccactagatgcgtccccgcggcatccttccttctgccaacgggttgttcctttccttcctttcccaggagagcaggcaatggcgggaaccccccgagagtaactgccctgtggtgccggaaacccccgcaactgtctggcctttcaactgcgatcggcagcaattccccgcggtattcttgtacatagagaccccagcgcctgttggtgagccacaagcaccaaccgcggggactatttcatcattgcgatgggaagtcaccgcagttgcttgttttcccggccgcccacagacgggggcatacacacagaggttcttcaaaagagatagttcccctccagggggaaccccccccaaacccctgcatccaaaagaggggggaacccctcccaaaaaaaacctttgggaaaaaaaaaaa

SEQ ID NO: 493326 - DNA, 124 bp, Homo sapiens
tgaaacttctaaaactaggcaaggaaggcctagtagagagttaggactttcaccatcactcagcagtaaccctagttttagaagtttcaatagcactcaatttttttcctctccccatccttcg

SEQ ID NO: 493327 - DNA, 1168 bp, Homo sapiens
cgcggagcctggtgagcgcaggcgcgagctgcgggcagaggctggagaggcggcagaatgcagccagaggagggcacagtgctggctgctggagctgctgtcctgaggtgcagctgcaacagtacttcctgcggctccgagacgacctcaacttgtctaccctgcctgtcccactttgagtactgtcaatgtaatgagtgacctggagaagatctggcatgggtctggcctggccagcggcggctgtgggagggctgtgaagcaggaggaagtgccttgtgcaaacgcaagtcgtggatgagtaaggtgtacagttggacaagctgacctggagtgcttgagttcccacctcatcactctcagagcaccttccggaagacctctgccctgcccctgggggcccatgcagggtgcagggggcccctgcagagcctcagctgcctcattggggaagaagggacctgcggcctacctggacgaaagctgggtgatggtatcctttggcgtgctgcgcacggggcgagtgtgaacggcggccctcacgtgaaagacggttgatgttgttggctgtgaagttgcctgaaagccctgatgttcctgagccacaggccagagagccactggcaccgacgttcatcacgtgagtgtcaaatggcccattgcaacttcgggtcggaccagccgcaaaaccctcatccggccttctagagtgagatgtgtgcgtcaactgcccgacatcatgaaagaatggctgactgctgcttggcacccacgatgggacaatccgatcaggattggaacaccgggcgataagattaaaggcccgccagtggtccgcgcttatcttcctgtgtgagaactctcgttgatgtcgcgccctaacgaatctgtatcaagtgtatccatgaatgatcacattggacattacctgtattatatcacagaggtcagcatgatacataccacggaggtaaacctgggtatgtccccgacaatctccggtcgagatggtgattgccgataagcatgcgggttaaaacaaagatggtgtgaactttgatgagccacaaatggtgacgagaagaaggctggtaaaatggcagaaaacgtatgcgttcagtacagttcaactatcaagaggtgggcccaaacgaagtattatgtcacc

SEQ ID NO: 493328 - DNA, 340 bp, Homo sapiens
tttgacaaaggaagaaatcttgaagggctcaaaatggctctgggcgacctcagtgtcattagttgcataaaactggtcatcggagtaggagaagcccaccccagctgtggactccaggtataacacatgggcaatcagattccaagaataggggtggtactccagggtgacaccatctggctggaccaggaaggggccaggctcggtgaggagcccatctagtgagctgcagccgggacccccatggagccaaagcaccacagggctgtgctcgggatccttctgggactccacaaaccagtaggggaggtgctgggagccggagcctttgaggtagccg

SEQ ID NO: 493329 - DNA, 119 bp, Homo sapiens
ggcccggtacagacactttgctgtgtatgtcctgggctatgtcactccatgaaacagccatcgctacaatgtcaccatgatctttgggagcatcttcaccagatctcacccgtctggct

SEQ ID NO: 493330 - DNA, 396 bp, Homo sapiens
tcatatcgtcttatgcccaatctctgcctccaaaaaaaagaagtaaaaactaaaaggcagaaatgaaatccacaggccgacagcccaggccgcaccctgggcctggtagttaaagatcgacccctgacctaatcggttatgttatctatagattacagacattgtatagaaatgcattgtgaaaatcgctatcctgttttgttctgatctaattaccagtgcgtgcagcccccggtcatgtaccccctgcttgctcaatcaatcaccaccctctcacacgcacccccttagagttgtgagcccttaaaaaggacaggaattgcacacttggggatctcggctcttgagacaggagtcttgccaatggccctcgctgaataaaccccttccttcttt

SEQ ID NO: 493331 - DNA, 371 bp, Homo sapiens
tagtggcaattggctccaggtttcccgggtgtccctgtgtcctgtgcttttgccctgctctggcttccctggctttctgatgctggtgccgttcaaaccgtgccgttatcccggctttttgagcacgctatgctccaagctcttcgcgcgcatcagctgggcattgacacctaccaggagtttgacatgaaagctatattccaaaggatcggaactattcgattcctgcattgatcccaaacctccttcttgcttctcggactcttattccgattgccttccaacattgggggaaacgcaagtcgaaattccggtctaagagcttggtgccgcatcttcccctgctcgctcattcggagtcctcggcttgg

SEQ ID NO: 493332 - DNA, 706 bp, Homo sapiens
ggaaaggtcttgggggccctgggcctgggtctgcgggagccccatctagcggggttccaaggcggcggcggcatcagtcgaggccctgctccgggagctcatctgtcccctttcgccctcacgccccccagtctgactccaggccctgtcccctgagctctgccctcggatgtccgacgccagagcctgcatcgccggggagccagaccccaaaggaaccacggaacgcctagcgtgggtccggggccccctgggcgggggtcccggggcgccccatcctcccttgggacccgttgtcccggtcctggtctttcccccggatctagtattcagggcggaccagcggagcggaccccgacagctgctgaccctcttagtaaaccccaccaaggcaactgcgcttcgcttccgagcatgctgattcgccatggtggcaccccaactttccccaagccacatatgattgctccaggaaaccggcttttccgggcaatttgcacgccatgctctgaggaaggagctgagcggccgagtggtgggacgcaaggacattacctccattctgagagccccagcgtacccccttgagcttcagcggacacgcagatcaagcgccctcgcccaggcctcctgctgggacaaacacccaaaccccaaaacaccacaacaccgggaacccaaaggcacaccaccctcaccccaaagc

SEQ ID NO: 493333 - DNA, 415 bp, Homo sapiens
tttggagctgccagtgcactccagcctgggcaacaatgagtgaaactctgtctcacaaagaaatgaaagaaagaaagaatggctctgcagtcagctgtaagtaaataccaggcactggtgtgctcacaccttgtacatcccagccgcttatgggagtgctgagtgcagcatggcgtgatacacattgatgtccgaggattttcactgaccatgcctgtggcaactgtggcaaaaccgctgtctctacaaagaaataaaaaattagccagtgttgtggtggtgcacacccataatcccagctactcagggggctgaggcaggaggattttgcttaagcccaggatgtcaagcctgcagtaagctgaggttgagtcactgtactccaggcttggatctccaccttgagatcctgtct

SEQ ID NO: 493334 - DNA, 954 bp, Homo sapiens
gagagagtggggactgtccggctacgaatcggcgacgtgtacgttgtgccatcgactatagagagaattagatatgggtgatgtagaaaaaggcccgaagatggtattatcgtaaggtgtgcccactgccgcaccgttgaaacatgggagtggaaaggtcaagaatgggccaaatctcgaatggtgatctttgtgcggaagagaggtcaggcccctggatagttcttacgcagccggcgaagtgaggatcgataaggcatcgatctgggggagaggatggaactagatggagataatttgggaagaaatcccataggaagtacattcctggggatgaagacatgatctttgtcggcattgagaagaaggaagagagggcagacttaagtagcgttatctcaagaaaagcgtatgtgaatgagtaataattgggactatgtggttattgatttactaagatacagaaatgtctgatgcatgttttgatgtgtaccatctcttcaatagatctcaatacaccagaattcagatctatgaatgagtgaccagaattattttgttgggcaagctcatggtttaaaactaagagtggttgtggttaagatgaatatgttcagagagaaggtggactgagaacgcccaattcagtatcatggtattagtgtgtacccatttaagatttgatagacttgcggcagtagtgttacttgtcataagatggtggtggctcttagactacgggagggggtgaatgaaatgttacgggcgtgaatgttagtgggggagaaggtccgtgttaagcacaaagaactcgttggggggcaagccccagaggggggaacacacgagggcccatgggggggagcacacaaacgggaagggtataaggaaggggtggtacaaaacaccctcggggaaaaaagctggcaaatagtaaaaatgtattctacagca

SEQ ID NO: 493335 - DNA, 296 bp, Homo sapiens
ctagctttaccctgtttaaaaacgtagtcagacctcataggtccttgctgtggaaaaacctgggggagaatgactactgggtacataacgaaatgaagggagaaataaagatgttctttgaaaccaacgagaacaaagacaccagataccagaatctctgggacacattcaaagcagtgtgtagagggaaatttatagcactaaatgcctacaagagaaagcaggaaagatccaaaattgacaccctaacatcacaattaaaagaactagaaaagcaagagcaaacacattcaaaa

SEQ ID NO: 493336 - DNA, 869 bp, Homo sapiens
ctagtttcctagccccgcgctcttcgtatccttcccagcctgcgccggagccatcaactttcaggagcatggacgtgaaggcgccctcgccccagcgcccctctgagatcctttgtgttttcctccgtttcctccggccgtattctattttggggggctctccgctccccctgcatctccccgtccccgttcccctctcgcgaaacatgcctccattccttcaccaggggccctcggaaggagctgcctgcctgaagcccggagacgccgcgccgagctcagccccgccgccgaccgccggctctcgaggcatgtgctgcgcatgccgactcaagtatggggactcctcggaatgctcgccagacgaacgcccgcggttccctgcctgccccaggccccagggcatcgaacgccggaccgaacagaatcacgaagacacctgacaccgaatcgagacgatacacataccatattattaaaacgagaaaaggcaggccattaacatcacgaccgaaccagcgatcagtccacacagacgtgagactacatgacgataacccacggataccaaccagttacatcagaacgaatatcaaacaacgagagagaggggacagccaaacacaacggggcaatttaccccgagaagaaacataccgcaaaaggcaaaaaacactagggagcaacccaatcccagaacgcacaaacaagaaaaacgtaacccccgaaagtcaacagacaaaagaaccagcaaagcacacgaatgcacaaaaacacagacccccacagcaacactcacaacaccgacaaaaacgaaccaacagcaaacaaggcacaaacagccaaagagaacactacactatacaaaa

SEQ ID NO: 493337 - DNA, 1212 bp, Homo sapiens
taaatagttaaaaaattttatcctaatagctataattacagggctgtgttggtcgaaatgaaaactgaaaacaagttttacaaaacaggtgtgattacctaattcggtgtattgaaagcagttaagaggttccacgacaccaaattagaccagttctgaggttcccccaagataattttaacagcctccagctctcaggttgttatactcaaaattcacaaaagacacaacagatagcaggtgtgctacttttccagatggcaaattcggaccctttgcaggctgcagggacagagaaaagctacatctcacacacaagaggtggaggtgcctcccgaggggctagtgggtctacggtgagacccgcctagcccggtttgcacagcgctcctgcctggtagaggccccagactatcctgccaaagtggtctgagcgagcacgagttgttgggggacgacggacccatctctggccacacgggagaccgagggacagtatggggccctgcgtcccataaggtcggcctgaacggtggttaagggcggcctgcggcataagggcgacgctggctgtgggaccccacagcctggccccgtgtgaaaccgtggaagcccagggcacaagcacattggctatgcgacatgccaggggtgacacccaagggcacaaagcgaatcgcggggactctctacgtgtgaccatgcgcatttgatcgcaatcatgtggcgcctccagcgacctcctttgttcctccgcagtggggacaccaagtcgtggtttggcggactggggctttcccgggcctgtacagttggcaatcccttatgctaaacggggtgtcccccctgtcgtgagtgttcccaggtgttcctccgactgggattcttgcaccttgtttgcggcacgatttggcctctggggattgcggggggttacaaacaagccgcatccacgcaaaatagtggagttttacattcacatggttcttaaggcatcctagagggggtttgggccggattctctccccaatatcgaaagggaaatcacctgggcgacgcccaggggtccccctgtgggcagtctaaaagcccgtctgttgagagtagaacacagcgactaggatcgttgtctgtggcaacacttaaaacactcgccagttggaagcaatggtgaaagaagatacgcaaaactgctctctgggtacacacacg

SEQ ID NO: 493338 - DNA, 760 bp, Homo sapiens
tcgatcagtagagctgagttgtaatggacacgagaaggtgtaccggctgttgctgaaatacggtgatgcctgggtgaagaagtatgatcgctcctccctgcggaccctggggtcagtgggagagcccatcaactgtgagtgcctgggagtggcttcacagggtggtgggggacagcaggtgcacgctggtgagacacctggtgtgcagacagaaacatggtggcatctgcatcgcaccacggccctcggaagaaggtggcggaaatcctccctgccatggcagatgatggcccttctttggcatcagtccccgtcctcatggatgatgaatgggcagcgtcgtggagtggcagcaactgtctcctgagtggccctgtgcatctcccagtgccatggcctggtgcatggccaggaccatctatgtgcgaccaccagctgattatgtggacagcctacttcaatgtgcctacccatgtgctattacattcacatggagactggggcttacctgaactgagggcggatatataccagatcacatgggctggatggatgatgtcatcaacatcatgtggccacctggctgggtgaccggcagaagatttgagtgacgccatcgaccgaccaaccctgcagataccagaaagtgctgtcattggctacccccacgacatcaaaggagaggctgcctttgccttcattgtggtgaacagatagtgcgggtgactcagatgtggtggtgcaggagctcagtcatggt

SEQ ID NO: 493339 - DNA, 231 bp, Homo sapiens
ggtcgaccaacaacttagccttggcaacaaagcaatatcccgtccttacaaaacaaacaaacaaacaaacaaaaaaactaattggccaggtgtgttggtgcatgcctacagtcccagctacttgggaggctgaggcaagaggatcacttgaacctagggagttcgaggctacagtgccctatgatggcaccactgcattgaagtatgggtgacaagagcaagaccctgtcc

SEQ ID NO: 493340 - DNA, 140 bp, Homo sapiens
tggatttccatttttaataaaaaaaaaattttatttatacagaattaaccttctctgtatatatgtgcataaaggtggtgggtgctaaattcatactaaacaacacttatattctcaataaaggggagtttgaaacattt

SEQ ID NO: 493341 - DNA, 828 bp, Homo sapiens
atcagtaggctgaggcacgagaatcgcttgaacccatggaggccaattgctgcagtgagccacgattgcaccagctgcactctaacctgagcaacacagactccatctcactaaaataaataaataaaaacaaacttgtaagagatgcccctcgattattttactaagtcgtggagtacagccattaagtttgaggtctacagctcagtataacgaacgtgactgtgtactgcccaaaaggcaacatattttgtggaagaaattcaccacggaattctttgggggctatctacttcaatacattgtcagtaggggagttatacccccttttataataacgttggtgttaacccgtacagtcttaaccaaggcattcttaatcccagtgaagtgccaccaccatttcaccctgtttcccaaacgtggtaccatagaaaataatcttgacataatcttcctatcacttggtcatcaaagtcctgtcatttttccaccctttgtaaacatctcttaaaatgtgtcctacgttcttcaccagacccttaattttaagctaccatcagcaccttttgcctgcgttgactgcaggttgtctcctaactgttcttcctgcagagaattcttggcccgtcccctgtatttcacgtcgagttgccatgcaggaattctccttttgcgttccgaaaggttcaatttttaatcaaggaaaacgcaagttaactttgcattttgcaccccttgctttaatatggctcgaatgggttttaattgggcccttaatggactgacaacggcacattttctgtgcgccactattttttgccgcat

SEQ ID NO: 493342 - DNA, 936 bp, Homo sapiens
tggcgctataacagctcccccccgctgtatgggccccttttactataatcggcgtcgaatcgtctcctccggggctgagccccccacgttctctagggccccgcttggacccgaaagtttttcctggaagaggagttaccgcctctggaaaaatgagccaaggttccaaaaatgctgccgtaattttagcgaatttaaagcataaaatttagagagaaatttaaccttacgagagttccctcgggaggaaaaataaaaggttttttaaacacacgcggaggggtgaatataaaccttctcttcctcgggggttaaaaaggtgagttgaaagaagattttagagaaaggactttccggcccccggtataatccccactttggaaggcgccaatgctcttttatgaaagttaaaattaaagggtaagcctttaaacacgcagtaaggttataggttgtaaaaggtgtaaggggggagttaaaataaatttgtaagggccgagtttctttttaaataagagagttttacccccaaggggagtttaaaacgcccctggaaatcacccgtccccacgggagagaagttgctgtcacttttaaacgctatgttgtaacgcacttcttcttgaccgccgagcgcgacaactggtgaacggaaattattggtggatagatgtgtaataggagttgagaacacctttgtgagaaaaaaaatagatagttttgaagtgggaaaactgggaagacacgaaatataccgggaaggtcgtaataaaaagagaataataagagaagaatatatgggaaattatataaagaataataaaacacaatcctttatagataaagaaaaaagaattaaattttaaacatcaaaattgggaaccaaaaaaaaaaaaccaattgggaaccaaaaataagggccaaaattaccaaaaa

SEQ ID NO: 493343 - DNA, 215 bp, Homo sapiens
gtttcaattcccacgttacttataaagaagcgttggtgaattttcacaaagctattttttgcgagtattttttagagtatttttaagaatttcacaagctatttccctcacatctcagggagctgagtaacaccatcgatcatgatgtagagtgtggttatgactttaaagtgatagtggtttatatgtgctataataaagagtgttctgcaaaa

SEQ ID NO: 493344 - DNA, 614 bp, Homo sapiens
ctgcggtgatctagagtgatccccacgagtgcacacacacagaagacacaacatccaaaaaaggagtgtgcgtgtgtgtggaataaccacccagccgcttgtcacactgccccataatctccaatggacttttaaaaccaacaaaagccgaaacggtggcccagaggctgctcctttgttatcccatgctttctaattcaagtcgaatgactgctttggtcacacttttttagtcacagtaaaaaatcacgggcgccctctggcatgcatgacatgcgataatcagaaaaggtaccactcccgtgttttttgtttctgaatatgtctgttcacggaccacaagggcatgggtcaccaatccgaagtggatgggactaaaccattgcgccttagaggccctcaattcaactacgaaccctttaacagcaacagcattaatatacgcttttggagctggaattaccgcgggtgctggcaccagacttgtcctccaattgttactcgattttggatgggtttaaatatcccccattgaaaacgacaatgcaaaagcactgtcggctctatttcttttcgctgcctcatcttattatttagaactagcgcaattcgcc

SEQ ID NO: 493345 - DNA, 131 bp, Homo sapiens
  misc_feature (11)..(11): n is a, c, g, or t
  misc_feature (17)..(17): n is a, c, g, or t
  misc_feature (31)..(31): n is a, c, g, or t
  misc_feature (53)..(53): n is a, c, g, or t
  misc_feature (91)..(91): n is a, c, g, or t
  misc_feature (103)..(103): n is a, c, g, or t
  misc_feature (114)..(115): n is a, c, g, or t
  misc_feature (119)..(120): n is a, c, g, or t
  misc_feature (126)..(126): n is a, c, g, or t
aatgtccttangtggancagggggtctgaangtacacctggaatttactgagnaaacttgtttgtaaaaactataagttaataattaattncattttcttacnaaaatatattnngggnnaattgnatact

SEQ ID NO: 493346 - DNA, 145 bp, Homo sapiens
ccccatattatgaggatatgcagtgtttctcggtgtctagggaaaaacagagacccacgttcccagacagcctggagcagaaaataggccgggtaagcaaaaaactagagttattaagagagacggacttatagacgtgaaatgt

SEQ ID NO: 493347 - DNA, 437 bp, Homo sapiens
  misc_feature (145)..(145): n is a, c, g, or t
tgtggaagtttgaacttgagagtgatgattttagggtatctggcagaaaaaatttctaagcagcaaagcattcaagatgcgccctggctgctttcaacaacctatggtcatatttgtgagcaaagaaattatgttaagttggaantatatttacaggggaagcagagcgtaaaagtttggagaatttgcagccagctatgtggtagaaaagaagagcccattttcagggaaggaattcaagcaggctgcagaaatttgcataagtaaaaaggagccaagtgctaatggccaagaaaatggggaaaaggccttgaaggcatttcagagacctttgtggcagcccctccctttcaccccaaggccaagtttaaaactgtgcattttgaaatcttgcaatgttgatgatgtaaaataaatcttttttcctgtgtttttga

SEQ ID NO: 493348 - DNA, 355 bp, Homo sapiens
caatggggtcctaaggccatagtcttgctccttaaagcccaagtggcttgggaccacctacaggtctcttgttctccaggaacaagaatgctagaatgggctactctcgaggcttcaggacctggttggagagcttgttttagaactagtatatttatttcttccccaagtatgttttactgcctgtgaaaagtccaaaaagacaatctttatataaaaatggactgtgttgacagcctcttccctaccttgggcccttgataaatgtttattggctgaaaatcggatgaatactgaattttaatggatctcaggtcttgtactttttttcccccttttatgctccatggaggtt

SEQ ID NO: 493349 - DNA, 328 bp, Homo sapiens
  misc_feature (144)..(144): n is a, c, g, or t
tgtacctgtgggtatcatcaactaaggaagggtcccaggttggggagagccccaagcttgagaacaagtaagtgaacaattagttgtactgaagccacttgttacgaaacagctagatcacaaacaacctgtgtgtaatatgtnttctcctacacaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttactacctgcaaaa

SEQ ID NO: 493350 - DNA, 117 bp, Homo sapiens
catggatttgctggtgcagtacaactaggcttaatagggagctcgaattcgaggctcgaattcgagattcaagcttctaacgttagaagcttgaattcgagcagtagtagtagtagg

SEQ ID NO: 493351 - DNA, 964 bp, Homo sapiens
  misc_feature (209)..(209): n is a, c, g, or t
  misc_feature (233)..(234): n is a, c, g, or t
  misc_feature (236)..(237): n is a, c, g, or t
  misc_feature (963)..(964): n is a, c, g, or t
cttttaaatatattttatatactgagtcattctattaggaaggatcatattatatataaaagaacatcactgctgttgatattatcaaattatttatacaaatttctgtggttcatttttaataaggtcctaaaacggagacatcctgctctcaagaggtgctgtcatcttcctttcatgtagattttcggggaaagatttactttatngaaagaagaaagggccgggcacanngnntcacgcctgtaatcccagcactttgggaggccgaggcaggcggatcacctgaggtcaggagttcgagaccagcctggccaacatagcgaaaccctgtctctcctaaaaatacaaaaattagttgggcatggtggcacacctgtaatcccagctacttgggaagttgaggcaggagaatcgcttgaacccaggaggtggaggttgcagtgagccaatatctcgccattgcactccagcctggatgacagagcgagactcaggaaaacaaaaaaccaagggagaacgctttggtagctctggttattaaacacttaaggtgattgggattaaccaaaaggaagttacatcaaccctccttcaaatttggccctgtgggcttcatttttagaagatgttcccggtaacctgaagggaaattcttttggcccaggggaataacttggaggattaagcagttctttcacacatcatggagagcggacacattaaagcacgtgttcaaaatgtcacatttaacctcgggaattcactgacaataatttaacccagaatgccttcttcacacattgataaaactatcaaggtttattacctaaaggaatcacactccggaagcgcagcagaacagaaataaatccgtggaaaataagtttaacatttaacacggaaaggatataaaatcagacacaaaagaaacaccttgcaatatgtctctattatataccnn

SEQ ID NO: 493352 - DNA, 122 bp, Homo sapiens
gattttatttaaataaattcttataacaataaaaaattaaccctagggtgggggtgcacactaataatcccagcaactcgggaggctgaggcacaaaaatcacttgaccccaggaggtggag

SEQ ID NO: 493353 - DNA, 143 bp, Homo sapiens
  misc_feature (22)..(22): n is a, c, g, or t
tgggggcccccgggtcccttgntgggggggaattttccagtttttcctccgttttccaggggccgctttttttataaaaaccctggtcattgaatttaaggccccccccaagtccagaatgaccttgcaagaccctttattca

SEQ ID NO: 493354 - DNA, 358 bp, Homo sapiens
actgacccgggcctcccctgtgtgaggaggacacgcctgccctggtcgagaaaaaatggagctaaaaagcccgtttcgctagaagggagcgaccaggcaaaataggtattaccaatgagaagacccgcttaaaaacaaggttatggtcagactacggcttataagacaccctgacatattcagttgacactatgccccaacaagctacagctatggatgtcgtttaagcactaataacggcttactcaaggtaacctggctaaaacctgggaatccaggaatacgcaatttcctgagaatttggacaaacaatggtacaagcttatacacaaagtgcacttgttcaattgtctgtgtt

SEQ ID NO: 493355 - DNA, 558 bp, Homo sapiens
  misc_feature (44)..(44): n is a, c, g, or t
  misc_feature (73)..(73): n is a, c, g, or t
  misc_feature (176)..(177): n is a, c, g, or t
  misc_feature (233)..(233): n is a, c, g, or t
  misc_feature (238)..(239): n is a, c, g, or t
  misc_feature (244)..(244): n is a, c, g, or t
  misc_feature (250)..(254): n is a, c, g, or t
  misc_feature (287)..(287): n is a, c, g, or t
  misc_feature (301)..(301): n is a, c, g, or t
gttttatttcatgtgtgtggatttagtactgatatgtcatagtngtgcacgttttagggatacatatgttatnttgatacatgtatacaatgagtaatgatcaaatcagggtaattgggatgtctatcaccttgaatatttatcttttctttgtgtcgggatatctattttaaatnnccatgctcgtcacctatgagactggaaggacaaaaaaatattttaaatactcgtcnttggnnggatntggacnnnnnggctctcatatactgttgatgagaatgccagtnggggcaatattttnggaagttaacttggcaatacttatcaaaattctaaatgcacattcttattgaccaggtaacataacttttagggatttatcttccagataaactggcacaaatacaaaatgatatatgcacaagtgtgttcactttagcattgttataatagcaaaattatgggtgcaatttgtatggttgttgataggagagaagtggataaatgatggtacttccatctaatagaacatctgacctttaaaaagtgtcagggtag

SEQ ID NO: 493356 - DNA, 330 bp, Homo sapiens
gattataggcgtgtgccactgcacccagcctgagttaaatgtttttaagatgagcttaacttgttcagtaacaataaaataatgtattttgattttttttttcccctggaaagtatgttgtcagtgatcatggaaaggccttgggatgcggtgtacatgctttcatttgttttgttttcatgccttcaaataaaattttaaaactatctgggccgggcatggtggctcatgcctataatcccagcactttgggaggctgaggcaggtggatcacctgaggtcaggagttcgaaactagactagccaacatggtgaaaccccgtctctact

SEQ ID NO: 493357 - DNA, 706 bp, Homo sapiens
  misc_feature (580)..(580): n is a, c, g, or t
  misc_feature (644)..(644): n is a, c, g, or t
  misc_feature (694)..(694): n is a, c, g, or t
gaatgtaataaagggtattcaattaggaaaagagaaagtcaaattgtgtctgtttgcagatgaaatgattgtatatttagaaaaccccatcatctcagccccaaatctcctttaactgataagcaacttcagcaatgtctcaggatacaaaatcaatgtgcaaaaatcaaaagcattcctatacaccactaacagaaaaacggagagccaaatcatgatgaactcccattcacaactgctacaaagagaataaaatacctaaaaatacaacttacaagggatgtgaaggacctcttcaaggagaactacaaaccactgctcaaggaaataagagaggacacaaacaaatggaaaaacattccatgctcatggataggaagaatcaatatcgtgaaaatggccatacgtcccaaagtaatttatagattcaatgctacccccatcaagctaccattaactttcttcaaaagatttggaaaaaaactactttaaaatttatatggaacaaaaaagagcccacatagcccatacaaatctaagcaaacaaaacaaaacataacatacaaactaaatacaacanaaaaacataccttgcagcattacgctacctgacttcaaactatactacaagggcacagtaacanaaacagcatggtactggtacccagtattatagaccaattggaccagacanaggccttgtttt

SEQ ID NO: 493358 - DNA, 409 bp, Homo sapiens
gccattagccgacatacaccatctgctgagactaggtctactcaaagttgttctgaatgtattaaatataggtcatgctgagccactttaagtcattgatactagtcatttatttacctatttgatgctcccttaactttttttttttttttttggaaagggattttcgctcttgtggcccaggcgggagtcaagggcacgatctcggctcaccgcaaccctcgcctccggggttcatgcaattctccgtgcctcagcctctccaagtatagtagggattacaggattgtgccaaccacccccggttaatttggtatattaagataaaaacggggattactccatgtgggacaggagggatcaaaaatcccgacctcaaataatctgcccgcctcggcctcccaaaatg

SEQ ID NO: 493359 - DNA, 250 bp, Homo sapiens
  misc_feature (1)..(2): n is a, c, g, or t
  misc_feature (11)..(11): n is a, c, g, or t
  misc_feature (14)..(14): n is a, c, g, or t
  misc_feature (17)..(17): n is a, c, g, or t
  misc_feature (20)..(20): n is a, c, g, or t
  misc_feature (25)..(27): n is a, c, g, or t
  misc_feature (31)..(31): n is a, c, g, or t
  misc_feature (33)..(33): n is a, c, g, or t
  misc_feature (36)..(36): n is a, c, g, or t
  misc_feature (39)..(42): n is a, c, g, or t
  misc_feature (49)..(49): n is a, c, g, or t
  misc_feature (57)..(57): n is a, c, g, or t
  misc_feature (73)..(73): n is a, c, g, or t
  misc_feature (95)..(95): n is a, c, g, or t
  misc_feature (119)..(119): n is a, c, g, or t
  misc_feature (162)..(162): n is a, c, g, or t
  misc_feature (164)..(164): n is a, c, g, or t
  misc_feature (193)..(193): n is a, c, g, or t
  misc_feature (208)..(208): n is a, c, g, or t
  misc_feature (210)..(210): n is a, c, g, or t
nntgcctttanccntcnagntttgnnnggcntnttnccnnnntttttanaatttttnatcaaatttatggtcnttatttcctcaaatacattttntgtcccagtatctgtctgggcttntggtgacactccaattgcacatacattacaccacctgccattntntcccaatcactgacgatctgttcattccntaacaatagtttttntntatgtgctacagtttggagaatttctactgacctgtcttc

SEQ ID NO: 493360 - DNA, 222 bp, Homo sapiens
tagctactgtataataggtaaatagtgtatgttggggggcaacagtttttatcctgttccctactttgttactaagtgcaaaagatggaaagcattgtcattcaaaattgaagtccaagcagaaaaaaaggactactcaaattgaaaaggcagtgcttagttcagggatgcttcaagcttatttgggttctctctccccacccctgtgttcttttaaagatt

SEQ ID NO: 493361 - DNA, 324 bp, Homo sapiens
agaaagcagaaatccatgaacacattgcttctcggccttttggctaagatcaagtgttagaaatccatgaaccactaaagggacttcattgattttttccagagagtagaaaaccacctttaggttttgctttttttcctgaatgcgtcataggcttgtgagtgattttttgtccattccaattgtgccttctttgtattatgataagatggggggtcctcaggagatcacaagttgtgtgaggattgcattaccaaccttatgagccttcaatgggggaggccagaaggtggaagggggcctgcaagttcatatggtgggttt

SEQ ID NO: 493362 - DNA, 539 bp, Homo sapiens
  misc_feature (64)..(64): n is a, c, g, or t
  misc_feature (149)..(149): n is a, c, g, or t
ctacttgacctgcccgggcccataaaattggcccaggccttgttgctgtctctgccccagcgantcaatgacagtgccctcagggccctgacactgcccattgttttcaagaagtatgggcctgaagccctagcagggaaccaagcctncccctcccttttagaagcccaagaagatgtcctcctgctagacgcgcaggcccaggttaagggctcagaagatgcagccaaagtggaaggtgggggccagacccagcagctgagctgaccccccttcagggcagtagcccaggagagatgtttgtgctgatttttatgccatcccttctggaagtgatgcccccttagaagctgccacttagagagaagcaccaaacggagaagccggccttgtgttcccccaaagaatgaaggaggatgtaaagttagaaaattgccagagaattttgaagactttaaaaagcccccccctttagctttttttcttggacagaaacatattccctgctttgaaataaagggaagggctctcctgtttta

SEQ ID NO: 493363 - DNA, 380 bp, Homo sapiens
  misc_feature (27)..(27): n is a, c, g, or t
  misc_feature (29)..(29): n is a, c, g, or t
accgcaaactcacatacaagatatttntnttttaaaacagcatacctgagacaacagtgaacagcgttatcgcctacttggaaatagtctcaacgtgcatgtagtagctaaactaatcaaaccttatatgaataattttgaaataactctgaaagatggtcatatgatttttcttcatttacagagacgcaaaatgaaattctgttttgaactaattctggtgaaaatgaacataaataatttgaatctgtccttattaacgaaattcgattttattccacaaatccatgtgcttcataatttttatttttcagagtcaaaacaaatactaactattaaccatactggggggccccctttactaaactcatctcactttc

SEQ ID NO: 493364 - DNA, 107 bp, Homo sapiens
  misc_feature (4)..(4): n is a, c, g, or t
  misc_feature (7)..(7): n is a, c, g, or t
  misc_feature (60)..(60): n is a, c, g, or t
gganaangtggtccaggagagtttcccagagctgccctcagaggagtgaaagggacattnggctgaagtctttctctgaaaaagccaaaggttatagggtacactta

SEQ ID NO: 493365 - DNA, 829 bp, Homo sapiens
taaaagggatcgaaaaaatttcggtcccagattattttgtcaagcacaaaactgcccccccttcttaaccttgccaatgccccgtgctgatagccacaccatctctttgcacatcctcctcgtgtatttgatcgcctagacattctccaggaccttttctaggctcttatttccaatccccccttttttggccctttcgtcaatttctctctgaatttcccctgttacacctgggtatctgcattttgagtcagccgtgttgcactaagggtgtaacctctgtcgagtcccccctgcgcgcgctttatattcatctctttcacgcccagaccaaagccctatacacactatgcgggtcaaaccacccaaacctgtatgtgcaaaagtcggtctagccccaataattatgcgggaaacaacacgtttctcctacataatgatatattcaccctttttccccccaagcttgtcttttacaccctgttcattctgtctatacctctcattacccctctgatacataggcggggcaccattatataacggggcaaactgcggtgtttctaaaatttttctgcaccagcatgcttcttgtaatgcacgctctctctccccatccccgtagcaccccttggccctctctccggttgattcatattagaggactatacaatcgtccttagatctggtcttatgacagcaggagttgtctgcctgtgagtgcccagcacccaccacgggggtggttgcagcgggtgcgaaacgaaaaaataggaaagaccatttgaacggcgaacacccaaattattctttttctttctacaaaaca

SEQ ID NO: 493366 - DNA, 418 bp, Homo sapiens
  misc_feature (94)..(94): n is a, c, g, or t
gaaagtgggtttccggcaacgaatcacgaacatgaacatcaaagggattcggcatgggaaagggtccctcctgtgctggctggctgggtgtcanaacctggctcctggtgtgcagagacgtgtggccccttggcccaatctggtcccgggcgggggctggccgaatggcagggtgaacccttcgaagaactggtttgaacgggccggtcggtctggtccactacatccacaacaacaactggtaagcccacatccatttcatctatttctgagaagggccttaatggatccggttccattggcaaggcttcttttagttggtatctcttttggaatccatggcttggggtggtaacagggtctcctcttaaaaaataaaaagctggactccttagagacatcaaaatctaaaaaaaaa

SEQ ID NO: 493367 - DNA, 304 bp, Homo sapiens
gagcttataagagcatacccctcacagctggcattatgtagtcaccccagaaagcatgggtctcaatgagcccacagtcatacatagctagtaatctttagctttattacatggaattaacaggagacagatatttccccagtacagccagacaagcacttggcctcttcatccttaggcctaaggtgtaccgtgagctcgtgagctgtgagaacgagaatagtagcgttttgctcagcccaggcactaacagctgtgtgacttgtaggggagtcactccacctcatctatcgagtaccggtac

SEQ ID NO: 493368 - DNA, 334 bp, Homo sapiens
  misc_feature (3)..(3): n is a, c, g, or t
  misc_feature (47)..(47): n is a, c, g, or t
  misc_feature (87)..(87): n is a, c, g, or t
  misc_feature (159)..(159): n is a, c, g, or t
  misc_feature (197)..(197): n is a, c, g, or t
cangggaagccctgctgttgcctgccagctgaactgggagcaataantttggcacccttgaagagaaaaatttacctcaactttaanttttcagtcagaatcatgaaagttgaatcaattgagatgtctacggtgttggctactgtttctgctgtgaantgttggtcctttttagttcaggcatgaacaagattacnttttcctcacaaatttatgtggatggtctgccagtgtgggcttcatcttttacatcatctaataccttcttaaaacaagttacccatttataagctgctaattttgggacgtcattattctataaacttttcataaa

SEQ ID NO: 493369 - DNA, 158 bp, Homo sapiens
tggagcgtgcttggtggcgtgcttgatgctggtccctttggatcgtggtgatttagggggtgaactcatgggaacgggatgctggcttgtgtaatcttactaggagctattagaagggctaggaccaaacctatccattcaacatagggtaccgggct

SEQ ID NO: 493370 - DNA, 119 bp, Homo sapiens
agcatgtgaacaggacacgcaagagcgtgcaagaagcctgtgaggtgaagaagggcaaagaccccaatgcccccaagtaggcccatgtctgcattacgatctgtgtgttcaatgccagc

SEQ ID NO: 493371 - DNA, 561 bp, Homo sapiens
tgcagcggctcacacctgtaatcccagcactttgggaggccatgatgggcggatcacttgaggtcaggagttcaaggccaacatgatgaaaccccatctctacaaaaaatacaaaaaattagccgggtatggtggtgggcatctgtagtcccagctactcgggaagctgaggcagtagaattgcttaaaccctggaggcggaggttgcagtgcaccaagattgtgccactgcactgtagcctgggcaaaaaaagagcaaaaccccgtctcaaaaaaaaaaaaaaaaaattggagtaatattagcagagattttccaaatttatggttagacaccaaaccaaagattccaggaagctttagagagcaccaggcgggataaattcggggaaaactcgaaaactcctaggcatattcatatttcaaacgggggaaaaagagacaagagaaagatttttcaaacgagagcaaggagaaaaccagttttttaccttattagaggagcaagagattaagcattacacgggaatttataagaaaaccatgcacagcaagaaagagagg

SEQ ID NO: 493372 - DNA, 1344 bp, Homo sapiens
  misc_feature (390)..(390): n is a, c, g, or t
ggagagagtctccttggatattagccgtcccaagatgccaggaggtggtggtaaatctacagtatgacgtatggcagcggtatgaagcgagaggccactgctagacgagctctatcaaggattgtgtgcagggagcgtaactcggatcctagtgatccacagggcgaaggtggccccttgtgcagaccctctccaaaggctttgaccttggtgcccttcccactctccgtctccgatcatcgtcttcttgtgaccatgaggaaggcctttcgcactaagccagctagccccccgcagcagccatacagtatcaccactatgtcggcagaatgggaggcgcggcttccatcagcatgaacttggcgcatatcggagctcgcatagtggtgnaaaacacctctctgcttccacttaggtagtttattaagcacaagtctccacattggattccatgacacaatcaacctataagactcagtcaatgcctttgactctgggtcgttggccaggttgtgttggctccctatccggggggcaacgggattgtgtgcgacgcttcttatagagcgtgaacagtgaagcttgtcgccagatgtagtggtagttggtgtaatggtcgctcgactggcttgattgcttattgagttgatgagtacatccaacaaacgattcaaactggccacgttagatacccgtctgttggtgtcatattattggcgagagccactcagggcgcaggatagcctacgggggaaggtacggctgaggagtacgactgcgcgggcaaaaggacggtgtgtgtatcagcgaacggcggccctaaacaaaaaggtacatggctcggaagggttggaacgcacccgtatgtgccctttacaaaacagccttgtggtgccctttgcttaacctatagattcgtgtcctaaggacagaacggtcctgatttgatcggcgccctcaatgagaagcgacaccggtcgaatcgtgggccgaagaggcacccaagcggacgagcataagagacacacgcgcggggggaggttgtagttacacaccacccccctatgcgtacagcaacatgtgggtcgggcatacattgaattcaacaccataatagtggcccgaaagaaggggccccaccaacgcctgcggacatgttcgtgggcgagaacaaccataggcaccccatttgtagtgtgccgcgagagacgaatgaaaagacaacccgcctggaaggaaccggaaactggccgcaacaagtatcgagctgtagagaaagactcgcgggagcgtacacaccatacccagatgagataacacaccgccaggagacagaaatcaccg

SEQ ID NO: 493373 - DNA, 719 bp, Homo sapiens
tccaattgaactctgaacttttaattgggcctcctgctccccaaagggtaccctgcttctggcgggctaaatgcctcaaaatcttggtgggctcattgggctctcaaaacaccacctttgtgccactccaacatatctccgggcgggtgtggagtggcatctttggagagtggatatggcatgtgagaagatgagcgtgcgtgtcacagaggacattcatccgaagatttaagagatccgtcgaccatcttccagacaaggcggcgagaaagagtgggcgaacacctcagagcctacacagagctaagaccctctagatgtgtacaagaagggggccatcataacatccctggaggcacatggggggcagagtacaccatacttagccacgaggggatcctgaggagcccagagatctgagaccctacaaggggggagcaagaaaaagaaaacacccgcagagatagaaagcgcagtggtcaaacacaaatacatgtagggtaagagggggcagaataaggagagggagaccccctccacaaaccactcccccacagaaggagcgcgaggaatacacactcacaaaagcgcgtgggcaaccattaacaagaaataagcccatacagtgggaagacacacaaggggtagaaaaccctccagggggaacggggaaacgtggaaaaagactcaccaagacctcgagggaaaaacaagataga

SEQ ID NO: 493374 - DNA, 288 bp, Homo sapiens
ggggcggtggctcaatgcctgtgctcccaacacctttgggagtgccgaggcgggagacacatctgaggtcagggtttgaaccaggccagccacaaggtgaaacccatctctacagaaataagaaattagcttgggcatgctggcgggtccctgtaatcccagctcctggggaggcttaggcagaagcattgcaccgcacccaggagggcggagggttgcttgtgagcccgagcccacttgcacttccaagccctggggtgaccagagcaaggactccgtctcaaaaaa

SEQ ID NO: 493375 - DNA, 596 bp, Homo sapiens
  misc_feature (460)..(460): n is a, c, g, or t
  misc_feature (514)..(514): n is a, c, g, or t
gttgtggatcatagcttgctgcaagcttgatttctggctcaagtgatcctcccatgtcagcctcttgagtagctgggactacaggtgtgcaccaccatgcccagttagtttaacaaaaaaagtttttagagatgggatcttgctatggtgcccaggctggagtgcagtagtgagatcatagctcactgcagcttcaagctcctggcctcaagcgatcctcctgccttggcttcccaaagtgctgggattataagcatgagttagtcctctgcttagattttaaaatctcaactccactcccttctatgtgcgtaaacaggggaagtactgaatttccctgagccttatcgtactcatctgataaatggatctaacagacctcccttacagggaatggactggggaggctgactctgtcaagcactaagcacagtgcctaaagcatcagaggcatcctttntttaagacgaagtctcactctattgcccaggttggagtgcagtggcacgatctnagctcacagcagcctctgcctcctgggttcaagtgatccttcgtgcctcagcctcccaagtagctgggactacaggtgtgca

SEQ ID NO: 493376 - DNA, 347 bp, Homo sapiens
attgctaactcataataagtatataacccgtggaatgtgtatgcatttgttattagtgcgtgtgcatttgtagtgtgtgtgtagtatgtgtctgatctgtatgtgtgcctgtatatgtaagcatgtgtttctgatctgtgtgctcaaatctgtggtgtgtgtatatgcgtgtgtgtctgatgtgtgtgcatctgtggtgtgtgtgcgtgtgtgtgtctgatctgtgtgtgtgcatctgtggtgtgtgtgtatgcgtgtgtgtgtctgatctgtgtgagtccatctatggtgtgatcgcgtgtgtgtgtctgatctgtgtgcgtgcgtctgaatgtggaggtagcaca

SEQ ID NO: 493377 - DNA, 1583 bp, Homo sapiens
  misc_feature (36)..(36): n is a, c, g, or t
caggtgcgccccgccccctgcctgcccggccacctncgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccacttgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaat

SEQ ID NO: 493378 - DNA, 1097 bp, Homo sapiens
ggcatggtggtgggtgcctgtgatcccagctacttgggaggctgaggcaggagaatcgattaaacccaggaggcagaggttgcagtgagctgagatcgcaccattgcactccagcctgggcgacagagtaaggctctgtctccaaaaaaaaaaaaaaaaaaaaaaaaaagggaaaccctttggattttttttcccttggcccggccttcaattccccacattggccgcccaatattattcccagttcttctcctttactccagcctttcaactcataggtgctaactggatttaacagtatttctacgaatgaccctacctcgtggtgtgtgctgatggacactaaaagggcatttcagaaacggtctgtggcccagaagcgtgacccttcggcactcttagaattttttacttctggacccgtctctacaagcggactattacacacgtttcgcacccatcaattcttggtcccggggggtttgccacgggttcgtgaaaccccgcgtggaactttatttcccaccaaactccttgtggctccctccccagtgtgcagaaaactcgtgccaccacatcgacgggcagggacaccgtgcgatgcttttatatcaggttcattccgaacaacggagatctctcttgcccccaggtgggtgcctcgacatcagcgcgacgatcgtctcgactgtcacaccctgccagaccccgtggggatgacgacggactccttcgtggcacttagggcaccccagtgcatgcgagggcatcacaggcgctgctgaccagtgcacgcgcctgtgggcgcagacgcaagtattcgattccgtgtgcagtggtatatacacccaatggcttgaagtattggacgttcccaccgagtgaaacggcctgcccgcttacatgtgcaccacatgtaatgtcgcgtgcccttacgctgggtatctctgagttctttctgcgtaagtacaccgtacttgacccaccttgccgcttagttcagccattcgctacatcagcgacattctggattgcaccgccggatcgagcccacaacacaaactacgcctgcgccacagtgcgctacgtcgcgggaa

SEQ ID NO: 493379 - DNA, 1686 bp, Homo sapiens
  misc_feature (36)..(36): n is a, c, g, or t
caggtgcgccccgccccctgcctgcccggccacctncgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccggagcgtcggcacctgaacgcgaggcgctccattgcgcgtgcgcgttgaggggcttcccgcacctgatcgcgagaccccaacggctggtggcgtcgcctgcgcgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccacttgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaat

SEQ ID NO: 493380 - DNA, 188 bp, Homo sapiens
atcgctgtaatacaccagcgcgagcattttccgcatatgtacttatcagtggcagagacacaacaaaaaaagaaaatttcaggccacatatccctgatgaacattgatgtgaaaatcctcaatacaatactggcaaatcaaaaagcttatccaccacgatcaagtcagcttcatcgctggttattccg

SEQ ID NO: 493381 - DNA, 537 bp, Homo sapiens
gagcccaacagcaaactcatccaccgggatcgagactgggaacgggagcgcaggctgccctcctccccgctccctcccaggcacctgaaagcaatgagccggagcagacccatgactgtcagcagtcggcaagacgaagatgagccggaggcgatgcagacagagttccgtatggataaacccagcaggtgatgggagtgctcagggggagggagtcatagcaacatcctccatcacaggagacatatgaccaccatggagaacagtctcaagtccgggaagggggcagctgccatgatcccaggcccacagaggggcacggaaatccgtctctttctccgatcatcgggaaagatgtcctcaccagcactacgggccacggggaaactctaactcacacaccagtcacaagggaaagggggttctgaaaggatcaaagcgatctcatacgggtgagattcgacagacaggccggttggcatcggaggccaatgagctctgatatgctgtaccaagtgtgttacgagaacgaccatc

SEQ ID NO: 493382 - DNA, 1538 bp, Homo sapiens
  misc_feature (3)..(3): n is a, c, g, or t
  misc_feature (8)..(8): n is a, c, g, or t
  misc_feature (12)..(12): n is a, c, g, or t
  misc_feature (21)..(22): n is a, c, g, or t
tangctangtanaggccgggnnttaatcggcaccgagggcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccacttgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaat

SEQ ID NO: 493383 - DNA, 379 bp, Homo sapiens
aaacgatggggtggataatgtcctgtagatggaggagctggatggaatgtgtccgtagagtgaggagctggatagaaatgtgtccgtagaggaggatgctggattgaaatgtgtccgtagagtgaggagctggatgaaatgtgtctgtagaggaggagctgaatgaaatgtgtctgtcgaggaggcagcgggatggaatgtccttgtagaggaggagctggatgaaatgtccctgtagaggaggagctggatggattgtccctgtagaggaggagctggatgaaatgtccccgatagcaggcggcagctggatgaaatgtccccgtagcaggaggagctggatggaatgtccctgtagagggaggagctggatgaaatg

SEQ ID NO: 493384 - DNA, 1410 bp, Homo sapiens
  misc_feature (36)..(36): n is a, c, g, or t
caggtgcgccccgccccctgcctgcccggccacctncgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccacttgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaat

SEQ ID NO: 493385 - DNA, 149 bp, Homo sapiens
gtagagacaggctcaagctagccagacagtctgtatagctttaccagtgcttgagcagtgtcctctcttcagcttcttctagtgctgttagtagtatcccaggcattagtcacatcgcttgttctcctgtccccttctgtcgtcttctc

SEQ ID NO: 493386 - DNA, 131 bp, Homo sapiens
tgacgatccctactcagacaagttgaccgtgagggtatcatacttgttggttgattgtcgatcttgggctgttaattgtcagttcagtgttttaatctgacgcaggcttatgcggaggcgaatgttttcat

SEQ ID NO: 493387 - DNA, 288 bp, Homo sapiens
caggaatcagctagtactgcatgctattcgtgggtacttctaacatttctttggaacacagaatgtgtgtcgttgccatataaacagcttggaagcactgtgtctcgtggattgtggaattgctgtactgtgactgggcctcccttacagctgctcttaccaattcctcttacgaactcttattcttaccgtctttacctctgtgattttttcccctaaacctcacccatctctctcccgtttccagattgcttaaaacctccttatggcgtgtggcatgtgacgata

SEQ ID NO: 493388 - DNA, 213 bp, Homo sapiens
cggattggcagatcccaccattgcattcagcctgagcgacaagagctgaactccatctttggaacaaaaaaaaaaagtacaggctcgggggctcatgcttataatcccagcactttaagaaggccaaggtaggcggatcacctgaggtcaagaagtgggacaccagccgggctaacagggttagacccggtctctactaaaattataaaaaag

SEQ ID NO: 493389 - DNA, 205 bp, Homo sapiens
gctgcagtgcaacgttcagatttgtggctagaaggctccagagctccgtcgcgaaccactggtgtaagctccaatagtctaaaagctgaagatcttgtgagtctgatgttcatcggcaggaagcatctaccacaggaaaaagattagggccagaacactgagcaagtcagcttcttccaccttctcctgcctgctttgtctagtc

SEQ ID NO: 493390 - DNA, 381 bp, Homo sapiens
  misc_feature (106)..(106): n is a, c, g, or t
ttattactactaaatttgtggttgtgtcgactgtggcctgtcgatgcaaggttatgagttcaagccccaccaggagcaagtattctttttgaagcctctgcctgtntatttctattccggaaaatgataatttattcaatccatttaggagtacaattcatcggtaataggtatgtcattgagatgacaggtcagagtgcaggcagagatagaatacaaattcatagccttctgtatcaccagctgtgcagggtggcaagcctgctcgaaattccaagcagatggttgtttgcgaagtgagttggtgcttcggcagagaaaataatcacctaacgtggggctcgaacaaaagaccctgagattaagagtctcagtcgacgc

SEQ ID NO: 493391 - DNA, 203 bp, Homo sapiens
cttatttccttcttatgggggaaatacttaattaacagcagaatgatacttaggggaaatctatatcactaatgcctatatctcagaaaagaagataaatctcaaagtcattgacctctgctttcccctttaagaaactaggataagaagggggaattaaactctaagcagaaggaagaacatgataaaggttgagcagaatt

SEQ ID NO: 493392 - DNA, 364 bp, Homo sapiens
  misc_feature (288)..(288): n is a, c, g, or t
  misc_feature (305)..(305): n is a, c, g, or t
gagattactgcgattatcactttaagcaggatggatttcgggctctcttgcagctgcggccgctgaacgtactgagctaactctatatgctcgagctctactattataagactttctatgagctgtaggatctggatgagctcgatccgctgcacgcgctgggtgcttcgctgtaaagttcgctgtgcggttaatgcagtcctagcacccgcggcgtcgggcccacgattgggcttgatagactgcttaaagtggttaagggctagggatcgtgcgtagctgtagtgntctccaggcgggggctngcccggaaaggggccccggagtatgcacacccaccccgcggtaacaaagtcttgcgggg

SEQ ID NO: 493393 - DNA, 150 bp, Homo sapiens
aatcctcctcctccttcctcctgctgtatctttctttcgtgctctctctttctacagcctctctgtctagtctccttccctctcgccctcccctgtctctctcgatcgctgtctctctccctaccctcggttatctatactctccatcca

SEQ ID NO: 493394 - DNA, 151 bp, Homo sapiens
  misc_feature (33)..(33): n is a, c, g, or t
  misc_feature (104)..(105): n is a, c, g, or t
  misc_feature (138)..(139): n is a, c, g, or t
cagcgtcgatggtgggtgggtggtcaatccgcnggctgccgacagcagccgcggctatttcctggtggacgaggcggacgccgcctcccggcagtttcagatcnngccgctcccgccgggtacctatagcggaatcgnntttctggtcggt

SEQ ID NO: 493395 - DNA, 978 bp, Homo sapiens
gccatatgcagcgatatttgggagttgatccctcggtgtcctgcctgggcgcacgctgcggtaacctgctgtctgtgtcctgtgagtcatgcgggtcagcgcagattgtatatccgctgacggattcctgtcccttgactgtccagtgatgcctgcggttagcgatccggggggcagcgagcagacggcgggaccccaggtgcccagtgacagtgtccgcaggtacgtgaggccactgtgggatctccctgcattcgggattataccgagaagctgaacgattgtagatgtagcctatagaggagaactggcacactcaaatgatgtttaccctacctgttggcaaccgatgagtccaaattcatgcttgctgacgaccttgcggacatagtgtcttttcgaatatacacagcaggaagttactgggataccgtctttcgcattggcggaggtctatttccacaaattggagtcgcagggatgttggttacctttgtagtggcgcgacgggtcgtgaagcaaagggccttcaccgccaggaagcggcgagttgcagagggattgctcattggtgtccaccgagcacactcaggggtgaaccttgatttgggcgctgaatgagtatttcaccgaagacaggatcgcccacagggttcaatgcgtgtgtgtctcccgtacctgcgtaccccgaaggctgtgcagtgacccaacgggtggaaagttggtggacttggcacgctcccttgcttttaagcggaacgcgacgctatccaactcgtttgtcccgtgcgaggctgcccaggaaaggcaaatcatggggatgtgacaccaaagaatcatggctaaactccaccacaatggtaggtcacccttgcgctaagatgacggcatcagacgagagacctagcgtgtggcacagtgagcctggggcgacctcctcgtatccaagcacgttggcaatgctcatggagttccacc

SEQ ID NO: 493396 - DNA, 126 bp, Homo sapiens
acctctatacggagccatattataactttatgcagtctgggcattcaggtgtgagccaccgtgcctggctacccagctagtttttaaaattttttgttgttgttgagatggagtctcactctgttg

SEQ ID NO: 493397 - DNA, 439 bp, Homo sapiens
  misc_feature (37)..(37): n is a, c, g, or t
  misc_feature (139)..(141): n is a, c, g, or t
  misc_feature (240)..(240): n is a, c, g, or t
  misc_feature (251)..(251): n is a, c, g, or t
  misc_feature (335)..(335): n is a, c, g, or t
  misc_feature (347)..(347): n is a, c, g, or t
  misc_feature (352)..(352): n is a, c, g, or t
  misc_feature (357)..(357): n is a, c, g, or t
  misc_feature (359)..(360): n is a, c, g, or t
  misc_feature (363)..(363): n is a, c, g, or t
  misc_feature (423)..(423): n is a, c, g, or t
accattctttccacttttagacctcctttagaaatantttattgcccatcctgaactaaagcactgacaaaaaaatttacaacaattatcagataatgtgcttagttcctggaaagttataaaaagatatatgtaaaannnaaatcctaagccacaaatattttatagagctaatacgggtcatgttttgttaggtacagtatctacggggttattacaaaatatacttttttataaggnttcttgtggtnaatgggctctcaccagagtagagtagtttagaaaagccatttcaaacgttttgcgattctgccttcaagtaaggggtaaaaggnaaatggcgtggnttgtngcgcngnngcntatactgtgcgggggttggtctctgcccctttctttcctggtgccctccaccgggcctgnttaggggcgatttctc

SEQ ID NO: 493398 - DNA, 1095 bp, Homo sapiens
ggctcatgagtaacaacactgtcggagctggacaccaagatccaggagaaagccatgatgtgtggatatggacatctgccgccgcatcgacatcaccgccaagctctgcagatgtggctcagcagcgcaactgcgaggacatgatccagatgttccagaagaagcttggtcccatccatgggtgtgggctggaagcgtggagctgcaaggctgaccgtctgacggatggacacctccctgtctggagagtgatgtggtgcccctgacaagccctgatggggatgaggacggagagcacagacctcaagaatcaacgaggcagatgcagcgcatgctcaaacagctgagggagtatgattatgaggacgaatgtgacagactgacttgggaggagactgaggagaacctgctgatttgaggaggataactcaggctatgccatggcaagatgcagaggcccatgggagagcagcaagtgaagatagccatggagaaaggtgattaaaggataacgagaagtcccatgatcaaaaaccgaggagaaggaggtatcaagagatgaccattgagcagatagagctggaaattggacagtgcaaagaacgaaatgatacggaaatgcaagagtacatggagatgtgaagatgaagctgatggccttggacagtgcaagattggcagaactagccgacaagatcatcagccagatatgtaagaccgaacagtatccatgactgccatgacagacccgaaaaaagaacagacaacgactgacaaacaagcctgagaatccgaaacgcaatgcacaatatagaagtacaatagaaacaaacctagcaacccacattagacaagaaggccaacaaaagcggacacacagagcaacacgagcgacaaagaacaaaacgaaacactcataacagagaaacatcagcaagcaggcctgaagcacaggcagacacacacacaaagaagaacacaaacagaagaccaagccatagcgagacccacacacgcagcaccactatgagcaaaacaccacgtaggaagaaagaaacataagaaagacacaaagaagagccggagagacaagaa

SEQ ID NO: 493399 - DNA, 1204 bp, Homo sapiens
ttcgaaactggacaggtgtcaccactggcgccacatttgtgtgagaacattctgggaagtttgtagtctcccaaagcggggggcacccaggggctcccccgtggggtccagtgttgcacccagttggtggttcgcgcgtggggaccccagtgtgccctgtcgagaaccggattttaggtccaaggagtagccccgttttttaggaccaccccaggtgtcttcccagttgttaaaacctatttggggaaaaaagctgccccccccgtggtgcgccaccccagagggttttataaaaagtgaatgtgacacttttggcgttttttttgcccgagagtgccttttggttgtttatctataagggaacctctttgtgggggaaaggagacacccacatgcgttataaccccccggtggagccccacttttgaagggaggagatgccccccccctgaggccccctggtgctatgtgccccccccattggagccccggggagggtttttggtcccccttctctgcgtctcttgtctttggccaagttctaaagggtctcacactgggcgtatcattggccctttgcggggggctttctaaggtgcacgtgtgccaccctggggaaagacccgagaatggggtaaacccctcgcccttggtagaaatgtggaccaaacactggtgtttcctcgcccgtgaggcccccccaggggatttttctggggcttcttataggtttgggatcacaatgcctgaaatttcggataatggggtgtaaagttaacttgttatttaaaaaagggtagtagggaaagataataaatacccaaaccccactaacccctcttctgggggttttttgtggcggttgaaaaaagtcccaccacatgtggtcactcagaaaaaatagccacttcctcaatacccaataattggagtcaggctccttgaacctttgaaggggccaggaatgcttcctggtgtgtgtaattagaatcccttcctgccttgtttcactggcacgtgaaaatgcctcttggtcctgtcccaaggtatttttcacctgaatttttgaaatcacatgttttaagttgcttgaccctgccccctgggtcccgatgctcctttgagcataacctgtactaaatcctttttcccctatccagtataatataaggagtgatgtgccattaaaaaaaagaaaaataaa

SEQ ID NO: 493400 - DNA, 261 bp, Homo sapiens
ggggttggggggccttttacaagggggggtttttttttaattgcctttttttttacaaaggggggtttttgcccccctaaaaaaaacccccccctcccctttgggggggtgaaacaaaaaaccaggggtttttttgggggtccttttttttggggggggcccccggtttttttgcccggggggtgggggggggaaaaacccttttggggggttttggagtttttttttttttaaagggcgtttttttttttttttttttta

SEQ ID NO: 493401 - DNA, 457 bp, Homo sapiens
  misc_feature (295)..(295): n is a, c, g, or t
ccttgtcctcagaaagagttgcccagacttagaagacttgatgaaaagggagagccactcgatccttgactccgttggtgagtctggacaccccagggaaagccacagtgcaagtggtcatcctggctgaccctgatggacatgaaatttgctttgttggggatgaagcttttcgagaactctctaagatggatccaaaaggaagcaaattattggatgatgcaatggaagcagacaaaagtgacgagtggtttgctacgaggaataaaccaaaggcttcgggttagtggaaganacatgaagagcacttacatctccagtccagtctgttatcagtctggcacttatgttttgagaaatgctcccaccacttggctgtgtcctgcataggaggtctgtgcagtagtttcactcttcaaagctctgtttttagaaatgaaatatttttatcactctt

SEQ ID NO: 493402 - DNA, 351 bp, Homo sapiens
  misc_feature (1)..(1): n is a, c, g, or t
ngagtgtgggttccgtgggtgtcttttcctcgtcgtttttcgttgcgcccgtcctttttcctatgtgtcccctcggggatcgtgggtccctacttgtacacttcggtttcctgggacggcatgccggatcgcatacccggaactttccgagatgtcgggttctgcttcacagtgcttgacggacccgcgctcgttcccacccgccgcgcccatagcagccctccgtcacttcttcaccgcacctcgactgccccaggccccgccgccgctccagcgccgcgcagccacccgccgccgccgcctctccttagtcgccgccatgacgaccgcgtccacctcgcagtgcgccag

SEQ ID NO: 493403 - DNA, 312 bp, Homo sapiens
atgatatgggtggtgtaacagtggagaggacagccgagaaatggggtggtaggttttttttggttttccgacagagtctctatctgttacccaggtgggagtgcaggggtgcaatctcccggctcacggcaacctcggcctctggggttcaggcgattctccggtgtcagcctcccgagtagctgggattacaggcgtgcacaaccacgcccggctaattttggtatttttagtagagacgggagtttcatcgtgtgggccaggcgggtctcgaacttggtacctcaggtgatctgcccgcttcggtgggtg

SEQ ID NO: 493404 - DNA, 781 bp, Homo sapiens
gccctcgagagtgccccgcccaatatggggtacacttatttgccgcaagtgtttaggtttaacgaggtgctcacactcctccgttgtctgtacaacggtgccccccctatattggccgcgccacccaccgttttttccgaccgggggttcacacgtgtaatccaggcgcctgggagccgtatccaggcgggttcacctgtggtcaggagttcaagacctgcctggcccagtatgattggagccgcggtcgtcctaacgagctaatgacagagattagccgcgccgtagtgtgcaatgcccgcaatcccacctactagggagctgagccaggagaatcgcttgaaccaggaggtggtagcccatagtgagccaagactgcacctctgcactccagccttggagcgacaggccccagactcctctctcccaaacgactttccccccaacacatttatcagttccttacagtcactcccctccaagtaggagcccacgcgtctagatctgcctaacttgggttactacacagacactagatctaagatcaaccactgagatggagatttgcagcaaggccaggaaactttcactgtacacgcggaacatcacacccgagatggtggtgaattattgataggtctaggcattaaggtggttttcaacgacgggcaggcggtagatgcatgaacataacacaaggctgcgcggagcttccccaacggccaagtgagtcccccacctccccctcgggcgaaaaaactttgttcgtcccacaaagaca

SEQ ID NO: 493405 - DNA, 703 bp, Homo sapiens
tggactcgacgcagccatgctgggcatggtagcatgcgcctgtagtcccagctacttgggaggctgaggcaggatgaatcgcttgaacccgggaagcagaggttgtcagtgatgcacgagatcagcgccactgtgactccagacctggacgacagagcgagacttctgccactgcactccagcctggacgacagagcgagacttcgtctcaaaaagaaaaaaacctctgcgacttgatatcaaaagaaagctaactgctagatctgatcgagttaagagtgtggatctgccatcctacagagccatggatgtaggcaagtctttacaatggcagtgtgtgtgtaaggaatcaatgaaacacagtgtgaaaaatattcctgccttaggagagcttagcaggaaagattggcactaaacataattatgaggtgctacattatgaaagggaagtacaagtttccatgggtggatattcaagatcagagacaacaagagcagagacactggtgaagacactttgaagtatgtgactcttcctgttacgagctgcacacaggtagtagcaaggaagcaattgggttgtgacaggagcggattgcaatgcagataaagaatgtacaatatacaatacatctggagagaggttacatatgttatgcacgcacacatcagactacaatacgctgaaatagcatgtaaatcc

SEQ ID NO: 493406 - DNA, 202 bp, Homo sapiens
cctccttgagtctcagtacaggctttggagcactgtctggtctgatcattactaaagatacgtcacgtggccttgtataagaaaaacacaggaatgctcacagcgtccgttttgaccgtctgactcgataacttgtgtccattgggcacaatggggacgctgggcctgtcctcattaaaaacattaatgcccccggcggccg

SEQ ID NO: 493407 - DNA, 565 bp, Homo sapiens
catgggatcaaaccccgtacacggggacctacaatgcttacagagttatagccaccacagaaagcttgtcaacactttggaaagggacgacccctaatctaatgagaaaatgtcatcatcaattgtacagagctggtaacatatgacctcatgaagggggcccttgtaaacaacaaaatactggcagatgacgtcccctgccatttactgtcagctcttgttgccgggttttgcaccacactcctggcctctccagtggatgtggtaaaaacaagattcatcaactctctgccaggacagtacccaagcgtaccaagctgtgcgatgtccatgtacaccaaggaaggaccgacggcctttttcaaagggtttgtggcttcttttctgcgactcgggtcctggaacgtcatcatgtttgtgtgctttgaacagctgaaaaaagagctgatgaagtccagacagacagtggattgtaccacataagcaacttggaggaagagatactgaacatcattgggcttctatgctgggagaccacgaataaaaccaaccaaagaaatcaaaa

SEQ ID NO: 493408 - DNA, 131 bp, Homo sapiens
  misc_feature (20)..(20): n is a, c, g, or t
  misc_feature (45)..(45): n is a, c, g, or t
gataatcctgtcctcctttnaaagcgaattctctactgaaaggcngctctgttaaggagctacaaactgctctcaaaagaatgaaatactgagtccaattcagtgaggcacagggttggactatggcacat

SEQ ID NO: 493409 - DNA, 1303 bp, Homo sapiens
cgcggtccggcggagcggcggcgggcgcatgtctagcgggttcggccgcgtgagcggaggtgcagtctcggcttccccgcggcactcgctcacgctgcaatacacagagccgcaaaggcacacacgcgtcatcccgaccgccacacgcctcagtccggagaccacccgcagtcgccccacacctcgccgcgccactactctgccacctcgccggccacagtccgcagcggcgctccatctctacccactcagtccacacactacacatctacacatcaacactcacgcacaacacacccatgccagaaacccaaccctcaccgcaccacacagtaaactcccacacacactactctaccaaacacatacacactgcagcacctcaactacaacctcatccactccacactctacacacacaacgcccacacactcacgactctcactccccacacccctccccacccccagccaccactcacatcccccgcaaacacacacaatcaccccaacaccacaccctcacccacacccaacacacaacccccaacacacaccaaccccacacccgccccaccacaccaccatcccactccacccccaccacccccctccacccaccacctcacaccacgcccaccccactaccccccacacgcacgcccactaccagaccagacgtccacacccccgcctcacccatcacacactcccacacacaccacccacccacctaccccctcccctaccctccaaacaatcgaccccccacccaatcccccctccacctcccccccctcccccacacacaatacaaatacacaaaccaccactacaccccccaaccgcacctcaccacggcatacacacacaacacactacacctcaccatcacaacaccagaatccccatactacctccccaccacacacgccaccacccccccctccccctctccgcggacccaacaccccctcactcccacaccacaccacacccctctccccccatcccacccactccaccacaccacaacccccacccccaccaacgtccaccccccctccccaccacaccccataacccccccccccaaccccacccaccgcccacacccaaccacaccccactcaccactcctacactcgcaccagcaccctcgaccaccgccctccactcccacaccgccaccaccacacctcccactcctaccacacaccccacgcacgaccaagacacaccaccacaaccacctctcctctacccacacctcgccaacacccgcctaccactcatcatcacc

SEQ ID NO: 493410 - DNA, 868 bp, Homo sapiens
  misc_feature (49)..(49): n is a, c, g, or t
  misc_feature (367)..(367): n is a, c, g, or t
ctttcccaattttctcccatcaaatttcaaaatataagtggcctctcgngttagaaccacaaccaagttttacaaacgaccacaatattctggcatcatcaatctgatcttcaaagatcatctaaaaaggaatttttgagaaaaaaaaagataattttaaccaaaaggaaccacttgtaatttatatttcagcactgaggagcaccaatgggagtcagaaaagaactctggagttctcccactagtaatgtgtttaatcatggaagctattagcctgctttctcacctagagaaataatataggtttggacctacatcgacttctcagcgtagtttatgtttttaaatattgtcggatcctatgatnaaacatggttctcccacgttccttctgaactacatttcaagatgacttatttttgaatatttctacgtgaggtggatgtgactcatatggtatctctaattatatctttacttagcacgctctagttgcccaaaacttcggctccaagattctcaatggttctaatactaacaaccaactgaaaaaaggtcacgacgtctcatacttctctaactacgaaaaatgccatttccgtcagtaatgaatcacatcttgtctgaagctgttactctatccctatccactcttaactgtcctcccacctaatgtattcccccctaaaaaacaacaaatccctctgtctgacgacaacctcattaccctaaactctcctatccctctttttctttcttcatcaagccttttaatattccgccctttactcttttaaaaggaaatttatacgattctctatctagctatatgtagttggtcgtttgtagaagtaatggcatatctatg

SEQ ID NO: 493411 - DNA, 356 bp, Homo sapiens
  misc_feature (65)..(65): n is a, c, g, or t
accctgcgcgggggaaatgccggcggggtcaggtgacttccggggcgacgaaggtagctgtcgcnaacctctacgcccagcttggccgcggcttgtcaccgatgacgatgccaaagctgcccggcgacagctcgtcgagcttaccttgcagcatgaacttgtcgatgatcgagacgttgcgctcctgggccgggtcgatgccgttgagcaggatcttctgcactttgccgtcattggtcagcaacccctgcatctgggtaaacggcgctaccgccaccaccttggggttctgctggaccttggcggccaggctttgccagtcgttgatgggcgcatcgccctcgatggtcgcgtgg

SEQ ID NO: 493412 - DNA, 146 bp, Homo sapiens
ttaaggagccgggaagcagaaagtacatgtgttcagtgtcgtggcagccaggcaccaagtttttgtaggatgtcagaagggacagccgggcgagctttgttggacctgttacaattgcgggcaggaaagttctttttgctaggtta

SEQ ID NO: 493413 - DNA, 140 bp, Homo sapiens
tctgttagcttgcgccagaatagcccaggtaatttgctgagcctaatggtgtgtcaggcgtcagtctaagtacctgggcgtatgagtagttggagaacgtgtgaatatggagtactgactaacagactgaggcatgaaat

SEQ ID NO: 493414 - DNA, 162 bp, Homo sapiens
aaacagctttcttttgtctcctgaagtgattgagacaggctccttactagtccataggcttctttctgccatatccgcctctgtccgacctctccacccagcagccagagtgctcctttccaagcaaataggtcaggttattgcttgtctcacatcttctcc

SEQ ID NO: 493415 - DNA, 254 bp, Homo sapiens
gcgatatagattagacattgtcctatgatgccctttcatgcttcacgtgccccagaaactgaatactgtacttccgtcgtctataataggtacagatcaggttatccttggacagtcaaatcgtatttcatcacaaacttggttaacccgatgacacaaaaatgtttccttttcatattcatcaaatatctgccgatcatgaaaataagcatgtgaacatattctgtaaatcctacggcatacagatcggggct

SEQ ID NO: 493416 - DNA, 264 bp, Homo sapiens
  misc_feature (15)..(15): n is a, c, g, or t
  misc_feature (104)..(104): n is a, c, g, or t
  misc_feature (231)..(231): n is a, c, g, or t
  misc_feature (251)..(251): n is a, c, g, or t
  misc_feature (257)..(257): n is a, c, g, or t
gcacgagcatgttancccaggctggtctcgaactcctgacctcgggcagatcatctgaggtcaggagaccagcctgcccaacatggcaaaacctcatcgctaanaaaaactcagccaggcacggtggtgggcacctgtaatcccagctactcaggaggctgaggcaggagaatcacttgaactcgggaggcggaggttgcagtgagccgagattgcgccactgtactccancctgggcgacaagagtgaanctttanttcaaaa

SEQ ID NO: 493417 - DNA, 199 bp, Homo sapiens
gttactcaaaaaaatcttatttctgtacttggattcagacttagaaggtagaaggctcgcagagagggcaagtcttcggtctcttcggcaatttgttcctggcgcttctccttaggctccttcatttctcttggcaaatgtttagcatattctgcagcctcttctttatttttgtgggtacgcttcttcttcagagccc

SEQ ID NO: 493418 - DNA, 327 bp, Homo sapiens
cgcccacggcagcccagctctcaagcagccgagactacaggcgcacgccagcatgtccagataatttttggtatttttagtagagatggggtttcaccaggtgggccaggagggtctcacatctcttgacctcgtgatctgcccatgtcggcttcccaaagggttaggataacaggcatgagctaccgtgcccagcctacttaaaatactctggaaatagctctccccacctccttttttttttgggaaaagtgagttccactcaacacccaggtggggcgtgcaggggggggactcctctaagagtcgaccggcgggcctggcagg

SEQ ID NO: 493419 - DNA, 889 bp, Homo sapiens
gcagatcaaccccagatgcagtaacagacactgtaccaagtgagtggactctcaccgggccatcactgatctggggccagactgatctctaccagtgtgtgtctttaaatcatccaccattacgtctcagactgccaaatcggtggctgggaccggggcagggtgatactgccatgcctcataggagagtccgcgccgcattactctgatgtgatcccaattcatcatcgctcacaagcaaacccatgaaggcaaggtattggtcaatcatacacttgtacaggagcaggaaactgggtagcaacagcaaggaggattgaaggagaactatgcccaaggatagacgacatgacttaggacatgaggcgtagtgatagtgagactacgaggcctatctagcgctccaaaagcgccccactagaagtcactcaaggtagactaacacacacgaggttaaacactgtaactatgacaagatgaatctaaagaaagctcagaagatgcacagaacggcatgcgtcataaagacgcctttatatccatgtcagtgtgaacattgccttgaagtccctctaacaagaggtagaccgcgtattagaaaggttgaggctaactggtcatctacgacccatacacttaaggggcagaactgcagcggaagactgcacgagcaaccaagaaaacgaagcgattaggtcacgacaagacacaaacggaggatttgacagtacatataactacacggcatacccggtggagccccattgcaagcgatcggacttccggtccacctaaaaggaatagaccaaaacacaggtgtaaggtacgatcaaacggatacgaggaagttaacttccattgccttgagaagaccccacatgacgtgaga

SEQ ID NO: 493420 - DNA, 340 bp, Homo sapiens
  misc_feature (154)..(154): n is a, c, g, or t
  misc_feature (276)..(276): n is a, c, g, or t
  misc_feature (316)..(316): n is a, c, g, or t
gggttttatggtaccagttactataatgaacatagtaaaaatgaaattaattgtacgcctttgcttgacaatataatgaaaagaattttatggttgattgttgcccattgggtttctttttactgtccttgaatttgtaataagtcagattgtnctctacctcttactacactgttttacaaaatagaataattggtaaagctgtatttaaagctttaccttctcttgaacaaagtcacaaagactaaccacagcaaattaaaaatatggaaattncttaagcaaattggaagtgactatacattcatttgaaggnaatatggggcatgtctggttactt

SEQ ID NO: 493421 - DNA, 582 bp, Homo sapiens
ttgccttgtacctggtagcaatgtttttttattatatgtgaattttgtttggtgttaaagcgttatattgtaggcataatagaaactaggtgtttggtagttgaattttgttggcacacaaagagttaaggcaaaacagcaaaatagtaacatttcagtagcaaccaagaggtacactgctattaggacttttgatagcttatccttccagaagttgttctcggtgtccgtgttttatgttatcaagacatgtgtatgcttcatacattgaatgggtagacaaaccaagtgatggtcaagataagttaggtaaggtgcaaagcaccatgttgggagagtattataaacagatcaacaagtcttaagtagacatgttgtagttatctgggcattcactacatgcctgctactgataaggaacactggtatcagctgttactcagtgtctgcagcagccttactgaggtgggtgttatcaccattttactacctcagggagtttaagtaactcagtgttactcactcaagtgactgtattgagatctaggtttgttaaaggccatgtgctttgctgtatacccg

SEQ ID NO: 493422 - DNA, 297 bp, Homo sapiens
caggtatggtgagcacgcctcttggcctagctgctgcgcgttgtctaaagtgagaggatcgctaagtccagaagattgaggctgtagtgaactttgattctcaccacatgcactccagtcctgagctgacagagcgacgaatctatcccaaatgaaagaaaaaaaactcccattaagtactacacagttagtccataataggttgcaaaaagttactaagctaccttgatattctaactatttcttccaaaaatgtatgtcaaaccccaaattttttattccaatatcaccaggcgc

SEQ ID NO: 493423 - DNA, 378 bp, Homo sapiens
gttttcagctccagtaacttttgcccgatgtatggcatagagaaactatgaagcagctcctagtagctcttgggggtcacctagtttgtggcgggtcagctctgcccggtactcgtatgcacttcttggacaccgactggtggatgtacacacagacctggatcagtccttaggatttcttacctgggaggattccagttactagggatctcattagaggaacacggtggccacagacttcagggcttctgccggccactcgttaaaccagtcaatggtacagcagttgaccagggagggaaactgcctcagacgagctcggaagacctctccgatggggctcatgcacagcaccatgtgaatattgctgcgcacacg

SEQ ID NO: 493424 - DNA, 117 bp, Homo sapiens
  misc_feature (7)..(7): n is a, c, g, or t
tgcacangcgagttcgagctaaaatccgtaagactgaaggtgacaacaaaagtcaaccgtcatgacaaaatcaagtggaaagaggaagaccgccaaagaacatctgagagaaactaa

SEQ ID NO: 493425 - DNA, 235 bp, Homo sapiens
ccgccacagttctccagcctgggtacagcaagacccgctcttaaaaacaaacaacaacagaagaatatacaaataggctttgcggggccaacgcggatcacgagatcaggagttcatgaccagcctgatcaacattgtgtaaccccgtctcttttttgtatttgtagaaatacgaaaatgagccaggcatggtggcgggttgcttgtaatccccgctactcgagaagctgtggcg

SEQ ID NO: 493426 - DNA, 946 bp, Homo sapiens
gggatcttatctcatctcaaggtgaccttctcaagagatgttcctgtcggggaggcgcgagaggcgcagcagagtatgtgcgagacaacatccagcttcatgggcagcaggtgtcgagaatcctcctccaggagaaggcctctatttgatgtgtgtggagcatgcaaagacagtctgggcgcggatgtacatgatgcccgtatgggtgctacaagtcataatgcactcagacggttggcatgtttgaagatgactcaggaagaacagatgcaaagaaccatggtccagttataacgagaaaggaagaaaacgctgaccttcagtggatatctgggtgcataagagaccagtaacatgtaaagaaagaaggattaacgcattagtcgtctcgaaaggtgagctgaaagtcaggcactgtactaaggggctcaaccaactgttacccattgtacagacctgactaaaggtcttcttcatctacttcctgtgcctggactatggcgttggacgatctgggatcattttaatcacttgtacattgatcacaaattgcctgattgtgactgaacaacgtaatgtgctattctacgcccttcctggtgccgtgtgacgttctcgccagaattgtgcatgatgactgtgtagcaactttctggacggcaaaagcgcacggacctaacagatcccctgattgagggccctcctttaactggccacagcagtaactgcgacaggagacagttctgtccggttcacgggcgaagggtagcctgcaaagtcggcggaagggcggaagacggcagacatggactcacagtggccacgataaaacaagatgaaaagagtatgaaatgcgtgtctccaaacggagccatccacgggaccccccaccggcagcacctcgacgcagggacacacaaacgacggggacgacagcgaacacacc

SEQ ID NO: 493427 - DNA, 1598 bp, Homo sapiens
  misc_feature (1310)..(1310): n is a, c, g, or t
gcatcttcttcgggttgtgcggtcctccattttttattgcgtggggcgcccctcttcggttgttgatgatgttctgcagcatctgtctgtctccgtctcctctcctctcttcctccggtgtggtcgggcgccgcccccctccttcttctgcgggattttttttcttggccggcacttggtggggcacccacacgtgggggggatatacaacccccccctcgggtgtgggaaagaggagcgcccccctcctctctcttgtcgttggtctgccccgccctatgtgttgtttgtttcccgccagggttgtttctcttccaagacgtcaccgctcgggccccaagaagagaatttctgcgccacacacgctgtgctgttatcagaggggacccccccgccgctgtattttaatgaagaaagaaggggctgccgcccctcccctctcgcggggggtataacccccctctcctgcaggaaaaagacactcaccgtcgtttggaggagaggagcaccacctcctctcctcccacccccactgcatcaaaagagctgggagggagatacttcccccccgcggcgagacacacaccgacagacttggtgggttgctcggcagcagagggtcgcaacaagctcttcgcgggagccacacacacacagaaggtgggccccctttcgagagaagagaagagttaattagcgcggtaggatacacaccccaccacgggtaagagaggtccttggttggctttcctcccgttcttggaaagtgcttgttgtacacgacacaacagagcgacaagaaataatactacaaaaagagggggggtgattatatatagcgcccccctcctcgttttgtgatgcagtctgctttgtcgccgttctctttgttttgtgtgtccacatgatctccacacacaattttgtggcccgccccacgcgggttttgtacacacaaagagagggggcgcacacacacagcagagggagatatatatcccgctaagagagagggtgtctttatatatgtgccccacagtgggacgcacaaaagaggggcgctttttagagaatatgcgtctgggtgggggttcttatatattcccctgtgacacacacacaacgcgcacaccttgttataagaaacacacatcggtgtataatgcgctatataatgtgcccacaagagagctctcgggagttattcctcatgggtgccccacacgggtctacaattctccggggatataatatacctggaacaccaccctcaactcccactttgtgtgcgctttctggtttcttttttnttatggggcgcttataaagtaaaagagagcccacctctcctttgcacacagatcaactcacacacgggttggtacactaaggcctcttaaattttgggccacaaattgtttgaaagaaatgggggcctgtttcacacgggttttggatatttgggtgtaaagcacaccgtttacacacacgaataagagccccaacgccttgcgggacaggcatttttttgggaaaatccattttttagggattgtttttcagcattttccaaaaaattttttcttctaaatgttcca

SEQ ID NO: 493428 - DNA, 463 bp, Homo sapiens
  misc_feature (35)..(35): n is a, c, g, or t
  misc_feature (68)..(68): n is a, c, g, or t
  misc_feature (156)..(156): n is a, c, g, or t
  misc_feature (158)..(158): n is a, c, g, or t
  misc_feature (171)..(172): n is a, c, g, or t
  misc_feature (184)..(186): n is a, c, g, or t
  misc_feature (402)..(402): n is a, c, g, or t
gtgagagctgttccatcaccaggtgctgtctacanccagctgctctcaaaatagctgccctgctgggntcggggctgatggaggagcagggcagggaacccatctgggcacatcctggatccctcctgggctgtcgcggcccagagcttgagctgnanccctgtgcccagnnactcgtgatgcnnnatgctggatttggaggtccctcctgtggggtctgtgtgcgtggtgggcaggggtaggggaagctgccctgctggcctggctctgggagtatgctggagacaggcaggtaatggccatgataataatgatgaccgtttatggcagtgataagcatcatcatccaaaatgaggcagaggccaggcacaggggctcatgcctataattccactgctttnggaggccggaagtttggaggattgcttgaaggccaagcattttgagaccagcctgggcaat

SEQ ID NO: 493429 - DNA, 1817 bp, Homo sapiens
  misc_feature (911)..(911): n is a, c, g, or t
  misc_feature (1151)..(1151): n is a, c, g, or t
  misc_feature (1499)..(1499): n is a, c, g, or t
cgcggacggataacgtgacctggcagggatgggctgacgtgcgacgatgctgacagaaggcactgcgtctactggtgtgttgacagcatgcgcttattgttgctagcatgagtgtatgattgccgcgacctcagcattgtctgttctcgctgagcgatggtgactacttgctttcattatgtcgttgtggtggttcgccgcaccgatcgatttgttgtcgtcttgtcgcccgctggttgtgtgtttctcttccctccgattggtgtacgtcttcgtctcgcgtctgactgaacgcccccccggttgtgcgatatatcacgtagtgatcggtggcggaacgcataattgatacgcgcggtgtgcctctctcatcagggggtattattctgctggtgggtgggcccgaccaccaccactatttgtgttgctgccctcatttgcgagtgatatacaagtctcggtgtgggcgcgaccgtcccggcggcgatcgataattgcttgtcgcctccgcctgccgcgggctgtcgacctccatgtagtgttgtcctctcgcgctgttcatttcccacctcccccgcggcgggctctcgccaaaatggttttttttttttagcctcgtggattcgctgtcgcgctccccacccgtcgctttcccccgcgcggggggtgccgccccataaattgttgtgcgaagaagtatgtgttgttccttgtccgtccgcccacagaggggtcgctcgttcgtttgagccccgccccctttagggggaattttccaagatgcggtgtgtgccgtgtgtgttccacgcgcatcttgatgggggttggcgcccctttgtacccttggcgcccacatgttgtggtaattgtttagccgcgaaaaccgtccttagttccaccgcttgttggancaacttcctgcggtatctttaccgccccccgaaaccaacccgcttgtattgttaatcccgctgttgtttagggcgtcaccaccccttgtgcccagcccgtattgggggtgcccctcagtccccatatatggggagagcctcgctaatatttttggcgcccacttccacctttataggtagaggggccttttcaacttttgccacgccttggaggtgtgttccccgccccctcatatgttntctcccacggcggtcttataacacacccccccgtatgtagccccccaaaacactcttatcacggccccccctcacatgatatccccactcgtgtgtcacacttatgtaccactatatatttccatcttaccgcgcgcgcgtataaaaatctctaaaacactcctgtgtcgttgctcccccacacacacacacactctttttcttccgcgcgccctatttcccgccggagatatggcccccccccgcagacgctgtatacctccgcgagcttatacccccgcaatgccacatataacgcccacccacgtgttgagacacactccccttatatcacattctcggtatagngctccacattacacatttctctctctataccacgccacgctataatatattataataaaattcttttcacatcgagatgttgaggaacgccttcgcctttcgagaagcgagaaaggtcctaaatatgtatgaagagaaccctccacttaaccctggaggtgagctaataatggagatgccccccacccctatccaccaccacattcgagagaaaccccgtaataccacattaaatttagaccaaaataggaagggatcgagacccccccaagctggtttcaagacccaccccctggcctccctgactttttcccccca

SEQ ID NO: 493430 - DNA, 407 bp, Homo sapiens
tctagcggatccctgagtgggttcttgcagaatgtgcctgtgctcacacagcggtttctcgcatggggcctgtctttggtgaccctctttctgcggtctctggctttgtcatgagggcgggttgtcaaatcgttttcggcggcccggatccggtttgggtgtgtgaagtcctggcctacgtgaagagatgcatgggtccgggagcaattgaaatctcatccccatcctgagcggcctctctcctaagatcaaaatgatcacactgcagccgaggacaagagccccacaggagctctttgtcccgcaggagagcagcggacccacgtcagagaagatgcttgtatcttttcacggctcttctctgagaaatgaagccacaccatgatacagtctgcaaggaacccacg

SEQ ID NO: 493431 - DNA, 275 bp, Homo sapiens
  misc_feature (42)..(42): n is a, c, g, or t
  misc_feature (63)..(63): n is a, c, g, or t
  misc_feature (66)..(66): n is a, c, g, or t
  misc_feature (89)..(89): n is a, c, g, or t
  misc_feature (111)..(111): n is a, c, g, or t
  misc_feature (133)..(133): n is a, c, g, or t
  misc_feature (145)..(145): n is a, c, g, or t
  misc_feature (178)..(178): n is a, c, g, or t
  misc_feature (255)..(255): n is a, c, g, or t
  misc_feature (259)..(259): n is a, c, g, or t
gaaaatcctttcctcttgggaaagtaatacaagtcttaagtnccattgtagggtgcgccttcnganacctgctgcacttttctgatatngttcaccacttttctgtcttcncagctttggggaattttggccnggcgcccctttncccgtccttgagacccgcggtccaggagaatcnggccgtctgtggcctcctgtggcggggcgctcttcgccgcctccggtgtcaggtttggctcccttgctccatccccnatcngtttcccgcgggcctt

SEQ ID NO: 493432 - DNA, 110 bp, Homo sapiens
tggatccacggatcccacttgtttaagaaaattacactgctacagcgttaaatatattttggattcacacttgagtgtaacttaatcctacccattcagaacttttgtag

SEQ ID NO: 493433 - DNA, 252 bp, Homo sapiens
acagggttgcttgagcctgggactgtcgaggctgcagtgagccataattgtgactggcactaaagtttgggtgacagattgagaccctgtctcaaaaaaaaaaaaaaaaaaaggtggtgtttttaaggattgtaaatttttttcaaatggttttgcaaaaaatttttaaaattttaatattttgaaaaacgaaaattcagtttcctttaaataacattaactaatttaacgccttaatcggttaatccaagg

SEQ ID NO: 493434 - DNA, 753 bp, Homo sapiens
  misc_feature (148)..(148): n is a, c, g, or t
  misc_feature (182)..(182): n is a, c, g, or t
tgccaaactagagaatgttgtagattcatgttattgtcctggtcgctgtcactaatcgttatcctgcaggattcatcaagtttgtccatacgcatcttcttacagaatggtacaacatgtaactgtacaataacgagacatcatgccntgagtaaagtgggtggcaattatgtaatgtcagnctgctctcacgtgacaagggcgattctttagtcttagtggggacacaagtcgtgatgcaactgtttcactgcatttggcctgtctctctgagtatcgattctatatcccggtcatttatccccatcctgagtgattttgacacctggggcgtggcctaggaggttcgcatggatttgtcccttcaatcaaatcgcagttgaataatcaaacacgatacgcgtactcgaatggcgatcacattgagatgcttatatactgaggctaaatttcttgacgaaaggcagcactagggggtagcgtttacttcaggggtgcattagaaaggcgccagccggtgcacgactgtagcgaaacaggggataaactagaagcgtgccttggggtcatggatttgaaccattctacttaggaaattccatgcctgtgatgctgcggcagggggtgtccgtcgaggatctttggcccgtcaatattcccgacgattgattggccaataagggttttacgtcgaatggcctttgtgctgctggaccaaatgcacgtcagcggaccttgaccaaaccagtatta

SEQ ID NO: 493435 - DNA, 162 bp, Homo sapiens
taaaatgccacgacaaggagctggagaaatatgtacgacccaaagaatgaggaggacgacatgcgtgagatggaggaggagcgactgcgcatgcggggagcgtttgatgaagaatgtggacaccaaccaggaccgcctacgtgaccctggagggagtccctt

SEQ ID NO: 493436 - DNA, 411 bp, Homo sapiens
gagaatctaccttcatcacatattgagcatggccctgcttcctgaccttgaccttttgtcactgccatcattaatctaggtgagactcctctcagctttttctcccttttgccccttcaatggtttctcattacatagtaattcttttatggcagacaactcctttgatgcactcccccttgctaacctcatgtctgtggagctcttagttccctagccacactagctcctctccactcaaggacatcatattatgcctcttctcaacttaaacacagcttatcagggaagcatttccagattccccacctcttccctgtgactgtttcctcggtagcacttatcactgttttttattttgtatttgtttaactttaattgctacctgtgtcccctcctatctgtaagctc

SEQ ID NO: 493437 - DNA, 1269 bp, Homo sapiens
  misc_feature (486)..(486): n is a, c, g, or t
gcttctgacaggctggtgctcctgcccgggaacatcctccgttgactcaatcatgggcttgtggtctggctcgccaggcgaacctgaagtcgtcaaaccgtggagagtgcctgtcgagctgcgaggcgatggtgtggcgtccgtgacgtgcttagaggcgtgtcgctgcgtgaagcctggggcgaagacaggcaacagacctgtgcctgcacttcgagacgcgctcgtcttcagacggcaccacgggagtacgcctacatcacatcgtagttgcaatacaagcgaaggtacggcggagggccgtgtggggacctgagcagcggtgaggctgtctttcccttccagcctggacagtagtttgcagagaggtgtgcatcaaccgttcgacgcaggccaacctcgaccgtctaatgctagcccagattggattaggaattcaagttccccgaaacgcgctcaacctgtgagtgccatctaactcacatnggcagcttgacggtgacttccaagatctaaatgtagtggcctttgacgtcgataatgcagcctagctccatggaccccaatcagaggcagcttgcctctgatccctctgagctggggctatagaaggaacattcagatacttgatggaaccaacatcaaaaggtgcgcaggccatattacaaacagcgtcggaggactgacccgatcagggaaccatcagcaaggtagtgaactcccaggtggccacgaaggccagcaagggattcccacgctggacattgaggcatctctcatacagcatgagtgcttccgaacgactactccagcatgacacgggggcacctgttttggaaaaaccacatcactaaacggtgttggacagggtggaagcccattgttcggggcctttacatttcctggtgacacaaaatggtggaccggggaaaacaacatctacggcgtgaaaactcactcagacagtggtcatgggagatgtaccatgataattccagtaaaagtgagaccccacaacccgaacacccccaggcggggtcaaagaggaaaacccgtgagactctgatcaccacggacgacacggttgcgcgaccaacacttgggtaggccccgacacagatggtcgcacaagacgatgaacagactcaacaagcgaacaaagcgacgaagatacccgcgatgcaacaaagatgggagatcccacagaggaaccaacgcgcatgactgaagacagagcacccaggactggagaaaaccacggaaacaaag

SEQ ID NO: 493438 - DNA, 376 bp, Homo sapiens
tagcctctaaacgggtcagaagcgaagtctcggctctgtcgcccaggcgggagttcagtggtgtgatcttgagctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcggcctcccaaagtgctgggattacaggcgtgagccaccgcgcccggcctggacagtgtctttggtaataaagttcagttttttttaatgtaaagtgccacacccaatgacatattttgtacaaa

SEQ ID NO: 493439 - DNA, 227 bp, Homo sapiens
cttagaggatccctccgtaacgagcgctcctaaaccctccgtaacagcgcccttcagtggtggtgctggtgggaagttttttcataggaggtgtatgagtatggtcgtagcggaatcgagtgtatgctagtgcgaattcataagaacagggaggttagaagtagggtcttggggacaacaatatgttgtgtgtagattaagggacagttgcgtcatatgttgttcct

SEQ ID NO: 493440 - DNA, 352 bp, Homo sapiens
tggcgtgcagtggtgtgatcatagctcactgtagtctcaaactctgggctcaagcagtcgtgctccctcagccttccaagtagctaggattataagtgcaagccacaacaccaggctgataggttatttttaatggaatttttccagatgtaatttacaaccatacagtttacctgcttagggtttacatctcacgcattttcgtacaattcacagcttgagtggccatcaccacagtccaacttttagcaaaattttcaagcgccctgagagcaacttcctcatgtctcagtatgcatatcactacttaaacgtttttattacgtgatatgatggcatgtgactttctcag

SEQ ID NO: 493441 - DNA, 135 bp, Homo sapiens
aggagttcgaggctagtcgggcatcatggtgagatgctgtctctgtgaaacagcaacaacaacaacaacaacaacaaattagccaggcatgatggcatgtgcttgtggtaccagctacacgggaggctgagtggg

SEQ ID NO: 493442 - DNA, 492 bp, Homo sapiens
tgaaagttagtgtatctggaatgtactaaatgtactagctactaagagttgtagttattgaaaaataaagtaaaacagacccaagtttcacaaaagactgtccttaaggtccttcaaagaaaaaaaaagcacattataaaagtcatttaagtattttgatacctagacacctgtgaatacaatcctacatatctaccttatacatattatttattatttcaaggccaacagggccagctcaaaacttgtatcattattttttgctcgccgtgaatctgccttgaagctctgaatttaaaagactcaagcaattagtggaaaatcagtcattgtgacaacttttcaagtgggtggggagtgtcttcaaatagccaatgatacggaaactttcttcacgctcttttttatatatttttttaagtctgcatatctaaattgagatcacttgaaatgagtcttgccacactgggcatttagcctaaaattaacacc

SEQ ID NO: 493443 - DNA, 360 bp, Homo sapiens
gaaaggaagaagaggaggtgtgggaaacagcttccacattgttatttaactcatcaccactatttctgatggccctttcctgtgtgtagcaaagcttcttgcatctgacttcttgtaggacacaacacccccaggtgtgggtcagtgtgaagacagcctccagcatcaggggcttttctttcaactttcttttgagtgacagctgctttgtctgcacgagcccgatagccacctccactaatgggcggtgggccagccctcaggttggaagcctcttctctcttcttgtcaaggggtcgatgaccacgggcactgaaaaacctctcctcattgtcgttgacaccttgggatttatctaga

SEQ ID NO: 493444 - DNA, 101 bp, Homo sapiens
actgttgcacacctgagcaaggtcatcatgacaaactttggtatcgtggaaggactcatgaccacagtccatgccatcactgccatcccagaaagactgtg

SEQ ID NO: 493445 - DNA, 157 bp, Homo sapiens
acttcagagaaactgaagagtctgttcagcagtttctacaagcaagtcgggacctccgcttgttctttgtttccaatatttggacacttagagtggtttgtgttttttctcatttactacgtggagtgtctagcgactgtcttgttctaaccatggg

SEQ ID NO: 493446 - DNA, 254 bp, Homo sapiens
  misc_feature (9)..(9): n is a, c, g, or t
  misc_feature (15)..(15): n is a, c, g, or t
  misc_feature (39)..(39): n is a, c, g, or t
  misc_feature (43)..(43): n is a, c, g, or t
  misc_feature (51)..(51): n is a, c, g, or t
  misc_feature (61)..(61): n is a, c, g, or t
  misc_feature (67)..(67): n is a, c, g, or t
  misc_feature (76)..(76): n is a, c, g, or t
  misc_feature (93)..(93): n is a, c, g, or t
  misc_feature (108)..(108): n is a, c, g, or t
  misc_feature (112)..(112): n is a, c, g, or t
  misc_feature (127)..(127): n is a, c, g, or t
  misc_feature (134)..(134): n is a, c, g, or t
  misc_feature (155)..(155): n is a, c, g, or t
  misc_feature (170)..(170): n is a, c, g, or t
  misc_feature (181)..(181): n is a, c, g, or t
  misc_feature (214)..(214): n is a, c, g, or t
  misc_feature (241)..(241): n is a, c, g, or t
  misc_feature (250)..(250): n is a, c, g, or t
  misc_feature (253)..(254): n is a, c, g, or t
tgagttgcnttttcngggatgaggaagtagggttaaacncccnagtttccngagggaggcncctganaggtgcccnttgtcagaccctaccanagcctggataggcanccanattggtcctcgcccntgctcgnactccgtggtggtcctgcccntctccctgcatgccngtgggtctgcnctggtgtgtgaaggtcggtgggttaactgtgtncctactgaacctggcaaataaacatcnccctgcaanggnn

SEQ ID NO: 493447 - DNA, 1361 bp, Homo sapiens
  misc_feature (305)..(305): n is a, c, g, or t
  misc_feature (640)..(640): n is a, c, g, or t
tggaaaaagtctatggaggccatggggttggtcttgaacccagtcttggggggtgttcgatcccttcccttttttggtcttagatttttattgttattccgggtttctctcgaatgtgtgtgtgtggtaggggtggggggctctccatttttgctcccctccgaaggtttagtggaggagtcctctctactatttaggcacttttccgctctcgaagccggacgcctctctcagccctctctcgggcgccagcggcccaagcttctccttctcaaagtgtgtctcttactgtggtcccacgaaantctccgtgtgtgcaagcctcagctgttgggaggggtgatctccctctcttacacccccagagtgtgctttgtgggtttctgttccaagagccctattattcataactctttgagtgctctagagcgcgggaagtgccttgtgacaccattgtgtaaaacagccacattcaagaacccaagagggtgtgtggcatctgaaggtctcccccattgtgttcccacacatatttgtggcaccccacaccgccgcgagcaattatgtgccccgagagagacaccggggatatatattgcgcctttcgcgcctataccccaagaagaagaggcaccccaanagagaggaactcttggcgtttttccacgcccttgaaaatgtccacgccctttttatttctttgggccccacccctgtgtggggacagcggggtagattttgtgggggggccccctatttgttgaaaagcaccccccgtgtgcctcccagtttatttagacgcgctttctgtgagagcgttaaaagacgcgttttccccaagtggaaaaggggggcgccggtggggggaacaccccctgaagcgggaggggaaccctctctcctcccaagtgtggaaggatctccactctgtgtggctccccgagagaatacccaacaccccggggggaggcgttggtcttggggcacatttttataccccggggaggttcctcacacccagggggagacacttggttttccccaagacatgtgtcttcttggggcacaaagggggcgccattttatttttcgggggggaccacccatcgtcgggggtggaaactttcccgggggaagtccctgtgttggtttttgccccctttgtccagagggggggttttaacaacacacccaggggatgttggtgcgtctcttctaaccaatggtattatttaaacccctcgggtttgtgttccccccaattctctcgggggggccactcttttatacgcaccgtcggtgtgtgtagaatatgcacaaaagagacgtcatgatgttttccccccccgcggtggtgtgat

SEQ ID NO: 493448 - DNA, 645 bp, Homo sapiens
cacaacgatggtcctcagctactaagggggctgaggtgggaggatggcttgggtccaggagatcaaggctacagtgagttgagattgtgccagtggactgcactccagcctgggcaacagaacaagacaccacctcccccaaaacccaaaaaaagacctggcattcataaatgaaacaacgacacacacacacacacacgatgcctttctctcactgccttaaaaacgctttgtcttcagggttcattagtttgactctgacgtgacttgctgtgaatttatttggatttatcctactcagggttcactcagcttctgaaatttgcagatttacagaagctgaggaccatcgttgcagctcactgcaacctctgcctcccaggttcaagcaaatctcgtgcctcaccttctcaagtagctgggatcacaggcatgtgccaccatgcccagctaatttttgtatttttagtagacacggggtttcaccatgttggccaagctggtcttgaactcctggcctcaactgatccacctgggcctcccaaaatgctgggattacaggcttgagtacagtggtgtgatctcagctcatgcaacctctgcctcccaggtggatcagctgaggaccatcgttggggatctcta

SEQ ID NO: 493449 - DNA, 604 bp, Homo sapiens
agatcgttttgtctgttctagagggaacgattgattctgcacaggcgcgatttgctattaagaatatactccagttaggtgatgggggctagctccctatacatgggaaatcattcaattatttcaatcataaagattcacgctatgtcattcggggacatggccatggattgcttcatattccgaagcatgtaatactcattgccttttttgtagacgtcacaatgaactcaatgtactattggatggcgaccttaaatgctctcaacattaccagaggcaacgtttgatgcttattctacataagatatacactattacatacttcttgacaatgacacgtgtataattgatgcttgacgctcatggtccgcaaattataatctgaagaaataacttagatcgaaccactgtcctcacactagtgcgtgcacatccaaccgaattaacgttctactatatttaaacacaagttgagctctccagtgttacatcttttctcagcaatcaagtatctcaagtcttatcgatttactgatacctcgatgaccaacaagctattctggtaactaccactgcgttacgcaagtgtgaacaacaattt

SEQ ID NO: 493450 - DNA, 419 bp, Homo sapiens
cacaacgatggtcctcagctactaagggggctgaggtgggaggatggcttgggtccaggagatcaaggctacagtgagttgagattgtgccagtggactgcactccagcctgggcaacagaacaagacaccacctcccccaaaacccaaaaaaagacctggcattcataaatgaaacaacgacacacacacacacacacgatgcctttctctcactgccttaaaaacgctttgtcttcagggttcattagtttgactctgacgtgacttgctgtgaatttatttggatttatcctactcagggttcactcagcttctgaaatttgcagatttacagaagctgaggacaacgatggtcctcagctactccggaggctgaggcaggagagttgcttgaacctgggaggcggagattgcagt

SEQ ID NO: 493451 - DNA, 1106 bp, Homo sapiens
  misc_feature (900)..(900): n is a, c, g, or t
agcggggaggaatgacgcgagccatgaggctgctgcggcgctggtgcgttcgcggctctgtttgctgtcgctgctccccagggcccggtcttgaggagccaacgggtcctgcctggtacgctcgtgcgatgaggggggctgtacggccccagctgagtgaggccctagcgagccccgtgaggtcacggaaaccgcagccgccgctcggtgagttagtgggcgagctgccgcgggggaaggaggtccgaagagcacgcgagcgtggaacacaagggtccgccaggagccagcaggtggcccgcctgctccagtcgtgggccacagagtgagtgttgcgatcagtcgccacgcgtgtcatgtcctataacttcaacactggatcctgtgagcgtgaaaccaccagcgtaccatcatccatcgcaatattgtggagcgcgcacgttcagccgattgaggggagcaagcacaagacaacagcacctggtgcgcttgagaagacccatacttgttagcgtatgccatggggtgacatgcgtacctgtggggtgcatacccgccgcattgtccctctactgctcaggatcacttcttcgcaacacttgtcgcacggaatgactagccaattgggaggtgcttcttctagattggagaaacatttggacttgacattctgttggacgcgcccaaacgtaaggatgtggcttggtgcaccgtttgttgggtggatgaccctcgttccatggggacgcccggtttcaggcgccacaaaccgttcaatttcctacgctgtgaatccccgctgcattcacataccggcaaggaattcctcaagcattcttggcactttgcaaaggggcaaaccccaggtggccttgtcgtatggttccagaattagttgcnccttggcctcaaggttcagtggctccacataccctagatatcctggggcctgattgctcttgaggtaaacgcgcaagcaggggcgacgcgttcgttgcccgaggtgcgccctatggccttaacaagttggcacacagatggaaaaacccaacgggtaatttttggaaggcttcacacttgttggagttgcacacggactcctagcc

SEQ ID NO: 493452 - DNA, 254 bp, Homo sapiens
caatgcgggcagcacggcaatcatatcccccaatattgggtgcctggaggtccaatcctgccaccaccacctattaatccaccctttcccccaggcccctgatgctcctcccccaggagtctccccatggcagatccatgcttaccccccaggtcgggcccctcatcctgatgccactagcacggctatccaggcatgccacccgttgggtccctaccgctcctcacatacccaacgcctgacccctggaatcc

SEQ ID NO: 493453 - DNA, 187 bp, Homo sapiens
gaactgttgtctgtcctatagcgctatgtgctgtgctgggtgtacactgtaccccacttggtccctatgctgacccagtgaaattgcagacctgcccctccaaactccacagtattggacccttgtgggctagtgccatggccttctacatgcctaccacctaatgaagcttgaatatgttgactgc

SEQ ID NO: 493454 - DNA, 103 bp, Homo sapiens
tcttggtattgaagttttgacttgtctgtctcctgaaactaaacatggtgcaacacaggactttttggatccctccagaaagtgtcagacgttttttcattga

SEQ ID NO: 493455 - DNA, 212 bp, Homo sapiens
catggtacgatactgtcaactctggaacaccattatctcattacatccaagaatattaattctctctaacattaccgcaaattcattagaatctccatgctcaaaatattcctgtatgagtaggtgttaaagtcttctcatgtgccctttcatccaaaggcgagacaacggtttcatcaaccaccgttctccttcgaggggagaagaccctg

SEQ ID NO: 493456 - DNA, 683 bp, Homo sapiens
ggcacgagctggttttaaagacaacttggcgcttgagatttaaggtgggacatagtgcggaggggcttggttagggccgctcatggaactgctcggaggaggtggtccagaaacaccactcatgcctgcccggcacgcagtggatgaccccgtggaagcctagacgccctccgttgaaggcatcaggcggggtggatcagccgcctctcagaaaacccttttagtgggacggggcaggctgtgtccccacaagagcgagaaccggcccgaagcaggactgaggaattccatctgcctgtaaaccctgcgtgtaggcttctctcgggaggataaaccttggtctaggaaatctctttagattccacccccaccccaggccccgcccagatattttcttttctgggctggacgtctgcacttcattcccctctgggggacgggataggagcaggacaatccccaggcccgggttcctcgattttgggggcacattctggccaccggagcctctttggtaaaccttgttcccacaggggttgttccaaagaaggcttttggcctggaaaaggctggtcccgcccccacaactttgaccgttcctggagcttaatacaatggatttattctgaaaacaggaaacaaggagttggggctggcagggctctcccggaatcccccggcgg

SEQ ID NO: 493457 - DNA, 927 bp, Homo sapiens
  misc_feature (927)..(927): n is a, c, g, or t
gtcccttgtatgggagctgttttcatgctatttcactctattaaatcttgcaactgcactcttctggtccatgtttcttacggctcgagctgagcttttgctcaccgtccaccactgctgtttgccaccaccgcagacctgccgctgactcccatccctctggatcctgcagggtgtccgctgtgctcctgatccagcgaggcgcccattgccgctcccaattgggctaaaggcttgccattgttcctgcacggctaagtgcctgggtttgttctaattgagctgaacactagtcactgggttccatggttctcttctgtgacccacggcttctaatagaactataacacttaccacatggcccaagattccattccttggattccgtgaggccaagaactccaggtacaagagaatacaggaggccttgccaccatcttggaagcggcgtgctaccatctcggaagtggttcacaccatcgttgggagctctgtgagcaacggacgcccccggtagcattttggcaaagccacgaaggacatgcaaagtgaatcgaagctgtcaaactacaagtggagccaagatgcagccaaagactaagatctgccgcagacccctggacggctgctagccgcgatctgatgttctgacctcaggacctcctgaggaaatctcagtggcaaccgctataaggcccaatagcagaagcacgtagaaggtcgcggcaactccaaaggactaggattccgggccatgggcctcagacggaaacggatcctagcgaagaacaaagcaaggaggacccccgacacggctaatccccccgacagagcaccttgcagggggatacattgtccgcgcgagggaaactccagacgaccttcggttaaaaagtttgtcctcccctcgtgtggcgtgttcctgcn

SEQ ID NO: 493458 - DNA, 304 bp, Homo sapiens
agatgggcgagatttaacaccagagatcacaatagttcatcaccactatcacaagaacagcacccagtggatcacctgaggtcaggagtcccagaccagcctgaccaacatggcgaaaccccgtctccaccaaaaacacaaaaaattagctgagcgtggtggcgggcaactgcaattccagctattcgggaggctgaggcaggagaatcccctgaaccggggagacagaggctgcagggagcggaagacagcaccacttgcactccaggcctggtcagtagaggtggagaacccggtctccaca

SEQ ID NO: 493459 - DNA, 118 bp, Homo sapiens
tgggtcggcacttacctcattcagtctgttccagctgagctcatctatggatcacaccggtggtgctgctagctggcagtagaagaatggctacgtgactgtcagtgagatcaatagc

SEQ ID NO: 493460 - DNA, 114 bp, Homo sapiens
  misc_feature (39)..(39): n is a, c, g, or t
  misc_feature (85)..(85): n is a, c, g, or t
tgctgcacctggggactgtgaccgactttaagcaaaccnccaacaaagggtattggttttcagttccgctattggtaagcattgnttccctggtaattcttctcgtcctaatct

SEQ ID NO: 493461 - DNA, 354 bp, Homo sapiens
cttacataattaaaattaacaagaaggtattataatatataaaaacttagtttcccctgagagttattctactttttaaaataaaaacttgtgttcacttccaacataaatatgttctcatgtaatttacaattataagacatgttccattctttaattgaggtgaaatacacataacatgaaattaccattttaaatgaacagttcagtggcatttaatatctttacaacgttgtccagtcactgctactttctagttccaaaatattttcatcatatcaaaataaaaccttgtttccaataaggagttatttctctgttatgggttgaatcgtgcctcactgaaaaaaaaaa

SEQ ID NO: 493462 - DNA, 467 bp, Homo sapiens
  misc_feature (265)..(265): n is a, c, g, or t
ctctactaaaagaaatgcatgcttgtcaggtgcagtggctcttgcctgtaatcccaacactttgggaggccgaggtgggcagatcacctgagatcaggagtttgagaccagcctgaccaatatggtgaaaccttgtctccactaaaaatttgccaggtgtggtggctggtgcccactacttgggaggccgaggtgggaggaccgcttgggcccgggaggtcaaggctgcggtgagctatgattacaccactgcactccagactgngcaagagagtgataccccgtccctaaaaaaagggcgggcgctttttttttttttttaatagggatactgaagggtctttattacccatgggccaccaacagtttcccagccacttgcggggccctctaggtctctccagcccactctagggacccaagaaatgcagccacagtccatctctcttttttctctccttcggggg

SEQ ID NO: 493463 - DNA, 121 bp, Homo sapiens
  misc_feature (10)..(10): n is a, c, g, or t
  misc_feature (41)..(42): n is a, c, g, or t
gaacccctanaggcacttaattgattagataatggcatttnnccgatgtgttaatgaattaagtgcctttagatggaattctttttttttcttcaaagaaataactattaaaaacctcaca

SEQ ID NO: 493464 - DNA, 103 bp, Homo sapiens
attctcttcaagctccactcccgggtcataccattctcctgcctctgcctgtagtcccagctactcgggaggctgaggcaggagaatggtgtgaacccaggag

SEQ ID NO: 493465 - DNA, 787 bp, Homo sapiens
ccggggtcagagaagtgctaggacataatgcccggcctcggccaccctgcacgtgcgtccaacatgccgccctcaagtctgccgaggacggatctcaaggtccctgttttcccagccaatggggggccgtcgtcaaaggatgtcaaggttgcttcccagataggaccggcaaagatggcactgatccagatgggctccagtggaggaggcggtccaggccctcacttgacctgcacaaccacgacctcgcgggagaaccaccacctgcgggtctccttcgtccaaggtccaccatctaggggcacaggcccccacggccgggccccctggcgacaactgtccatcattccagagaaaagccacgttgtgaagacagcctgaaggtgaccttagcagaccagagatgtttagtgtgggtggtaaagagaaatcaagtttaccatgttgtcgtaaaaaaagttaaatctagttcaccttgctcaccatgcaggtgacagggacagctcaggctcattggtgactgtggcagcgggagttcccaggcccatccacaccacggggccagaccctcaggggccatgcctttgctggggcctgtgtcgggcagtggggccatgcaggtgggcagccaccgaccacagacttggcttccttgtgccttaaaaaacctgccttcctgcagccacacacccacccggggtgtcactggggacccaagggtgggggggtcacaccagagagaggcagggggcctgccaggctcctgcaggatatgcagctggggcac

SEQ ID NO: 493466 - DNA, 1614 bp, Homo sapiens
  misc_feature (153)..(153): n is a, c, g, or t
  misc_feature (527)..(527): n is a, c, g, or t
  misc_feature (1251)..(1251): n is a, c, g, or t
  misc_feature (1359)..(1359): n is a, c, g, or t
tgcacgttgcgccacaacgccaactgtggtgttgcagattgtgcttttatctgctcggacgagatattgagaaatatagttttgtcttgcccacgccacagatgagatgatgtggttctcacaaagacgggtgtgaaaataataggcgcgccngtatataattattcccgccgcactatgtatatataagatgaaaccattgggcggcccttcacaccaaagaaggggaacgagcaacgcccccgaacgaggagaaaattttgggggggggagaaaaaacaccgcacgaacaacactgctcccgcagaagaagagaatgattgtggatctccccccgcccataatatacccacaagatgtgagatgtatgatatttaaggggaaccacacaactttgtggaagcgacccaccacccacagaaatttgttggggcccccccaacgagaaaaaatagggggaaatgtggagaaggcacacaaaccttgcccttggaaggggagatatatccccgccaacgagagttatnaattagaaaattgggggagaaaaaagacaaagtttgggttctcgaagaaaatttatggcgcccccaagagagaagaattgttataatttatcattttaaggcccccccacctctgggttgggggtctccccctcggaggggccctctgtggttggcgttatcctatttaaaagggacaaaggttttccccctatgatttattacaaggacgaaaaattatcggtttggagaaaattggggagtgggagagaaattatagagaagaaaaagggttttaaaaaaattataggggagagcacaacgcccagttattacagcacagggtgttctccagagagagaaacacttaaaatggggagacacttctcacactttgagagggagaccctcacagggagacaccaaactcggaaaagagtgtgaaaagagatattttcccctttggaggagttcacacagtgaggcaccactctgagacagaaatattgggagaggttcacagaaaaagttgttggttgggactcgaatataactcgagacccacaaaagagggctctttataggagaagtgtagaagttttcacaggaatggctctttctataaaagtgcacactatacttcacagagtatagagaatataaggagagagaataaaagagagaatatgtttccaccagctgggtgcacacatttatagaaacataagagaggccctcgagaagnttatattctgtaaagtttttcaccacggcgcccacacttgtgaacgctcacgccctcggtttctataatatccccacttatattataatatatcacacacttctgacnacagctggaggagaaaatataaagagagagaaatatggtttctttatatcacacaaaactgtgaactatttctgccacccacgaattctgagaaatcccacaggagaaaatgagtaaatgagattcacggcacctggttccacctggctgagtaactagcacgtattgaacttgagaatttaatccactctctagcttttctaaagttaaacttaagaccgtggatcgatatctttaccagaaaccagaagacca

SEQ ID NO: 493467 - DNA, 742 bp, Homo sapiens
gcagtgactgccatgttcccaggctccagcccgtggagagggagagggcacatctgggtatgccgccagtgtgtctttgcgatcgccaccaagaggggaggtgccctgaagaagggcccctatgccctgggccatgctgtgtatgaacgctttctctgccatatggactgaaaggcgcgtggcacatgcgtgatgcttggacatctgagcaatcgacagcggagagttcactgttacttgtggtgggccctggggagtggaacctcgaaaatgctgcagtgccggatcctgtctgcaagtgattccatgatgcctgcacccagtgtcttgagcaaagcccccgtcctctatgcgggagcagtgttctatgaactttgaacttgcttgtgtgtgtcggtcgggtgtgcccttgagcacaaagtccggagagctagcagcttcgctgggtggagtgtggcccgatcttgtcctgtatcatccgtcagtgttgtgctgtaatcaatgaaatactttgactctttgactctgtgagatccctccccttcagctatctgagaacttggggacaggttttgcgtcctgggggcagcttttcagaagacccgcaaacgggaggacacagttctgcccaaagctccgtctctgctctttaagcaggcacagaggacccgtgtcaatctcaggggagaagcgatcagaagaaggaagtgtctgccctggactcccaggatccggctgcgtc

SEQ ID NO: 493468 - DNA, 629 bp, Homo sapiens
  misc_feature (3)..(3): n is a, c, g, or t
  misc_feature (75)..(75): n is a, c, g, or t
  misc_feature (79)..(79): n is a, c, g, or t
  misc_feature (84)..(84): n is a, c, g, or t
  misc_feature (116)..(116): n is a, c, g, or t
  misc_feature (128)..(128): n is a, c, g, or t
  misc_feature (132)..(132): n is a, c, g, or t
  misc_feature (135)..(135): n is a, c, g, or t
  misc_feature (141)..(141): n is a, c, g, or t
  misc_feature (145)..(150): n is a, c, g, or t
  misc_feature (171)..(171): n is a, c, g, or t
  misc_feature (173)..(173): n is a, c, g, or t
  misc_feature (209)..(209): n is a, c, g, or t
  misc_feature (215)..(216): n is a, c, g, or t
  misc_feature (227)..(227): n is a, c, g, or t
  misc_feature (234)..(234): n is a, c, g, or t
  misc_feature (243)..(243): n is a, c, g, or t
  misc_feature (245)..(245): n is a, c, g, or t
  misc_feature (248)..(252): n is a, c, g, or t
  misc_feature (279)..(279): n is a, c, g, or t
  misc_feature (288)..(288): n is a, c, g, or t
  misc_feature (293)..(293): n is a, c, g, or t
  misc_feature (302)..(302): n is a, c, g, or t
  misc_feature (309)..(309): n is a, c, g, or t
  misc_feature (326)..(326): n is a, c, g, or t
  misc_feature (329)..(329): n is a, c, g, or t
  misc_feature (371)..(372): n is a, c, g, or t
  misc_feature (375)..(375): n is a, c, g, or t
  misc_feature (377)..(378): n is a, c, g, or t
  misc_feature (380)..(380): n is a, c, g, or t
  misc_feature (386)..(386): n is a, c, g, or t
  misc_feature (389)..(392): n is a, c, g, or t
  misc_feature (399)..(399): n is a, c, g, or t
  misc_feature (408)..(408): n is a, c, g, or t
  misc_feature (410)..(411): n is a, c, g, or t
  misc_feature (420)..(420): n is a, c, g, or t
  misc_feature (424)..(424): n is a, c, g, or t
  misc_feature (427)..(429): n is a, c, g, or t
  misc_feature (434)..(434): n is a, c, g, or t
  misc_feature (445)..(446): n is a, c, g, or t
  misc_feature (448)..(449): n is a, c, g, or t
  misc_feature (456)..(456): n is a, c, g, or t
  misc_feature (458)..(458): n is a, c, g, or t
  misc_feature (464)..(464): n is a, c, g, or t
  misc_feature (468)..(468): n is a, c, g, or t
  misc_feature (471)..(471): n is a, c, g, or t
  misc_feature (474)..(474): n is a, c, g, or t
  misc_feature (484)..(484): n is a, c, g, or t
  misc_feature (489)..(490): n is a, c, g, or t
  misc_feature (497)..(497): n is a, c, g, or t
  misc_feature (506)..(507): n is a, c, g, or t
  misc_feature (513)..(513): n is a, c, g, or t
  misc_feature (525)..(525): n is a, c, g, or t
  misc_feature (531)..(531): n is a, c, g, or t
  misc_feature (628)..(628): n is a, c, g, or t
atnagggaatgataggtcacaggtgacaagtttatagtaattttgtgtggccacaaaaagacgggcctgaaaaangaancaggntgtgaggtcagccactgctgggcacggctcanagtgtggggggnaggngtnggcagngggnnnnnngctcaggagaagaggcatgangncaaccatagcccccttcccttcctccactttcaggntgatgnnactcataaganatcttanactcaaatngngannnnngcggatccagatagagggggccagggnatgagtggntgaanaaggaagantcgctgnaggactgtggggcaganttnagattggcacggggggtgccatgcatcttgttgtagagggtnnttncnntncccctnccnnnntgttccntttttgctncnnattgggtgnaatntgnnntttcnttttcatcttnntnntacttantntatttngtantgnagnggcagtggtngtcgnntgagggngaggatgcnntttttngttttttattgntgttangttagttggcttggttttgcccttcccctggctctttctgtgtttgtggcgggggcgttagcatggggcggctttgggggcgcgtgctggctgtggnt

SEQ ID NO: 493469 - DNA, 583 bp, Homo sapiens
agctgtgtgatgggattgtgtgtctgagggcctttgaaccatgtagttagtaggacttgctgactgttcatgggttatgttttacgagaaaggtctgccgcgcctctcagccatccagtttggctatgggagtgaagtgaacagaagggtcctctggctggagagcagagttcctgcctagagcagcagccaagctgcagcccatccacccactaacccatgtttcacaggctgcccggtgccctggagaaactggccccaaggtctgaccctgccctgcaggagctatgggtctgactgggagatggccttgatcacaactttctaattctgcatgttatgagtgactccattgccctagacccagaattccctggccacctccctgcagggctgtgaagcccatgacaggcctcaccttttctctgctggagcacctgctgtcacagaggcgacagctcctgctgggcttgcctgtgtattttttataagttcttctcaagtgtcacttgtcttgccaggtagatctgcagctccctgagggcagggaccatgaggtgagtgacctccatggagggtctga

SEQ ID NO: 493470 - DNA, 519 bp, Homo sapiens
tgtgctgtagcctacattctgtatcagatggctgctgccttatatgcactcgggtggggagtcgcaacctgccgctgtcctctgggtctggtctagccacaccagggtcaatgctcgccttgcatgtgtccccagcgaggacgcccagttccccaaggtgcattggtcagcccgtgtaacttctagttctgcctggcacaatgaacgcctggatgtgcccgtgtggtgacgtggaagccaccctcaacttcctcaaggtccacttcttcccaaacaacatcatcctggagcttccctgcagctgggtcatctgcccggagggatgtgcagaatgtggcagacctgtcccagatgctggcgatgggagcgcctgtgagctggaaagccggaattcaacgtctggaccctgggaagcctgagatgatgagtttccccaaaaacaccaccccacatgtgccggctgagggacctgagcttatttgaagtcctgcctcattctcactggagcctcagtctctc

SEQ ID NO: 493471 - DNA, 129 bp, Homo sapiens
tgaaattatatttacctatataatgtaattagacttataacacttttatcctgctttaaatcagccagaagttcatctattatattgtattttaaatataccacggtattagaatctatttactgttat

SEQ ID NO: 493472 - DNA, 486 bp, Homo sapiens
  misc_feature (145)..(145): n is a, c, g, or t
actctagagatccattgcaagcactgccggtgatatgtaatgatatgatgagtgtctaggggctgtggttaagagtagaaacgctcccatagtggctgtagctgtccatcttgtctgtctatcggatgctatgtacgtccaaagnaacacagcctcttgagtaaagacctcaacacagggggctctaccttcattcgcacctcggcacggtctcaaaagacagatgttcatatccatctcctgcttgcccagatccaaatccctccctgtcctgctattctatgagtctgcactaaatgcctaacacttctctccgagtgttcaattgctgagaacattttgtgctgaattcatcgaagacagccctgtgttaattcatatttagaacccaacccatttcccccagaagaagacagctagcaacagcagcagaagaggccgactggcaatatttgggttctggcagtagttataaaatctctatgc

SEQ ID NO: 493473 - DNA, 151 bp, Homo sapiens
actttctaagagcattcgttttggaggcgcgaggaccaggtaggttaagtgaacatggtgcaataccgagtttgcctgaggagatcctggtgcatgacgtcagtcgcttaggatatcggtcatcaatgacagaacgcccggaggagagaca

SEQ ID NO: 493474 - DNA, 728 bp, Homo sapiens
gtacttttgtggccttggtgtccgatggggctggagggagagtgctctccacgtgacccagcagcacacccatgtgcagtgcgcctgcatactgtgtgggggcagccacaccccttggctgctgtttcctatgggctgcctttctagggggcatgtagactaggacctacgaggtctagcactgagctccatttgaatgatacctttcctatcccatattcccccacgagaagcagccgcttacagggttattcagtcctctgcctcatggctgaaattgctcatctcgtctgcagatgtctactatcctgtctacctaatgcactattatgtattgattctccatgagacagagagagagagagactatcagatagtttacacccaaagggtaggttttgtatatatttccagccttttttattaaggggaaggggagagttataaaaacccaaaccgttgtggtattaaggtgtatcatttataaaagggagagagaatctatataaagctatatcagatcagggcatagtcatccttatatggtccaatgtataccttgtacttttaaaaaaactttttataagaggaaaactaatattagtcttaggtgtacactaactcttcgtggtacacattgtatatatgtattcagttcatatcatcagatatggttagccatctgaaagactggccaggggtctgaaagatcgttgagaataggagat

SEQ ID NO: 493475 - DNA, 107 bp, Homo sapiens
gagagacctcgatcccagatgcgaatgtctgatactgtcgtggtactgttgtcaaaactaaaagagtgacattgggacactaccattcaccaaaccccagtgcttca

SEQ ID NO: 493476 - DNA, 1609 bp, Homo sapiens
gacactgttccctgtgcatcagtacagttggcccagcctacagggcccggtcgatcttcatggtgaacaggttctatgtcagacgcttgtgtctctttttcccggatctctgtcgtccttccaacacgctacagagggcttggcatgggcgtccggggcgtcgttgatcgagtcgggcgatagcgctgcgagtcgatctggaccagtcagatgccaaggcagtctcgacgaacggatgaagggagtcctcgagtgacaaacatcccgtagagaccgagctgcgcttaggactccgtatagccatgtgacgtgagatgaggcatgcctgagacgcaccagtagaaacgcaggcacgtgctttggacgtagcttaacagatccaggagcatgcatgttgcaccaacgatggtgacctccaaagatgaggatgaatgtgtgagccaatcttacgtctcgacggatcatcggcatggaccccttgagaggccctcacgtagtcttatcggacttagagtaccttataggaaacgaacttgctcgcgctagtacgcttccgttgcaagcatttggacgagaatagccccagatacgtattggcatgacttagcattggcaccctatctcaaggacgctcccaaatctactagaagaaccagaaggcgtagtgggcgaatggcggccacgaagttcttgttgtgaagcaatgggaccctacgccatagggtgcttccagaaacggttccctttggagtcgaaccactctggagtaattcatcgatcaagtaacttgcggacgctttggggacatcgattgcaggatctccgatagatgcctcatcccatctagtagaagtagacagcatttgctttcggtatcaaattggagatgaaatcgaaaacacatcgacaaagacctgggacaccggttaacagagaggggcccttaccaacaggcgcccacaggaattttgacccaggcacttccttgcagaggatctatggacaccaggtgtggaagaggtaagcaattggacgccccactacagagttcttcacacgtgtaacccttcgggcacaagagaatttcgattggggcagagaccagttcccgagaggcccctatattcagttcgacctgaatggccgttggactttctgggaaaaggaaacacagagtgaatggaagacctaggacacaacaagttaccttggggtcatacagagggcaaggattttggacaggaagacacgcaaaccaaccagttgggtccaccacacaagacgaggatcatgggcgtggcaggggtattggggacaggcttggctttgtagcaagtcggaacggctttcatccaagaaggctgtggacgaaaaccgataacacggtgccccaggctaccatttgtgcgaggacatttcggcaccgtgtggaacatcccagtgacagacaaatacttgaaagcggaccgagttttggcagtaaacaggccagtcatggggaagggtgaagaaagggcgcgggatagcggcgtatcatgaattgtgagcaggttcacagggggagtatcccgtggtgagcacccattgcgatactagggttggacagaga

SEQ ID NO: 493477 - DNA, 339 bp, Homo sapiens
tttttttttttgagactgagtctcactctatcacctaggctggagcgcagtggcacgatcttggctcactgcaacctccgcattctgggttcaagcgattctcttgcctcagactcccaagtagctgagattacagaagtgcaccaccacaccccgctgatttttgtatttttagtagagaaagggtttcaccacgttggccgggctggtctcgaactaccgacctcaagcgatccacctgcctcagtctcacaaaatgttgggattacaggagtgagccaccatgcccagcaggcatgtccatatattattatactgcacaatattccccgtcgacgc

SEQ ID NO: 493478 - DNA, 241 bp, Homo sapiens
acagggaggccaggtgttctagtggtggagttccaccattttggggtagtatctttgaccatctttggtgacgttacgttatcccagggtgaggtggaaaagcgtctcacctggaacctgatatatactcaggctgcacttccataccacttcccacataaacggggccacacattttggcactcttatctctggcatccctcatccccgaggaggcatctccatatccccgagaagagga

SEQ ID NO: 493479 - DNA, 500 bp, Homo sapiens
  misc_feature (19)..(20): n is a, c, g, or t
  misc_feature (33)..(33): n is a, c, g, or t
  misc_feature (38)..(38): n is a, c, g, or t
  misc_feature (40)..(41): n is a, c, g, or t
  misc_feature (59)..(59): n is a, c, g, or t
  misc_feature (63)..(63): n is a, c, g, or t
  misc_feature (66)..(66): n is a, c, g, or t
  misc_feature (70)..(72): n is a, c, g, or t
  misc_feature (82)..(82): n is a, c, g, or t
  misc_feature (104)..(104): n is a, c, g, or t
  misc_feature (209)..(209): n is a, c, g, or t
  misc_feature (216)..(216): n is a, c, g, or t
  misc_feature (231)..(231): n is a, c, g, or t
  misc_feature (235)..(235): n is a, c, g, or t
  misc_feature (242)..(242): n is a, c, g, or t
atcgagcttgggacccganncagtttacacaanctgcntnnaatccaagaaatcctagnatantcngaannncatgcatatncatttagtaagacctacatttntaaatgtatatgcatgtatttcagattatactaggatttcttggattagaagcacctacatttctaaataaattacatgcatgatatacaataaagaatactaanatgaaanttcaggacatttatntttntgcatgnaaatttaactactgtataacacacgcacatacaaaacaaacccacaaagcaacagtgtgtaataggtagtgagagacacacaaaataagcatatttaaaacgcctacaaacagcctttttttttaggcaacaaaatacgtccagtccttgacatcttctcatactcacctagcaccacagatgcaaggacctaacagtaaacatgtacaatctcatgcttaacacctaaagcatgcactgaatttgtgtaaactgatt

SEQ ID NO: 493480 - DNA, 141 bp, Homo sapiens
gtgaccaagaaacacaggcatgaagaacacttccaaaaacaaataccccgagaatccagtatcataccagcaatgatggaaatgatgggcaacccaagattctgaatggacttgcatgaagccatatgcagttcccagcgt

SEQ ID NO: 493481 - DNA, 437 bp, Homo sapiens
  misc_feature (19)..(20): n is a, c, g, or t
  misc_feature (33)..(33): n is a, c, g, or t
  misc_feature (38)..(38): n is a, c, g, or t
  misc_feature (40)..(41): n is a, c, g, or t
  misc_feature (59)..(59): n is a, c, g, or t
  misc_feature (63)..(63): n is a, c, g, or t
  misc_feature (66)..(66): n is a, c, g, or t
  misc_feature (70)..(72): n is a, c, g, or t
  misc_feature (82)..(82): n is a, c, g, or t
  misc_feature (104)..(104): n is a, c, g, or t
  misc_feature (146)..(146): n is a, c, g, or t
  misc_feature (153)..(153): n is a, c, g, or t
  misc_feature (168)..(168): n is a, c, g, or t
  misc_feature (172)..(172): n is a, c, g, or t
  misc_feature (179)..(179): n is a, c, g, or t
atcgagcttgggacccganncagtttacacaanctgcntnnaatccaagaaatcctagnatantcngaannncatgcatatncatttagtaagacctacatttntaaataaagagcaggcatgagatacagctaagcgagactaanatgaaanttcaggacatttatntttntgcatgnaaatttaactactgtataacacacgcacatacaaaacaaacccacaaagcaacagtgtgtaataggtagtgagagacacacaaaataagcatatttaaaacgcctacaaacagcctttttttttaggcaacaaaatacgtccagtccttgacatcttctcatactcacctagcaccacagatgcaaggacctaacagtaaacatgtacaatctcatgcttaacacctaaagcatgcactgaatttgtgtaaactgatt

SEQ ID NO: 493482 - DNA, 436 bp, Homo sapiens
  misc_feature (46)..(46): n is a, c, g, or t
  misc_feature (48)..(48): n is a, c, g, or t
  misc_feature (50)..(50): n is a, c, g, or t
agtctcaatggtgaaagtaaatttaaaatttttattttggccaggngngntggctcacgcttgtaatcccagcactttaggaggccgaggcaggtggatcatgaggtcaggaggttcaagaccagcctggccaacattgtgaaaccccatctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttacatctatttcttatttcaacaagttgagttatagtaatttagtacaaaacaacg

SEQ ID NO: 493483 - DNA, 402 bp, Homo sapiens
  misc_feature (167)..(168): n is a, c, g, or t
  misc_feature (170)..(170): n is a, c, g, or t
  misc_feature (244)..(244): n is a, c, g, or t
  misc_feature (261)..(262): n is a, c, g, or t
  misc_feature (373)..(373): n is a, c, g, or t
  misc_feature (385)..(385): n is a, c, g, or t
ctggggtgcctgtgctataaatgagtttcttcacatgaaaaacacagccagcccaagatgacttatctgggtttaggattcaatagtattcactaactgcttattacatgagcaattttcatcaaattctccaaacttcttaaaggaatgctttcggaaaacacgcnntngtataccctagatgatcgactaaaaatgcaaaactccttgggctttggttctttcttctatgtaaggatttctnaaaataactgccgactnntcaaaagggtgtttcttaaacacgacaaaataaactgttaaagaaaaattgtgaaagctcttggaaaacccacaattgtgtaaatatccatgtgtattttttcattaaaanggtttctgtaantaaattttctaagatta

SEQ ID NO: 493484 - DNA, 267 bp, Homo sapiens
tgagacggagtcttgcgtccgtcgcccaggctggagtgcagtggcgcgatctcggctccctgcaagttcgcctcccaggttcggcgcgatctcggctccctgcaagttcgcctcccaggttcatgccattctcctgcctcagcctcccgagtagctgggaccacaggcacccaccaccacagccggctaatttttgtatttttagtacagaccgacgagctggtcttgaatgcttgggctcaagtgatctgcccacctcaggtcgac

SEQ ID NO: 493485 - DNA, 970 bp, Homo sapiens
  misc_feature (46)..(46): n is a, c, g, or t
  misc_feature (48)..(48): n is a, c, g, or t
  misc_feature (50)..(50): n is a, c, g, or t
  misc_feature (734)..(734): n is a, c, g, or t
  misc_feature (755)..(755): n is a, c, g, or t
  misc_feature (763)..(763): n is a, c, g, or t
  misc_feature (835)..(835): n is a, c, g, or t
  misc_feature (845)..(845): n is a, c, g, or t
  misc_feature (852)..(852): n is a, c, g, or t
  misc_feature (859)..(859): n is a, c, g, or t
  misc_feature (866)..(866): n is a, c, g, or t
  misc_feature (884)..(884): n is a, c, g, or t
  misc_feature (926)..(926): n is a, c, g, or t
  misc_feature (939)..(939): n is a, c, g, or t
agtctcaatggtgaaagtaaatttaaaatttttattttggccaggngngntggctcacgcttgtaatcccagcactttaggaggccgaggcaggtggatcatgaggtcaggaggttcaagaccagcctggccaacattgtgaaaccccgtctcgagcggggtgcggtggctcacgcctgaaatcccagcactttgggaggccgaggcgggcggatcacgaggtcgggagatcgagaccatcctagccaacatggtaaaaacacaaaaattagccaggtgtggtagcgcgtgcctgtagtcccagctactcgggaggctgaggcaggagaataccttgaacccgggaggcggagtttgcagtgagccgagatcgcgccgcgccgacccactgcactccagcctggcgacagagcaagactccctctcaaaacaaacaaacaaacaaacaaacaaaaagcaaagcctgatctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctggtgcttggactattttgtaataattaaactttgatgntgagaaatcccactttattgncacttcantgcacttgaattcatggcttaaagtgagattggatttctaatgacgcctttagtaatcccaaccataaggtnaaatctatgnatattgngtatatntaaaccncgtttaacctaaatgganttcctggttaattccagggaagactggttgggaaacttttantaggtggttaccnaatactggtcttcctttcggcataccctaat

SEQ ID NO: 493486 - DNA, 228 bp, Homo sapiens
tagcaggcgctccagagtgtacttgaagccgatgtgaaaggatggctgctgattgtctagcaagtgaccctgctgaaaaactgtgtggggcctgtgcaaacttcgacgggaaccagaccaatgattggcatgactcccaggagaagccagcgatggagaactggagagcgcaggacttctaccccatgttatggctagaatcagtcatccaccaggaacgaagatttc

SEQ ID NO: 493487 - DNA, 204 bp, Homo sapiens
  misc_feature (46)..(46): n is a, c, g, or t
  misc_feature (65)..(65): n is a, c, g, or t
aagggacgggaggggaccccttttttttttttaaggaaacggggcnattttaagatgtaaaaccnaaactttaaaagtttggtcgggtcgtttgtatgaaaatttgaggctttgggttaaatctttccctggattgtgatttccctttagatgtattggactaagtgaaacttgttaaataaattttccttttaaaaactggga

SEQ ID NO: 493488 - DNA, 1964 bp, Homo sapiens
  misc_feature (1889)..(1889): n is a, c, g, or t
gtgccctgcagaagcgcgctctgttgcagtatcgtggttcctgggacggtgtccctgcgagtgattgcgcgagcagtgaagggtgcgcatctgcaggatatcggcgagggagtgactgttgctgcaccttcccgtgccataacgatcgctcacttcctcaagggactgcgtggcgatgcgcgcgtgtgagtctagcgctgtaagcgtctgctcgctggcatcgcgtgcatccttatacctgccgtgtctcatgagcgagcctcatcgcgcggccacacaacagtctacactccttccgctttcgcgtgctgaatcctagcgcatctaagcctagcggggatggatcacctacggcgcgtggccacgcgcgagcgagtaacttctcaaagtctcgctttccctgtgctagactctcggagacttgtacactagaccgaccgcaccagtgctggtaacagcatgacgtcgtaggcaacctatggcgcgtgaccgcgcgcggcaggaagggacgctaacgcaccagcctaggaaggctaagccttgtgcgtgttccctcgggtgcagacaaaccgcaccgtgctgattacccttgggctgacctttcgcaagcaccgacataccgaacgaagcgcacgcccctgcagcgaccaccgccacgcgaacaggtcaacacccgctggaccgtagcactgggcggcaccttgcgtcactcgttgcgcaggcaccaaacaccaccatgagacaacgaaggcaacctggccgcgctggcgaccgcagcggcgcacaccaccgctgcgcctacaagccctccactcgcgccctagcctagcgcccccccccccactgccgctcggaccccccgctgggactcctgccgcacaccccaccacgcgagcgcaccatgccccatcacccaccaccgcctcacacccccctagcgcactcaccgccgccgccaccggcgccccaccgcacacgccattgctgccgcaccctccccttacgacaacaccgcccggcccacacacctggcagcatccccaaccccagaaacctcaagcgcgcacacccatgctcccactaaacagcaggcggcccggacgcccagccgtcctgccccgcggcaccacacgcaccagcgcgaagctccaacatacgcacccccctccgcaccccccatgcacgagcgccccagccccccggacctccctcgccgagccactcgcatcgctcccccgccggaccctgcgcctccgcccccccgcggccgccctcccatcgctttggcccccggcgtgacttctgccgaccactagccgctcggccccccccttagcctcgccctacggcacagtgaacccccttggggcgctccaactggggcccgagcgacctccggacgcaaccccttcggcgccccctatgtcagcatatcgcgaacgcaccccgcgctaccccccagcgcacacccagcacccacgtcagcacagcgacacgtaggtccccgaactggtcgcgcactcatcgcgagccacatcccacccgcaccccgaccacgactcctacaccccacctgcactctctggccccgcccggctcccctcctctccacaaccctctgcacactctccgcgacccctctctcaactcacggcccgacccccacacatccacatccccacacctacacggcaacaacagtaccacaacacacagcaccacacaattacccgaagcccacctgacccacaccacaacagcatcgcgggcctcgcacacacatccacacatccactaggacactgcacaacaccgctcagacgatctaacactacctcacgatagcagcgacgaaccccaacccactgcactccagctcgctgaaccanacacacgcacaatcaatagacaccacgcccacatacatcctactaacaacagctagccggcttccagcaacatag

SEQ ID NO: 493489 - DNA, 231 bp, Homo sapiens
  misc_feature (9)..(9): n is a, c, g, or t
  misc_feature (64)..(65): n is a, c, g, or t
  misc_feature (76)..(76): n is a, c, g, or t
  misc_feature (91)..(91): n is a, c, g, or t
  misc_feature (139)..(139): n is a, c, g, or t
  misc_feature (172)..(172): n is a, c, g, or t
  misc_feature (185)..(185): n is a, c, g, or t
ggtgtctgnataaccctttgtggagaatgagattccccccacctgtgttgagaaaaataaacannctggagtcttngttcctgactcccanaaggaacgagagcattcccaggaaagagagattccctcggaaaatttnaaaatgtgaatcctagggggaaattggggattntgtctttccctgnttgaaaatgtttggatgggaataaatattcttcaggaaacataaaa

SEQ ID NO: 493490 - DNA, 406 bp, Homo sapiens
  misc_feature (40)..(40): n is a, c, g, or t
  misc_feature (241)..(241): n is a, c, g, or t
tgttgttggtgaatataatgacgttgttcttttttttaanaaaatttgtatttttaatttttgtgggtacacataggtgtatataaggcatgtgtgatactgtgatacaggcatgcagtgtgtgtaaatcacattggggaaatggggtccccgtcacttcaaacacttacactttctttgtgttacaaataattcagtgatacttttcgttatgtttaaatgtgtgataaattattgttgnccatagtcaccctgttgtgctatcaaatactaaatcttactcattctgtttttgtactcattaaccatccccatctcttcccccggccccattcctcttccgagcctctgggagccatccttctgctctatctccatgagttgaattatttttatttttagttcc

SEQ ID NO: 493491 - DNA, 285 bp, Homo sapiens
gcgagtatcgaggatgcgcgcctgcgccgccttgccgccaggcccttctgcagcaacaggtttcgccgatctgcttttcgatgctgtgcagcgggttgagggaggtcatcggctcctggaagatcatggcactgcggttgccgcgccaattttcgcaaggtgctcggtgaggcgccgatcagttcctggccgcgatacttgatggaacccagggtttcggtgccggctttttgcagccgttgcagggatcgaatgggccgtcaccgacttgcacgagcccgactc

SEQ ID NO: 493492 - DNA, 166 bp, Homo sapiens
ccccccccccccaaacagggcccaaagtgtgatgttccccctcctggggccatggggtttcattggtcatttcccccctatgagtgagaataagctggggttgggtttacccctttaaaattttgaaccatgttaattatattttttaaataaatttttttaatga

SEQ ID NO: 493493 - DNA, 1069 bp, Homo sapiens
tatgtattttaggggagagagcgaagcaagcagcccaatagggggggcgcacgcgggggagggggggggggggggcgcaaaaaagggcgcccgacgacgcaaaaacaccggggggtcaacaaggaggagacacacacaggcggggggcgccccccgtcgggggagagagaaccacagagagaaaacacacacaagagagaagagaccccgcgcgagtgattgtggagggagagagagcgcgagcggcgagcgcaggggaaagaggcgcggggtgcgccctctagagaggaggcgggaggggaggccccactctccagagagagcggaacaacacaccaccacacaccacgcgcgaggaggccccccgctgccgaggagagcggcgagaaaaaaagagagggagacaactgcgtgtgcgaacaccgcgcgtgtgtgagcacaaaaagagagcgagagcgcagcgcgtcgtgagcgagagcacacaaccaagagagaccacgaccaacacacacagagaaagacacagagagtgaagagggtgccgaccccacccagcgcgggggggacaacaaagaaccagcgaagagcggcgcggcgccgccgcagagagagacgacggaacagcacacagaacaaaagctgctctctgccaaagaagagacgctcctatgctgcgagacgaaacaccaccacaatcactctctctcctcgcagcggagaggagagaagagcccactgcgaggagagagccgtaccacccagagagaagagcgcggagaggcagagaagaaaccggtccactcaaaagtgagtggcgatgcacaccacgcgcagtgagaaaacacagccgagggctcaagcatggatagatgaggactgcagagataacaccccgccgagaagaaggaaccgctcaccagacaccgcgggacataacacaacaagagaagtgagatgaatcagagacgacaaccacgccgcaggagcagagagagcgcggcgcgacaccacacaccaagcaaacccgtcccggcaacgaaatcaaacaagaacagcggtgcgcagcatc

SEQ ID NO: 493494 - DNA, 131 bp, Homo sapiens
ctctccagtcgcaaccgaagccggattatcttctcttcatcctactcagactataactgtttaatctctcgtttctgctggtccttcatggtctctagtatactcctcaactcgcggacctctgtccttag

SEQ ID NO: 493495 - DNA, 530 bp, Homo sapiens
ttgcagaagtatctctatgatctgtctgcataatgggagactggctcacaggtcttatcttaaccagacattccttctactgattccaggtctgagacataacttactctttaaccaattgccacatagaaaattgtggaattcatgtatgacttggacccccctgcttagagttgtcctgccttttgggactcaaccaatgtatagcttagatatattaattgatgtcatatgtcctcctaaaatgtttaaaattaagctgcagccaaaccaccttgggcacctgttcttgggatgtcctggggctatatcatgggccattgttcactcacatttggctcagaataaatatcttcaaatattttacagtgaatctttttgtcaacattgtatgggcaataagttaaagaagaatatttaaaactgaaaaactaaattgtaaaatgttaagtagtaaagtgggactaagagcattaaaaatcatgtaaatactagagtaaaaaatagagtataaaaatactaaccattaa

SEQ ID NO: 493496 - DNA, 379 bp, Homo sapiens
taatctgtactcattgcgtagagagcaaactggtggttaccagatgctgggaagggtggaagggagcagtgaagggaggctggctactggctacaaaaacagttagaaggaataagttctagtttttgatagtatggtaaggcaactatagttaacaataaagttatgtatttcaaatagctagatgagaagctttgaattattcccaacacacacacaaaaatgatcattgcttggggtgataaatatcccaattatcctgatttgatccttacatattgtatgcatgtatcaaaatataacatgtaccccataaatatgtacaactattatatatcaataaaaaattgtaaaatgcaatcgcaatgagtacagatta

SEQ ID NO: 493497 - DNA, 175 bp, Homo sapiens
ctgctttagaggatccctcataggttcgcaggatggaaagttttcaggttcccaaagggaactctcaaatccaaaagggttatctttgagaccattccattctcctcagtggcttctccagggaattcttacagccaagtggtgacagtcacggcatgggcctgcgaacctatga

SEQ ID NO: 493498 - DNA, 243 bp, Homo sapiens
  misc_feature (59)..(59): n is a, c, g, or t
aggccccccccgggggggggggggttccccttttcccccaaaaatttttttgggggggngggggggggaaaccccccccccccggggggcccccccccgggcctttttttttgggggcttttgggtatttttccccctttttttttccccccccccccttttttggggggggggggtttttttttttttttttttcccccccgggggggaaagttttttttttccccccctttccccttttta

SEQ ID NO: 493499 - DNA, 474 bp, Homo sapiens
caccgcttattctttttgcctttttaacaaacatattatccgaattttttttctgcaagccactgatagtcgctgctaactagcttaattgacctttttacaaagtttgatccccaagcatcctaaactaaatcattgaatacttaaatcaggatattatctgctttactttacaaatccaaatcttttgtcaacaggatgaaacccatcttaaaggaaagatctgtgtccatcaggaagtttgtcctgttaaccaaatggttactgcactaccagggttactggtttatttttcagggagctgttaaagcaggagaactgttgctgcatgttttttatttggacctccgcacaatttggtaggatatccttaaccaacttccgacacttaacaaacttggtttaaattttttttttttttggaccatcctactacagattttttggacttaagggacatctttagacccattt

SEQ ID NO: 493500 - DNA, 259 bp, Homo sapiens
ccagtgcattccagccttggagtgacagagcaacactctgtctcaaaaacaaaaattcgtgaagacccataataattaactacggcttataatgcacctaaataactaatacacacacaaaaaaaccagtgatgtaatccatatgatctacctatggcatacctgggtatttacccaattgagtaacaaacctatacgtccacacaaaaaccggcatacatgtgtatctcgccgtttaactcttaatggccaaaattgg

SEQ ID NO: 493501 - DNA, 183 bp, Homo sapiens
catttctatcacatacccgaatttttaaagaacgatctaatcaaagactagaaatcaacattcaccatcatcaggatggaatgctcatttctatagctctaacaacagaaacagcagatagtggtggagccaaactgggatcgagacctgttgacctccttgcgtacgcgagataaaacttct

SEQ ID NO: 493502 - DNA, 499 bp, Homo sapiens
  misc_feature (417)..(417): n is a, c, g, or t
  misc_feature (423)..(423): n is a, c, g, or t
  misc_feature (452)..(452): n is a, c, g, or t
  misc_feature (494)..(494): n is a, c, g, or t
gcagcccagctggggagctagcatgccaggttggtctttaggcaccagagtctttaacaaaaaaatcctctagtactgtgtggttttctattcttccagttcactctcctgactgttcagaagcattttgctctcttttgcattttcttttaccttttttttctaatactgctttggtactagccagtgtggggaagagatacagtatgttggacagataaaaacatgtgttatttcttggtcaattttctattcatattccttattttggccaagttcttttgtttgtgctttgtaacataaggtacttgggagaccaagctgccctccttggcttttggctttttggtgtccttgaaggagaccagtcatgagtaccaaggaatttgtcagcttgggttctagaacttagcagangttganctctgctgcacattggcagaccaggtcangatgtctgcagttggagatgtaaatattttgtacagtaaatnaaatg

SEQ ID NO: 493503 - DNA, 255 bp, Homo sapiens
cgtataagcgagggcaacaggcctcagatctgtgtctctaagtagagctctatgaaacctctccacagtttctcactatatacgcatggctgagactgtgggatccttcttcatggctgtcatccacagcttaaagaatggaccgcgggctacacacttatttcacttcattggtttcaaccgtgtcaaaccaaggccagatgatggaatcactcatagcgatatgattgccaccgtggcacgttcttattaggc

SEQ ID NO: 493504 - DNA, 345 bp, Homo sapiens
atatgactcctttgtgtatttactatactatacttttcattgtcattttagaatgtatttcttctacttacaaaataaaaaagttaactgtaaaatggccttaggcaggtccttcaggaggtattccagaagtcactgttatcacaggaggacagctccatgtgtgttattgcccctgaagacagtgggacaagatgtggaggtagaagacagtgatactggtgatcctgaccctaacgtgtgtaatgtgtgtgttcgtgtcttcattctaagaaaacgttttgtacagatgtacagtgtgtttgagtttaagctaagtgttatttcaagagtcaaaaagttaaa

SEQ ID NO: 493505 - DNA, 473 bp, Homo sapiens
  misc_feature (98)..(98): n is a, c, g, or t
  misc_feature (112)..(112): n is a, c, g, or t
  misc_feature (114)..(114): n is a, c, g, or t
  misc_feature (119)..(119): n is a, c, g, or t
  misc_feature (149)..(149): n is a, c, g, or t
  misc_feature (152)..(152): n is a, c, g, or t
  misc_feature (177)..(177): n is a, c, g, or t
  misc_feature (187)..(187): n is a, c, g, or t
  misc_feature (206)..(206): n is a, c, g, or t
  misc_feature (217)..(217): n is a, c, g, or t
  misc_feature (227)..(227): n is a, c, g, or t
  misc_feature (231)..(231): n is a, c, g, or t
  misc_feature (235)..(235): n is a, c, g, or t
  misc_feature (239)..(239): n is a, c, g, or t
  misc_feature (243)..(243): n is a, c, g, or t
  misc_feature (247)..(247): n is a, c, g, or t
  misc_feature (285)..(285): n is a, c, g, or t
  misc_feature (287)..(287): n is a, c, g, or t
  misc_feature (306)..(306): n is a, c, g, or t
  misc_feature (311)..(311): n is a, c, g, or t
  misc_feature (338)..(338): n is a, c, g, or t
  misc_feature (343)..(343): n is a, c, g, or t
  misc_feature (352)..(352): n is a, c, g, or t
  misc_feature (356)..(356): n is a, c, g, or t
  misc_feature (358)..(358): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (381)..(382): n is a, c, g, or t
  misc_feature (386)..(386): n is a, c, g, or t
  misc_feature (389)..(389): n is a, c, g, or t
  misc_feature (395)..(395): n is a, c, g, or t
  misc_feature (428)..(428): n is a, c, g, or t
  misc_feature (442)..(442): n is a, c, g, or t
  misc_feature (450)..(450): n is a, c, g, or t
  misc_feature (456)..(456): n is a, c, g, or t
  misc_feature (465)..(466): n is a, c, g, or t
ccggctttgtgtgccgcgcgcgggcccgggccgcccgcgcctcgcctgggttccggggccgccgctgacccgcccgggctccgagcgccgcgcccgcngggccggccccgcntnctgcnctcctccgcctccgcctcctcctgccgccnggngggcgggctgcagccgccctccgcnctctcctgcnagctccctcgccgcgcgtncgttctccgtnctcccgggcnagcnagcnagcnagcnagcngggccggcggcgggcaccaggccgtcccgatgcccgancnaggccccaggatgaacggnttctngctgggcgagctgtgctggctcttttnctgcncgccctgcncgancngcatngcngcnaagctggccttnntgcngcncgatcncacctatacggtgttggtgctggatcagcgcgncgccggcgcgttcnctccggcnccggcncaggatacnnctgctgc

SEQ ID NO: 493506 - DNA, 154 bp, Homo sapiens
atgaaatatttatttatcctgagatacagggaacaggatattcgatatatgaatgagtctgccatatgtatatatatcagtatctctagtaagtatgatactatcttccatgaattagaattactgtagcatatctaagctccttctgtgctgt

SEQ ID NO: 493507 - DNA, 104 bp, Homo sapiens
  misc_feature (9)..(9): n is a, c, g, or t
  misc_feature (16)..(16): n is a, c, g, or t
ccctcattnacacganaaaacaccctcatgttcaaacccctatcccccattttcctcctatccctcaaccccgacatcattaccgggttttccttttaaaaaaa

SEQ ID NO: 493508 - DNA, 398 bp, Homo sapiens
  misc_feature (23)..(23): n is a, c, g, or t
  misc_feature (132)..(132): n is a, c, g, or t
  misc_feature (266)..(266): n is a, c, g, or t
  misc_feature (276)..(276): n is a, c, g, or t
  misc_feature (390)..(390): n is a, c, g, or t
  misc_feature (392)..(392): n is a, c, g, or t
  misc_feature (395)..(395): n is a, c, g, or t
  misc_feature (397)..(398): n is a, c, g, or t
gttttgccttaatgtaaggaaanggattttccctaattacccctcaaaacaaaaaagcttttagtgttttattgccatgttaccaaatattaataacatgaaaaattaatgagcctaggtgcggtggttcanacctgtaatccccagcactttgggaggctgagcccaggtggatcacctgatgtcaggcgttcaagactagcctggccaacatggtgaaacccgtttctactaaaaatacaaaaattagctgggcatggtggcancgcctgtaancccagctacttgggtggctgaagcaggagaattgcttgaacctgggatgcaaggttgcattgagctgagattgcaccattgcactccagcctgggcaacaggagtgaaactctntnttngnn

SEQ ID NO: 493509 - DNA, 269 bp, Homo sapiens
cttctactccacaaacaccggtgatacacattccacgtcaatacatggctgatgcaggaaaattgcttgaacctgggaggtggaagttgcagtgagccgagactgcaccactgcactccagactggtgcaacagagcaagactccatctcaacaacaacaaaaagagtattgaagtggctaaatattattggtgtatagtttatcttccctccaattactgcagtttatacttcatgtactttgagtttctgtctgtggaggtagcact

SEQ ID NO: 493510 - DNA, 217 bp, Homo sapiens
gattataggtctgtcggtagataagcagatgacgctatgtaataattctgcctcatagggatagtacaaggaaggggtaagctatgtgtcatgtcagggggtcgagaatgagtgtgaggcgtcttataccatagccgctttagttgtaagagtactgcggcaagtactattgacccagcgatgggggcttcgacatgggcttaagggagtcataagt

SEQ ID NO: 493511 - DNA, 160 bp, Homo sapiens
ggcctcattgcttatacttctcaacgcttatacttctcattgcatttccggtatgaagtataaacgcgttgagaagtataacgcgttgaggagtataaagcgtcgagaagtatcaagcgttgagaagtatacacagcgttgagaagtataaagcgttgag

SEQ ID NO: 493512 - DNA, 1655 bp, Homo sapiens
ccaggccggatgcccgcagtcctggggcgttgtgggagggctgcggctggacctgcggtggctacaagaaggcagccggacccccgcaccgcaggcccggaccatgacaggacgcgcgagcgaccagcgcagctcgcgtgcaggcatgaacacacctccgaactctatgcaggcgtgccatcacagaggataggactggagggagaggggcgtgcaagataagtataccacgggatggacgctgatgagaccgacggacgtaacgtgtataagaagggctgagaaagtacactggtgagaatcacaggagaaatgagaatcatgtgaaacaaaatacacatgaggaaacatcagaagatcaaatacaagaagaccaaaaagcatctgacacttacgcacaaaagagacgcgttgaggagcagtgaaagaaagacgggttggacgaccaaggacaaataaaaccgtggggacacacgcaatcgagatagaaatagggagatcaatagggaaagagaccgatcaggcacgcacactataacgacataagtggaaatttacatatcaccagtggagagcgtgcaatagaaaataacagcgaacaaagcaaaagacaccaaaggggagaaacagacaaaacaaaacacagtaagacaaaggagaggagacagccaagagaaagttcaaagcgaatcacccagaaaaccgcccatggagaccacaatagaaaataaacaccacgacaaaagaaagagacaccaacaacgaatcagcagtaaaacgacccaaaagaccatgggacacaccactcaagaacaacccagagagaaaagcccgcccttcggcaatacaaccagacgaggaaaagcaaggaagcgcgatgcaaagagataagaagagcaaagcgagcagaatcgcgggcacgggaagcaaaaaggggcatcacggcagggcacgcagaaacaggacagagaccggaacaacacacaaacggaggaaccacaggaacacacaccggaagaggccaccacaaggagaaccagtcccgacgagcggcacagggcaagcgcgacgcccgaacagcccactatgataaaatgacaagacagaaggacaaaagaacgatacacaagcaaacatgaaatggagcagctgaaccacacagggccaaaaaacacaagacgcagaccaaacagcaccaacagagaaaaacagcaacaggagacccatgaacgaaaacgaaaacacgggccgcagcgaacccgagcacaacaacgcacacccaccaagcacaaacgcgacgcgaaacgacagcaagacgaacacaaaagcaattggacacagataaacggacagccaacggcgaacgcgccaagcgggaacacccacgagctaggacaagcgccaagagaaggcagaacacaaacagaggaccgaggacgagaacacaccggacgagacgcacacaaacaggagcacgagcagaaacacgccggcagtagaagaaacaaagaacaccgtagaaggacagcaacaagagaaagacaaaggagagaagacaagacaaagacagcgcagacacatacacggagagacggagagacacaacagagcgggagcacaagggacagaagaatcagcgacagtagcggccacac

SEQ ID NO: 493513 - DNA, 162 bp, Homo sapiens
caatgttagaacggatgccattcttagagctcttgggagttgacacgtcagcagcattcccagggacccacaggcgtccagagcagcagcgcacaaagaaattactgtagtgtgacaggattctaggatgaacatgtccatttactcctggcattcctgact

SEQ ID NO: 493514 - DNA, 265 bp, Homo sapiens
tcctctccggctgcctcacgctctcctgcaacagcatccaccggattctcctcattatccttctcaagggctgcgatatcttcaggggcctctgaacagtcgccttcctccgtcccctcttccgctttgcagtgaacaacggcttgcttggggtacatcaggtcgtgcttgtgttccaggcgagtccaggcctcaggaatggctgtcctgttgctctgcatgcactcggctctctgtaccttgcccaggtctccatcaggcatca

SEQ ID NO: 493515 - DNA, 292 bp, Homo sapiens
aggtttgggggtttccccctttttcccccccccttttttgtggacccccggggggtttttcccccccggggcggttttttggggtttcaccctttttttccttatggtttgttgggctttcccttggggtcccccaaggggggggtaaaggggtcctttccgggtttggcttttgatttttttgggggggtttgaacccgttttttttcctttttttttttggggtttttaccccattaggtttttgttcccccggggttggttttttccatttaaaaatttttaaccccca

SEQ ID NO: 493516 - DNA, 297 bp, Homo sapiens
ccctgggttttttcccttagcggcttaaaaaagccttgggttaatttttttaaatatcccctaaaaaatcatagttttggggtagcccttgttttttaatgaaataactgcccctagagaaaactgtttaaaaccctttaattggccgtatttttgtaaggttcccttttgtaaaaagaataatattccaagacttttgtagcctccaaagtgaaaacttggttttgcgaaactatccttgtattaaatgggctttttaaataaaagctcgtaccccccctaattaagggcttgcca

SEQ ID NO: 493517 - DNA, 269 bp, Homo sapiens
gaactgctgcaaatatcgcctttatatgtgggggtaacgtgtggggagagggaaagtattcctctatgaaccctatgattaggtctcagtcttttagtgagcatgtggcttctggaatgtgaactttacaagtgcttctcagtttttttcttcccccttaggtgggacaagatggccagagtgggctggcgttgggcatttttcccttctcccaggccagttaggctcgtgataaaactccagccatttaggctctgattaaattcctc

SEQ ID NO: 493518 - DNA, 226 bp, Homo sapiens
cggctatggcataacagccaggtcctatgcctacctgtgcagtctgatgaaagacttcagcctctgctccatcacctccagtcattcctacactggccaagtattacagtacccagaggaaatgttgggaagatttctttacatcagattgatttgctttctaccaaatccttcccacctagcatgcgtcagggacataaagccttgcgggaaaatcaccaccagg

SEQ ID NO: 493519 - DNA, 1028 bp, Homo sapiens
cttttactacaggatttcactctctctatataccaatctagctgatgtaaggggatttatcatccgctgtggcacatgtacagatgaatctgagatatggggagtaccgggacatatgagtcacggcagtatgtcaatgtacccgtctcggttggtaacataactggtctcgagatcaatgggtcctcttgcacttccacttggtccaatttacacgtacacaaaattcatgcaaggtagaaggccctctgtgcacatttcttcctattaaatcttgtgatctctggttcgtatataacatgctcacgctagactcattctatggactccatgcaatgaacgtaggcatgaagggttgcagacgatagatgactactaattatcatgaaacataggcttgggggtactgaatctgggttcaattatactatggttctaaaatggatattaggacgtgtgcactgatagtagtttataacatgtgtaaaaaagtttggcagaaactcgttccatggcaagattgaatggaaaaaacatttatactactgcttaaaaagcttaatattagacacagggagataataagtattaattacaggggagttaataggataaagatcaaacatacgaaaataaattgttgagcaaaagaaagaacaggatacgtctcccacaaggaaagacgacactgaaaaaacacctcggacagtcctaccaagggagggactcacaacatggacagccaatatgctaccatgaacggtgtgatccgcacctctatcatcgagacaagggaacgagagaccccgcacctacatacgccatacgaacaatgtaaggggagaataagacacggcacgaggcacaacaggcgcgcaacgacaacagacggccggggacccggccagccaacaacaacgcagcccgagagaggaccagacgggaaccacacacggacagagacaacaaacgagaacagcaaacgagccccacacgcagcggcaaaaagcaggccgcaggcacaccgc

SEQ ID NO: 493520 - DNA, 1197 bp, Homo sapiens
tcgccggctccctttcagtgtggttgtcccccacaacgatttcgcgtcgtgggctcactgctttggtgtccgccccccccgcgaggggggggtagaaacacattccctagttcctgtgtccaaatcctgtgtctagacgtttttcgcgcgcgtattctctttgacagcggggctcccgtgccacgtggtatccgcttacagtgtgactggcggcacatggttgttggagctgttttgtcccacatatgctactcaccgtgtccaaatgttggggtgcctcaataccctctcgtacccccttgtgtggggggcgcccacccctctctgaggaaggggtgcctcattgttccgccgtgttctaggggacgccccgctgagttgtcgcccctttccacccctccccgcggagtttgtggccccaaagggttgtcacccccccactttgtgcccactttccgtccactcttgttcactgtgttgccccactcttgctgtccttgcgtcgcacccctcccgcgagttttcacggtgggtgcactttgagattccaccgcgtctttcccacaggagggtgttaaagaggcgttttatgtggtggttggtggagacgcacatctctgtgtgtcacagagtcgatactcttttcttctctatggacacctccccccctcttctcgcacacaccagagtttgtgaggttggtgcgggcgactaatattccgggcgcgccacacaggcgcgcccacatatctccacttgaggattcccctctccaatgtgttctgtgggggcgcacgatccacacaatattgccggcacccccctgggagaagagatttctcctcagatatggcacgggttatcacctctccctggagattttcgtgcccccacttatgccctgtggctcacacatattttataatccaatgtttcacaggcttgtctcctcggagagaccgcgggtgcgcaccgtgggagcccggctaggaccactgccgatgttctctcccctaaccctctttctgtctggtgtgcccccccccccctcgagtgccactctctgggtgtagttttttgccccctgcccgcgcgtgtcccggtgtttaaacaatggttttataattttccattttaccccccttttccccccctcttcgaatttttttattaaagccttttaattccccttaaata

SEQ ID NO: 493521 - DNA, 1664 bp, Homo sapiens
aaacgaccggaggctgttggagacttctggatgccttcaaggaggcgaacccggagtacagaggtggaaaatcagcctccatgcagtgcagcaatccatggccagagtctgagtggcagtggtgtgcccccacgtcctgaggaagcagatgcagcacctggtcactcacacaggcacagcacacaaattcaccaatgctgagcaaccatccgagccctggggaaaccagaagtcatgcacatcatcaagtccagcatcgagtgtgcaagccatctcaaaccatcagcaggcagcaaacaacacgttcacgcacctgttgcagttcacttgcatgtggttatatccactgttcgatctatttgaccagtaatgccagcacagcccagcagtggcatttgcctagcatcatccagttgcacagttggttgccttggcaccaagtgcccaatcaacaagcaccacttgcagagccacatagtgatacccacgtacgactacagatggccataagagtttgttggcaccatggactttcagctccatacactttagccaacacttgtgcacgtgacaaacaccattaggcaacccagatggggacacaccacaaagaggagatgagtgcacaacgcagctggagagacgacatgcacaccagctgcgagaccagtgactcgagcacctgagaggacaccccgaggccgacatcatacaggcaaaggggaaaccacaccgaaaacaacgcacaccaacagacaacggcaatacactcatgcccaccacagaagggctatcacgtgcaaccccggaaacggcaagtacatcaaacgagcacgcgtggccaagcgacgagcggccacgcaagcaacacagcccgtggagcacaagcgcccgagacacagccacacgacagcgcaccaggacgcagccatgcactaaagagcagtaacgaagagagcgcacgccaacgaaatcgcacgcactgggacaagccacaaaaccaccacgggccaccattacgatgccccgggccaaagcggcatctgcagagcaatccaaaaacaacgtgcagaccgtacacaccttgaacaaacccgcccaaagacagtgcataccaaagacaaggacgacgggatgatgacaatgacaagagttggacggaaacaacggcgaccactgacgacaccaagacgacaagacacactgcaccgacaaacggcgcgacactaacgagaacaccaacagacaaccgatggcaacgacacggaacccgaacatcccacagccagcgcaacacaagcaagcaccgtgcggagccacacgtaacaaccccaaggatgagcgaagaccccacacgacgccgacacgcaacagagccacaagaccaggcgacagagcacaccggaagtagaccaacaccccaacgcgccgaacagaacagaggcaagacagcagaagggaccacagagagcagcaacgacagcgagaagagtagcgacaaagagcacagcagagcaccagacgagaaacacacgacggacagatgcgaaaccaccacagaacggcagcaaaaagagacagaagacacacaagacgccagagacggcagacaccgacgcaacgacgcccaagacaagacaacacaaaccagactacaccagcca

SEQ ID NO: 493522 - DNA, 547 bp, Homo sapiens
  misc_feature (15)..(15): n is a, c, g, or t
gttgctcatccattngagaaagtagatgtgaaaaatgatatggagtacatagctacagctgctctgctggtgccctccagtaccccgaaagtacagtgcatggcaagcagacatcgcaggaatcaaaataaatctttagtcaagttataactaaatcactactgccaaatgtatctgtggatatcccttgtgacaaactgtgtaataggatgtttagagatctgctctcaaagcaagcctgagggaggcaagtcaagtttgagagagataaagaaggaagaatacgtggttattcagacattgggattatactgattagttctgtgtgttataagttattatgaagaaataaagtaaagaatataaaatagactaacatctcactataggaagacatactacaatacgacaaattagcgacgttagcaagcgaacttaacagaagagactaaattgtaatggacttaggtagtgtgtcaggctggccattagtgttatctaaatatgtgtatgtgcaagcggacgaggaatagagctaaagtaagtt

SEQ ID NO: 493523 - DNA, 478 bp, Homo sapiens
  misc_feature (172)..(172): n is a, c, g, or t
  misc_feature (351)..(351): n is a, c, g, or t
cccgcgaggtctgtctcttgcttcagtcagtgtctggacggaacaggatccggggactctcttccagacctccgagcggcctccgatgtcctctccggttggaagctccgggaccatcttctcggccatctcctgcttctgggacctgccagtcaccggatgtgtcggtggnttagtctcacttcgttgcgcgagagccaatcgcgatgagctccacagcattcgttcagaagttattccactcgaacgtggaggcatgccggtcaacagcccgtggtcaaattgtagtacctgcaggccgtccgtacacactacctctcgtcgtgggtcttctattgtcgacccgtcgantgcatgatggcctctggaaagcgtcgttgagtccatgcttcattgcgcgcgaacttggaccgaggtagaagccgtcgagggccatagcaaggcggtcgtcctgaagattgcgaaaaccagccgttgt

SEQ ID NO: 493524 - DNA, 742 bp, Homo sapiens
tggtgacaggtgcctcacagaaaaagaaaaaaaaacaacccgcgccacggtaaaagcgaggccgtgggtcccccacgatgaaaatgccttcccatcagctccgtggctctgggccctgttggacccgtggagaccctggttcaaagccacggtggtgggtcctcgtagcccgttaggggttacccccgctgcgcctcatctgacgcctgacgcgcggacgccctgtggccttttgcgaggcgcggagtctagctttactctctcaagcactagaacccgcgagagcttttgaccgaggggcggaacctgtagtttctcctttccgtgcaacgagacttttcggagattacgagccgaaggcggacctgtgttctcttccgtcaaagcgaaagacaccccggggcggtgcgcgccctaggggtgcccccgcagagtgcggcggaactccttgcgttttccgggcttcagaaacacccccggggaaaaccatccgggaaggcgcgagaagcagcctttttcctagcaaatgccttttgtggggcccgtgcccatccggttttgggagacatacctcaggagcccgtcatcagggcgggactaacaatccttcctgttggcagcccttaaatactacagggtcagacgacctgttaagaagggtccagtgtgcacattgggcacccaaagcccctgtgaatctgcccacgggttcccccaccaggcaagcgccaaccgggaaccg

SEQ ID NO: 493525 - DNA, 851 bp, Homo sapiens
gagtccaggccgctgagagtgggggtggctgggagcagcgcagcctccggtaggagagggcggaggccccggaggacccaggaatcaccttcaagcctatgtcgtgagcgctgggccagaaatttaagaaggaatatatctccatgtgttcatgtggcttggaaaattgtcatgtgggaggagtagagtgtgatgaacagacttccgtgctttagtagggaaatagtgggccagggaaactagtctcatggacccataggggatacatgggggtcaatccagctgtgtccttattagtcagtaagatctagggaaactcaccaggtgaagaattgattgaatgatgatgatgatgttgggtggtttaatggacatctatacaacctccattcaatttttcggctccagaccaataggttgatcaaagaaaactttccataattgtgcatcatcgaacgagaattgaaatggcctcagggaaaattatgcttgtaatttccttcctttcttcaaggagattggggcatctcaggaaggggagataataggtgagacaagtggttactcgattcgatgcacgcagcggaccattcagcacaccacccttcggcagcgaggccagaagaaaaaaaagtccttcctgtgttatccgacctggcgggacttctcccttgccaactaacagagagcacgaccccaagcgactgtggattctcccacttccaagtcctttctcacgaacagtaagcaccaagatgggaggtaagaccttttaaccctgtgacaatcgatgtgtcgcagggcacattattccagcaggagactggaaccataaaggccagatgtggacc

SEQ ID NO: 493526 - DNA, 105 bp, Homo sapiens
gtaccccgtaagttgccaaatgtaatgcttcttcaaaagaatactcatatattttgacactcaccatgttgctagcctgaatgctgttgaatgtgcaaaaacact

SEQ ID NO: 493527 - DNA, 373 bp, Homo sapiens
aaccacgggttagatgtaaatgttaaattcttccttactatgaaactttgctggtacttaaaatttagcataaacaaataatctaataaattttattcattagaaatatgaccaaaatttccaatataataacaaaaattaagggggatttaatgtatattttctattagccattccctggctatttgaagcatgttatcagtcattttgatagaaggcagaagtttgcattagttccagatctttcataaaatgttgacataaaataaaatgattcaatacccagtactcagtacactaaatgtagtaacaatttgtaccataatatgaaaagttttaatatcgatactccagtacatctgtactactaact

SEQ ID NO: 493528 - DNA, 499 bp, Homo sapiens
atgttattttttgggtttgaggttagcttgtaaaacccgtcaacttgaaaaatgttcttacttgagaataccgccttttccctcagaatttaatgtgtaacactgggttactcacagaatgaaaatctgtcttaaggggtttgtctggtttaaaagttttcacatcatcactggccgagagacattgttgctccgggcgctgaatggctcatgcccggctcggggacggcagtgacacctgcgtatgtgaggctccggaaactgaatctgacccttgcaaggacgtgcaaaaaacagaataggctttttgagcttttgacaaattgtaaataacgcggtttttacagaccttctggggaacgactgagaaataaaaagagggtgcttctcttccccttgaaaaatgaaagggggctcttcttgagatagaaacaagaaacctggtgtgttaccccacaacctgttgttttacttggggagggtgtttcccggggaatcg

SEQ ID NO: 493529 - DNA, 183 bp, Homo sapiens
atcggaactcagtgtcgagtagagtcccgtcgaaatcccacaagacagcgtgcaactaggcggtcggcggtcgctgtgtgcgttctcacggtggcattgaaatagtttgcctccgggtgattggacgacgaagtgcgtcgatggatgtggccagcgatgacagctggacactccgtctagaca

SEQ ID NO: 493530 - DNA, 156 bp, Homo sapiens
ctgggggacgacttacacccaggataccgtttcactgggcgtaggtttaccccggggaaacggttttccccgggattccgttttcactggcggtggtttaacaccgggaaaacgctttcaccggggttcccgtttccgggggcgtccggtttcccc

SEQ ID NO: 493531 - DNA, 277 bp, Homo sapiens
cggggttttaaggggggggaaagggggaaaggggggcccccttttttcctggtttttcccaaagcctttttaaagcagggtttcccccccagcaattttttttcccctttccccccccgggcctttttttttgggccagcccctttccccccccccttaatggaccccggggtttggttccttgggggggtgttcccaaatgggttttaggggaacaagggggttggggtttttggggggtttgatttttttttaaagggcccttttttgcccgcca

SEQ ID NO: 493532 - DNA, 216 bp, Homo sapiens
cagctagaaaggaggcctctctccaggctgccactaggccaggcacagaccagcacacacccagccagggccactgcattagacgaacaggctgtgccctgtgcacccctggcccagaggcagcctgatgggagtcctcctttctatctgcaacctgcatcactcagagtgcaagtgcctgcccgatgcactgcctgtgcgaggtccgctgctggg

SEQ ID NO: 493533 - DNA, 745 bp, Homo sapiens
gcctaggtaggggacggatggtgcctggagcagagggacccacaagtgcctccccgagcctagatcctggctcgtgaccactgcaatggtgcctgaggtgcagggccagaccagagcatcctgggtgtacagtgcctggtgctctccagtggcctggtgcctgattcatgtgtgcatgtgtggcactcctgaatgtgtgtcagatgctggcatcttgccagtgcagcccctctgtgcttcctgcatgatgtgtgtgttgcatgtgccctgtgtgtggcagatgccctgtgtgtggtcatgatgtgcctgtgtggtgccatgatgtgcatgattggaatgtggatgtgcattttgcttgacatgatgtgagctgtgggcaccctgggctccccactgcatgtctgtgccttgcctcctcctcctcctccacctccatgtcatgtgcttggaccggggaggtggtatgccttgttggcttgaggatgtgtgtgtcatgacctatgtgttggcacatgtggggctcccttgtgcaacaggacatgcagtgctttccttgcttggtgctgttacccctatggtttgcgagggtgacatacgagcgtcggggggttgggactcctgctcggtgggttgtccctttgtccactcggcaccccttcgccggcccaccatgggccgttggctcttgtgacttgtggcttgtccccacccctttctgggcctacatcaccactggccggtgtac

SEQ ID NO: 493534 - DNA, 503 bp, Homo sapiens
agctggttccaagaaaaccaacgctcccaactccgaagagtaaggggttgttagagagccctttcccagaaaggctgacactcgtgtctttagtccagcagccatgctggtcacttttaactggccaacagatgcccggtatttacccaccaaattctaaggaaaaataggacagaatagcaagtgaaaggggtccgatggtgctcactgcttggtgatagtcgattggccccacattgggtgccaaagtgtgtccggaattggttccttctggtgggttcttgaagggcagatcacctgaggttgggagttcgagactagcctcaccaagatgtagagaccccatctctactaaaaatacaaaattagcagggcatggtggtgcatgcctgtaatcccagctacttgggagaatcacttgaacccaggagacggaggttgcagtgagccgagatcacaccattgcacttcagcctgggcaaccagggtaaaactttgtcaaa

SEQ ID NO: 493535 - DNA, 858 bp, Homo sapiens
cttccgggtcccttcccctatcgtgtgcaccccaaggctggacacagtgagaacggggttgaggaggacacagaaggtcagaacgtgggcccacagaagtgttaccccttggagcccatcggagaccccagcgtccccggcccatgctaggacctatcaagggagtgaggccaaccgagagcccatcggagacctccgggtgccccgtcgcggtcagggaccatgcatggggacggagccattactatgaggcccaatcgtatgaaacacacaggtgcccaacacggttaggtacctacaaggggtatgatcctgcctgaggatcgccattcaggtaggcccccaagagagtccttctgatccaggagggcacaccctgcaattgtgggacctaaggccgacgccagtagaacgacccaagtgctggagaccactaacgggacacgacaggcacggggcaagagttacctggctttaggaggagctcagcacaagtgccgcacgaaaccccaatggtgtctgaaacactcttatgatgcacaagccccacggtgttacccgctgctaaccatggtcgaatggcaagtgctgtactcctggcggacgcagcagaaagtctaccggcctcgagatccgcgactgccgtatttccaagtcgtccggtggcacttggccccagggtttgctgccgtaaggctcgtgaattgggcactagtggggtttgcccggtcggggatgccatcattgggggcctcttcggtggatcagcactattttgtcctcgcatcttggcgttccttgcgcgaattgttgcatcgcttgagcttcactcatgcggcgttccttataggaggaggc

SEQ ID NO: 493536 - DNA, 861 bp, Homo sapiens
cgagtaataggaaacagttccaagggactcagctaagccactcagagaaaaaaagaccggagctttagttcggagagggagaaaaaaaaaagggtcacgggatagagggtcccttgggatcacgtgctcatcccgggcccagctcagctgtgatcagaggagcaagaccgtgagataaggctgaaacctgaaggaatttcaaagagggggccatgatgggcattcagcggcttcgtcaggagggggcacgagtaaccagcagatggggaaacccaggtaacgagtgcatagatgattggcctagggttcttgctgtctagtaggggagtccattgcgattcgagttcagccctagagaattcatcaactaccgaggcccagttgaagtcttctgggcaaattggagtttactaagatacaatactttccaaaatattgacatgtggtagatgtttgtttgcttggtctaggacggaaatcgtgagggttgcatgcatacattgaaggtttcttgaccctgggattacccatggtgggtaagtaattacgagcagacgatttaaatcgacagggcaatccgtggtccattagtccgatgacttcagccatggccttatactagcctgttgattctaccggcaatcttttaactttttgagtataaactcgaatgatatatgtggtatctttaaaaagcaatgtatttgggaaatcctgaagccttgtttaaaagttggagaggccaccgtgatggagacccaattacccaattaatcatggctcaggcagttatcaattcgtgtggcaaatcttttatggtgatctctcctcattcacctcctcgtgggtctgggaatcttc

SEQ ID NO: 493537 - DNA, 404 bp, Homo sapiens
gtcaggacccatcttgaggaggcagtctgtcctgtatcatgtagctcgaatgctgtgctgggagaactgctgctctctttaagctgtctggcagggacgtttaagtctgctgaagctgtgcctgcagccgccccttcccccacgtgctctgtctcggggtagctgtggtgggctccacccagttcaaacttcccagcagctttgtttacactgtgagggtaaaaccatctactcaggcctcagcaatggcggatgcacctcctcccaccaagcttgagtgtcccagctcaacctcagatgctgtgatagcagtgagaatttcaagccagtggatcttagcttgctgggctccgtgggggtgggacccgctgaacctgagcaagcccggagacctgagcaagcca

SEQ ID NO: 493538 - DNA, 438 bp, Homo sapiens
actcggcccaatccttgcagtcggcgggtgctgggggctcgacgcaccgagcggagtctggttgcagccttcaaagtcctaaaccgcgcggcgtgcgttcggggtttattgattgaattccgccggcgcggacgcctctgacagagagagagcgcgaaagatggaaatgggcagacggattcatttagagctgaggaacaggacgccctctgatgtgaaagaacttgtcctggaacagcagtcggtcgcatgaaggcaaactcgaaggactcacagatgaattagaagacctggaattcttaagtacaatcaaggtaggcatacaactcaatcgacaacttaccaaaagttaaacaaacttaagaagcttgaactaagcaataacagagtctcagggggcctggacatatcggaaaaaaagtgtccgaacataaagca

SEQ ID NO: 493539 - DNA, 167 bp, Homo sapiens
agggaacgttgaccagagacagaaacgccaacacattagtagagtggttattcatcacactccgggcagatccacagtacagctggctccttccccacccaaatcccgcagagtcctttactcacccatctcaccacgtttcaccgaggcaaagccttagaaatcag

SEQ ID NO: 493540 - DNA, 164 bp, Homo sapiens
caatgatggtcctcactcaacgatggtcctcagctcaacgatggtcctcagctactccggaggctgaggcaggagagttgcttgaacctgggaggcggagattgcagtgagctgagattgccccactgcactccagcgtgggcaacagactgagactctgcctc

SEQ ID NO: 493541 - DNA, 434 bp, Homo sapiens
agggtaaatatttacataaaagtagaattaatgtagtgatccataactgtactgtggactaagagtccttatttgttattttttcaacaaatttttctcagatattaactaggtcccaagcactttgctaaattctagagaagaataaagctaggccgggtgcggtggctcacgcctgtggtcccggcactttgggaggcttaggtgggcggatcgtggggtccgggggatcgggaccatcctggtcggcgtgatggggcctcgtctccactgggaatgcaagaattggctgggtgtggtggtgcgcgcctgtggtcccggctgctctgggggctggggcgggggagtcgcttgggcccgggaggcgggggttgcggtgggcgggggtcgcggcactgtgccctagtctggcaggggagcgggactccgtcaga

SEQ ID NO: 493542 - DNA, 116 bp, Homo sapiens
  misc_feature (39)..(39): n is a, c, g, or t
acgatctttgaggcaggacactgtgatctgcgtgccgtnaactcagctgccgacccaggagtcgcatactgtgaggtgtcacctccctgctcatggcactacccagactgccagag

SEQ ID NO: 493543 - DNA, 273 bp, Homo sapiens
ctcatttcagctctccatcttcacatggcattccctctgtgtgtctccacagagtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattgaagattaggaccacaacataccttttttgggaggacacaattcaaactgaaatgagccgggtaccgagc

SEQ ID NO: 493544 - DNA, 349 bp, Homo sapiens
tgaggttccgcgcgtagtgtttaccttctgtcttagaagagaaacagaaaagtgatgctgaagaagatggtggcactgtcagtcaagaggaggaagacagaaaacctaaagcagaggtaaaggaaaggggtcacacatttagttttaccaagttgaaggtacatttctgtaacagggaatattttaatacgggtagtttcacagtggcttatggcagtcacaaaattctgttcaaagcccaattttgttgcaagtgggcattctttgttgatacacggtcagtgttcttgtattgcataattttcacagctaccatattcaatcatcagcaagtatccgttttcagctg

SEQ ID NO: 493545 - DNA, 426 bp, Homo sapiens
  misc_feature (416)..(416): n is a, c, g, or t
taagtgcccatcagtaacagattggataaagaaaatatggtacacatacaccatggaatagtatgcagccataagaaacaatgagatcatgtctcaggaacatggatagagctggaggctattatccttagcaaactaattcaggaacagaaaaccaaataccacaggttctcagttgtgagtgggagctaaatgatgagaactcatgaacacaatgaagggaacagacactagggtctacttgagggtggaggatgggaagagggagaggagcagaaaaagtacctattggtgatgaagtactctgtacaacaaacccgtgacaagagtttccctatataacaaaccttcacatatacccctgaacctaaaagtttttttaattgtaaataaacggatcattaaaaaaaattttnttaataaaat

SEQ ID NO: 493546 - DNA, 341 bp, Homo sapiens
  misc_feature (32)..(32): n is a, c, g, or t
  misc_feature (37)..(37): n is a, c, g, or t
  misc_feature (87)..(87): n is a, c, g, or t
  misc_feature (180)..(180): n is a, c, g, or t
  misc_feature (185)..(186): n is a, c, g, or t
  misc_feature (257)..(258): n is a, c, g, or t
  misc_feature (261)..(261): n is a, c, g, or t
  misc_feature (296)..(296): n is a, c, g, or t
ggacgcgtgggttgcagctcagcatggctcanaccanctcatacttcatgctgatctcctgcctgatgtttctgtctcatatccaangccaacatgcccatacagagttgccccaggcccggatcagctgcgcagaaggcaccaatgcctatcggtcctactgctactactttaatgaanacccnnagacctgggttgatgcaaatctctattgccacaacatgaattccggcaacctggcgtctgtgctcacccannccntaggtgccttcgcggcctcactcattaaagagagnggcactgataacttcaattgcctgattggcctccatgaccccaaa

SEQ ID NO: 493547 - DNA, 376 bp, Homo sapiens
  misc_feature (23)..(23): n is a, c, g, or t
  misc_feature (66)..(66): n is a, c, g, or t
  misc_feature (105)..(105): n is a, c, g, or t
  misc_feature (144)..(144): n is a, c, g, or t
gagaatcccgagcaatgctgagnggtcaccaccggccgccttacaaggctcctgatggagcactanatatggaaggaacaatggtaccgccactgccaaaaactncaaatttgcaagaccttgacactatgaagaaatgcatcnctaatgggcagagtaaccgctagcatcgtatgacggatcaaattcacacataacatattaaccttaaatgtaaacaggctaaatgccccaattaaaatacacacactggcaaattggataaagagtcaagacccatcggtttgtggtattcaggagacccatcttacatgcaaagacacacataggctcaaaataaagggatggaggaatatttaccaaacaaatggtaagc

SEQ ID NO: 493548 - DNA, 520 bp, Homo sapiens
ggagaactagtctcgagtatttttatttttttttgcaggtaaccggaaccttaaattaattatgtggaatgcttaatgcaaagtaataggggctaaagtggctagaaaaggggactactgaaataaagtaacaggaacacagtaatgattactgtggattggggggctgcaaaacaggaaaataggggcagatatagctacatacttatattcaaataccactgggaggcaaggggtaagaggcaagggcaaaatgtacaggtcaggatctctagtgtcttcagcctgccgacagcaaccgtgggtgctgggccctgtgtctccgtggagccaagggttagggcctgagcagttgtcactctcgtggaaagcccaggagtggggctgactgagcaggggccataaagcctagtaagggaacgagggaggctggcaaggagcccaggagggaggctctgtgaattgtctctgatcctttcctggagcccctgcctcgtacacctcctgggatgcgtctcag

SEQ ID NO: 493549 - DNA, 369 bp, Homo sapiens
ctcgttatccctatgcgcgtgacctttatcaagtcgagcgtaatccttgatcatcttctacgtgtgtctcatgaatcgatcacttcagatacctcccacatggagagctcacccattgctgcctatccttcccattgtacaagtgtgcttgttggaagttgcctgtgttgggaaacgaacaggattggacggtgctctctggggtgttctcctatctggcagcctgttgaagtcctcgtgttgctcattgtgcttgagcgatactcgccgccgcttcagctccatcttgaggccacgcaggattctccgctatcgagatctcctcaggctcagggtgcgagctcgcttccgtgactcctcctccaacga

SEQ ID NO: 493550 - DNA, 1051 bp, Homo sapiens
ggtagaactcacttgcaacgcatggaggcagaggttacagtgagcctccatcgctccactgcactcccgaacgcgtggcgtgagactagtagcgaaaactgtctctacaacaaagacacgaagaagccacactaaagaggtatactgccagctataaggttcgtactgttcaagactgaaacctttcaaaattatgacctatcctgagaaaccatgactagtgaccactcacgtgggccctggggaacttccttaagattctaaatgtattgcgtgtagaaaggctgcatgatacatgaaagcgggatctgccgtgaaacatattggtgctcacgtcttgtctctcacagatataattatccctcctattcattgcctgtctgaagcagctcttagggttaacactatggcaacggacctgctagatgtgggcagctgcattagtgaattctgaatgccccccactgtgtagaaacaaatctggcacaatcggttctaatggataatacggccccagggatcatagtacaggcccctagaggactgactcgaggctacgagtgacgcgttggttatctcgcaccaatgaagcgcgtcacgtaccctttgtgtacttacagcgttgcgtgattcttcagaagacttgtaggatttttgcacatgaaactctaatttgactccaaactggctgaatgtattgcatgatgtggctctccaagagatggggaaatgtacgactcgtagtgcacttaccgtttcccttgcccccatttgaggacgttgaccttggtagcttcgcgtcgattgataaccagtttgcagtctgcgagggtcctaaggcgaagatcgtcccgtctccttaacttgaccaggctcccgtttaggagttcctagaggaatggcgccctaggttccattctccctgcgtccggacggtttgcctttcgtcgcgcggatggggggcccttgggtggcttgtgatgttggtgcctttttcgctgtggcccagggttgactagcccgggcgccccttttgtgtgggccccagggg

SEQ ID NO: 493551 - DNA, 337 bp, Homo sapiens
gctgtacactgtggtgagggaacacactcctcaatttctttacatgtcaagggtagttttcgggtttcatattccaaaaatgaaacttaccaactctttttgtcatattcttcaaagaaggtcgcgatgttgtgctcacaacaacctttgtggatgatattaaagctttggcaactacctatggaaagggagaatattttggctttttggaaacctatggaactcacttcagtagctctgggtctcttagaggactctatgaactcatatatgttttggataaagcctccacggagcgcgaaggcgttggactctgacatgagatgccctgggttcc

SEQ ID NO: 493552 - DNA, 787 bp, Homo sapiens
  misc_feature (22)..(22): n is a, c, g, or t
  misc_feature (39)..(39): n is a, c, g, or t
  misc_feature (69)..(69): n is a, c, g, or t
  misc_feature (89)..(90): n is a, c, g, or t
  misc_feature (96)..(96): n is a, c, g, or t
  misc_feature (101)..(101): n is a, c, g, or t
  misc_feature (124)..(124): n is a, c, g, or t
  misc_feature (127)..(127): n is a, c, g, or t
  misc_feature (136)..(136): n is a, c, g, or t
  misc_feature (206)..(206): n is a, c, g, or t
  misc_feature (210)..(210): n is a, c, g, or t
  misc_feature (276)..(276): n is a, c, g, or t
  misc_feature (298)..(298): n is a, c, g, or t
  misc_feature (382)..(382): n is a, c, g, or t
  misc_feature (437)..(437): n is a, c, g, or t
  misc_feature (442)..(442): n is a, c, g, or t
  misc_feature (482)..(482): n is a, c, g, or t
  misc_feature (489)..(489): n is a, c, g, or t
  misc_feature (517)..(517): n is a, c, g, or t
  misc_feature (527)..(527): n is a, c, g, or t
  misc_feature (531)..(531): n is a, c, g, or t
  misc_feature (565)..(565): n is a, c, g, or t
  misc_feature (567)..(567): n is a, c, g, or t
  misc_feature (609)..(609): n is a, c, g, or t
  misc_feature (636)..(636): n is a, c, g, or t
  misc_feature (645)..(645): n is a, c, g, or t
  misc_feature (649)..(649): n is a, c, g, or t
  misc_feature (659)..(659): n is a, c, g, or t
  misc_feature (662)..(662): n is a, c, g, or t
  misc_feature (670)..(670): n is a, c, g, or t
  misc_feature (699)..(699): n is a, c, g, or t
  misc_feature (707)..(707): n is a, c, g, or t
  misc_feature (764)..(764): n is a, c, g, or t
tggtgctccgtggaggaggcgnagggatcctcgttaaangccttttgtgcggtttggtggatttggggngcaccactctccgccctaannccaaanccaangtgtcttcaggccggatcacctnaanagtcaagtnagacaagtgcactcaacagaaaggttcttcaaatgtgagaaatgtgatggcagctttcgccacgaaggancggntgcgggcgcacacagtacagacacagaggagaaaatgccatgtcaagtgtgtggcaaaatgctganctcggcttatatttcggaccanataaaggtgcacagccagggtcctcaccatgtctgtgaactaagcaaaaaaggtactggtgaggtttgtccaatggcggcggcngcggcagcgacgcgcacggtcagcagcggcagcagttagcagcccctccccacanctgtngggctccctctccggggcgcggaggggggtgcctgttganctctcanccactttccctcctcaaaccctgtgtgnagctctcaanttgngtttgcgggtggagagggggagaatgggagttananttccttgggtacaaactccctctccccccctctttttcccanccaactccctattttccctaccaaacnaaggagccntccngaaaggaaanggngggaaganatgtttttctttagggggaattccgctanggtttttnaccgattttgttttctcctggctcctctttctatcacgacctgaaccccacacaaancctgtccccctcgggttgtggtt

SEQ ID NO: 493553 - DNA, 480 bp, Homo sapiens
  misc_feature (451)..(451): n is a, c, g, or t
  misc_feature (462)..(462): n is a, c, g, or t
ctggaattcagtggcgcaatctcggctcactgcaagctccgcctcatgggttcataccattctcctgcctcagctactccagaggctgaggcatgagagttgcttgaacctgggagatagaggttacagtaagccgagatcgtgccactgcactccagcctggcgacagagcaaactccatctcaaaaagaaaaaaaaagttccgttagacaaaaggaataaattcaagagatgtactgcacagcatggtgactacagttaataacaccatattgcatccttgaaaatcattaagagagagaaaaaaagaaagaaaatcattgcgagtagaatttgagtgttcttaccacaaaaaaatgggaagtatgtgaagtcatgtgtgttatgctgcttgatttaagcacaatgtaaacacgtttcaaaacatcacattggacatgataaatatatncaataaaagancaaaatacatttgcaaaa

SEQ ID NO: 493554 - DNA, 464 bp, Homo sapiens
  misc_feature (145)..(145): n is a, c, g, or t
  misc_feature (405)..(406): n is a, c, g, or t
  misc_feature (423)..(424): n is a, c, g, or t
  misc_feature (427)..(428): n is a, c, g, or t
  misc_feature (431)..(432): n is a, c, g, or t
  misc_feature (434)..(434): n is a, c, g, or t
  misc_feature (437)..(438): n is a, c, g, or t
cgtacatgtatatccacaggtttgtagacaaatgttgcagccttttttgtaacagtgaaaaactgaaaacaacctggaagtccagtgatgggaaaatgaatatatttctgtcttagattggggaacccaaagcagattccaagantgaaatttaagtgaaagcagtttatttgctaggtcataccagaagtcatcaatcgaagtatggagaaatggaactgagaaggtaaaaaccagttcaaaatcagtgaggaggttctcaatggtaacgagctccatactgctgagatacagggaaacggaggggagaaagctagagtatttaacccccactccttggttgtcagctccctgtcctgtgtgtgggcagaacgtactccacctactcaatagcaagttccaggnntttggaaagaagtgctnnaanntanngnaanngtaatcccaaacacttaaagcaattc

SEQ ID NO: 493555 - DNA, 1014 bp, Homo sapiens
gccacgcgtccgcggacgcgtgggtcgacccacgcgtcgatgttgatagaaacaataatgatggtgatgggactgagggggggagcagcaggacgcaaggatgaggaaagacagctaaataaaaagggatgaagaaaagaaagaagccacagggaatattttggcgagagacagagacacacatcagagcccgaacaggactagactcaacagacagacaatcacacaaagaccaatcacctcagtgggagaaacaggaaaaacatgaatatgtacacaaaaataacacaggcaaatacaaggaaaatagtcaaaacaaaaaaaaaacacaaacacggaagagacagaaaaacacagaaaacctcaaagaggaaccacaccaaaaaagacatacacaaaaaaaaaagaagataacaatcgacgcaacaccaaaaagataaaatacaaactcaataactcaaagtaaaaagaaagaacgtaattaaaagataggatgaatagaaacaaacagagaaaagatagaaaaactaatagaaccatgcaacaccaatattcatgggtacaatcaaaaaaaaattggaaccaaacaacaaaaaacaataacaaagaaacagcaaacgaataaaaaaaaagaaagaaaacatatgaaacaagaaaacagaaaaagagaaaaacaaaaaaatagtagataactcaacagatagataagaaacacaagaagaacaaataagaacgagcgaaaaaaaacaataagaggatgaacacgggggcaaaacagcaacaagaacagtagagaaattagggacctacaaagtagaggacagacaaagagaaaagctgaaagtaacggacagataaagacaagacagaagaggtaaaaaaacgaagaagcaaaaaagaagggaatacactcgaagcagaaaaaagaaaaggaagtatcagaaaataaagacaaaggcagaacgaagatagacataagcaacaataagaaataacgaaacaacaagcgaaaaa

SEQ ID NO: 493556 - DNA, 288 bp, Homo sapiens
ctgagatgacagtcggcgcatgcttgtaatcctacttgggaggttgagacaggaggatcacttgaggctaggagtgggaggctgcagtgtactatgttcgcatctgtgaatagccactgcactctagcctggacaatatagtgagaacccatctcaaaaaaaaaaaaaaaaaaaaaggggcaaggttttaaaccttactggaaaaatttggcccaaaaggaaaaaaaagttttgggaaccggggggtaaccccaaaccctccaaattatgaaaaaattgggggggggg

SEQ ID NO: 493557 - DNA, 391 bp, Homo sapiens
aaagaggagagattgggaagacttggtgagtttggggcatgaaagggcttgccggattaggagaagcctcattgctttcccagttgagacaagggttttccccatacaaaggatgcgttggggtgtcgtcgccagtgtcctcatcagtattcattcaggaacaaattgatggataactgggagtttttttgtcaatgtagacttaccacatcttgcaaaagcatagctaccctggaggaattcaaaggagtaggtagtgtgtggatgtaaaacgtttgagttgtcacaaagaaggaaggggacaagtaatcaatgcatttaggccccgaacatggctttaatggtttagggtaatccaaatccatttttttcccaaattcatttcctttta

SEQ ID NO: 493558 - DNA, 114 bp, Homo sapiens
tgatgctcagtggaaaacatgcaagtgcaggtatgccttcgaaatactaatttcctttcctttggatagatgcccaattgtagaattactgtttacacacatttttgttcaata

SEQ ID NO: 493559 - DNA, 818 bp, Homo sapiens
ggtgatttttatagcatcctttttaataaaggtgaatacagattgctataaaaggttctgcaatgacctgatactagcttcaagaggttctgctcagatagtaaattgagagttatcataataggaaactgtggcggtccaagccaactgtgctgtgtcacatactagcgatgtagagtggctttcatacttgtttttgtttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgcgtgcccagctggcgagccagtagattagcaggaatctgtcgaatggccattcgacgagcaccatatagcagggacggcgagacaaatcgagagcgagggcgctggccgccagctagatcacagcgcgggggtcatgtgctcgcgtcctacgagggtattcagctttttgttatgcttcaattaagacgggaatcaagccttacacgtagaactattggtaatctaagtttccatcttaccacgtaggggtaaacatgtga

SEQ ID NO: 493560 - DNA, 481 bp, Homo sapiens
  misc_feature (413)..(413): n is a, c, g, or t
  misc_feature (421)..(421): n is a, c, g, or t
  misc_feature (468)..(468): n is a, c, g, or t
acagagcgcaaggaaactcccctcctcccaaaaaacgtttgaacaggagaccaagccgccgatcttaattggaggccgccgccaatatgcactgtacattccacaagcagtgccttcttattttacttcttttggctgttaaactttgaaagaggcaaagaggttggatcaagtttaaatgactgtgccccccctttcacataaaagaactactgacaagggggcgcgcgcctgcctttcccatttgtttatctttcgggcgggcggggaaggaaaaaacttccattttggtgaaggaaaaaggggggtggaaaaaggggggtgggcccacagtgaaatctagagtaaaaccaagcgggcccaggtgtccgcaggctgtaatgcagtttaatcagagtgccattttttttttngtccaaangattttaattatgggaaggcacaatttttttaatatgcaaataaaangtttaaaaactta

SEQ ID NO: 493561 - DNA, 1310 bp, Homo sapiens
acggggctccagcattcagtcaatattccgaggagatgaagatgctaagacacatagagatcaggtgcctgtgaggagagatactccctacgctaggtatcacggctgcatggtatgaacggagagaagcacaaggtacttgtgccagcctggagacacactgtctagcgctcagctggatattgttcttgaccagagtgcctggcgtcgacgtggtgcttaccagacctacgagctgaggtagcaagggattgtagcctctgcgagaacacccgtaactctggaacacgcccattacggaaattcgtggacacgattgacatgaacgccgtgagggactgatgatgtctggggctggagaggtcagccagggtgggcacgctgaggcgaactcgcatgagcgcaggagtattctaacgacacaaggctggccaggcgatgcgaggtcgacccgcagaaattactagcggcggcaatgcaagactgttagagagaacaggcatctggcatcgcctcactggacgttagctctggggcggattgtgggaccccaggtctttccctgcgtacggccattggaaaaagataccaggtgggccaactggttcacaccattcctgctcatgagtggggtggtgaactccccttggtttgttgggcccaaagagatctctcaaggcatctcctgctcaatttactagtttagattcatgagcattggggcggcccgtcagtcaccgccctatgtgagcaaacaataccaattgggcccagtgggggcggttcaccttccaaggggacgcttggggggggcttttagcggcggcaaaggcatttgttcggcgtttgaacggacacgacacttcccccggttagtagggtttggcgagggaaatctgtgtacccccttctagggaagctggtgttgggacgatgctcgcctttgggggttggcttttggctccttggaacaccacgccggtttgggcaggggtaggacttgggccatttggggacttggcaagagtcaccgggacgcgacatgcacctggggctctgcagacggaccgggaaacacggggcaacacaatggaccatagttcgcaaaggcggaaggcgcatccacctgtgtgaagggcgcacagggcacaagaaccccactacacttccccacttggggcccagaagtggcgccagtggacaatgttttcctccaaaaacgcaacaacggcaccaaatggcgccccagacatgggcaacaccaagatacctgtggcggaggcaggccaagaccccaggagaccatacgg

SEQ ID NO: 493562 - DNA, 103 bp, Homo sapiens
gtggactgacggtccagccgaggtgtggctgcacacaaggatcagacccccactacctgccagcacactcccagaatagtcatcagaggactctggctcacga

SEQ ID NO: 493563 - DNA, 1189 bp, Homo sapiens
ataaggccagaacggactgcgacacagcccatcccactcgagacgcatcgacgatcgacattatggccgactcccataccgactccaagacccagacctcagccatggcatgccccctggatcaggccattggccatcctcgatggaccatcttccacaagtactccggacagggagggtgacaagcacaccactgagcaagaaggagctgaaggagctgaatccagcacaggagctcaccattggctcgaagctgcaggatgctgcaacattgcaaggctgcatggaagcacttggcaccggcaacaaggacccaggcaggtgaacttcccaggcagtcatgtcaccattcactgggggccatatggactttgactctacaaatgaagccctcaagggctgaaaataacatagggaagatggcgacacccatctgaggggtccatctctgagtcaaatccagaggctgggctacatcgtccaataccactaacaccaggatcaccattgcacacgaacaaacacaccaaccgcacacaaaacaccgacacacacaaaacaggcgacagcggccgccaaccacacaaccgcagaaggagaggcccccacaatctccacgcggaccaccgcaggcacacatgacccaaccgcaagagacccccaaacaaagaggcacgaaaacaacagaaagacgacagacgcacaccgagcacggcactacaacacaccgtacacgagagcgggacacccagggcaaacacggacgcgccacccacgaccccggacagccccacgaacatgcgcgaggctgcccccaccacagggacccaccccacccccacacgcccacctcccgcgcccgccagcaggaccacaccgaaacagaacaaaaacgcactcccacgcgtagcccgcaccacacacatcgagccgccgctcccacgacccaaacgggacgaaacggggcaagccaacagcaccaaaatcacaacccacgcgcgcgccacgcaaacaacaaccccacaccgaaaccgaccagcccgaagagacgccgccgccaaccacccacgaccaagcaaaagggcgcgcaagcgaccagccgccgagcgcgcaccaacaacacggcgcgcccgcagccccagcagaagcccgcgagacagacccacaccgaccccaccccggcgccgcc

SEQ ID NO: 493564 - DNA, 733 bp, Homo sapiens
ggctttgtgggtgagctcgtttgtgtgccctgtgagtggtggacagtgtgttggtgattggtaggatcctggtatccggtaatcaggtcaaaatgcagatcttcgtgagaaacctgtagcggtaagagcatcatcccttgagtgtagggagacccagctgatcaccatcggataaatgtgaaggtccaaggatccgaggataaggaaggcatatcctcccgcacgcagcgagcaggctcatctttgcaggcaaggagctggaggaggggcacagtacgtcgtttcatgacgtacagactagtccagaaggaatggtcgaccctgcacctggtcctgttgtcttgagaggtggtatgtgagtagtcttcggtggtaagatcctgaagcaggagtagatccagtcactgcgtggacagtggaagcccagatgaacaaccaatcgaaaaactgtgaatggccaaagattccaggagtaacacgaaggcatcccgtacccgagccagcaggaagggctcatctgtgtgcaggcaagcaggtggaagatggccggacgtctttctgacgtgacaacatccagaagggagtcggaccctgcacctggtcctgcgtctagagaggtggtatgcagattctttcaggtgaatgaccctgaccggggagaacatcagtctggaggtggagcccaagtggagacagccgaaaattgtgaggccaaagaatccaaagattaaag

SEQ ID NO: 493565 - DNA, 116 bp, Homo sapiens
  misc_feature (81)..(81): n is a, c, g, or t
aaggcttacgtcatggagagtatgacctacctccagcatccctgctgtgaggtaggtcatactctccatgagtaaccttcntcgagccgatcagtgatgcctggaccaacctggct

SEQ ID NO: 493566 - DNA, 992 bp, Homo sapiens
gagggcaagggtagggaggaggcgggcgaaccgcgtcgctgggcctgaaatgtgggctgctgagctgctgccctgctggctgggggaccacaagccaatgtcgacgggctgctgaaagaccattgccgctggggttgtcgggcgctgcttgaagaaatgcgtccctgtgcagggggctgcccaaatggtaccatagatgcacttcaaggcaagttctccccctggtccccgtctgtccactgaaggcagtgtctggacttcggatccagacaatgcctgtgagaaaaagcgtccgttcagcttcctcaggcaggagccttggccttgtgccgccgtggcccaagcatcagtgaaaaggagatcaacgctggcttccctgacctgagttgctgaggcaaagccctccctgtgccagctgggctgcagaagctggtatgtccacgagcctccgtgggacaatcatgggagttccctgggacagagggatcccgatggaaccatcggcacccttgagccaagtatcacttgacggccccttgggtcaccattccggaaagcagggcaacgaacgaacggtgggttgccccagccatgtgcaccaagtgccgtgcatatgaagataacgtagggacgaccctaacgggacgaagtgaccccggacgtccaaagcagacacatccagtaacttcctgggaaccgcttcttacctcagtaccggcattcttccattccggagaatgcaccactcaacaccaggtaaaaacgcctcaatgcattgggagtgggactgaggccgaagccaagagccgcaattcccaaaagaaccaattcgggcaggcagttcagacgcccaacatgggaaaggggtcactctgcaggtgtgtgtcaagacagtgcctgacagcacagagggagaaacctcctgttgtgagcaaagagtattgcacgttgtggccaccctagtagccggtggattcgctgggagatccatg

SEQ ID NO: 493567 - DNA, 866 bp, Homo sapiens
caccccggcgcgcccaagcgcaggggctcctcgggctcagtggttgttgacctcctgtactggagagaacataagaagactggagtggtgttggtgccagcctattcctgcgtgctttcattgacagtatccagcattgtgagcgtaacagcctaacattgcctttggccctgctctctgtgaccatcagcttaggatatacaaggcgtgtgatccaagctatcagaaatcagatgaaggcacccattcagggcatatcttggaatctgaagttgctaatatctgaggagtggttccagaagtaacagaaattctgctcttggccatgtgaacttgcacgataaaaggaactcaggcgcctctactatagtatgatgacttcagttcgaattctctgcaagtttgcagggtgatgtgggtattaaccctattgtgtggtgccctgttataagtggccctgacactactctgaatgttggctctacattatcactcttcagggtccctgttatttattgaacggcatcaggcacaggatagcattcatatctaagggcctttgcacatacgactgttcacaagactgcttattgcgtaaaaatcccagaggcaagaaattccctggatttgaagcgcaaaaggttgaattgaaaaggcgcgaaaataattagaaggaggtcatctaaaggggatattcattgattaatacggggagggtccgggaagaaagaacctgaggtgcagtcctttcccggatcgtggtagatctattttagcctcctttgttgaaatactgtttgccgccctgttcccacttagtggacggctgttggtaccggaacaatttgcctatatctcggggggaa

SEQ ID NO: 493568 - DNA, 675 bp, Homo sapiens
  misc_feature (3)..(3): n is a, c, g, or t
  misc_feature (347)..(347): n is a, c, g, or t
  misc_feature (437)..(438): n is a, c, g, or t
  misc_feature (444)..(446): n is a, c, g, or t
  misc_feature (455)..(455): n is a, c, g, or t
  misc_feature (495)..(495): n is a, c, g, or t
  misc_feature (507)..(507): n is a, c, g, or t
  misc_feature (521)..(521): n is a, c, g, or t
  misc_feature (675)..(675): n is a, c, g, or t
ttnaggaaacgttccttcacgagtctgccttagtctttcacctgtgttcacctcagctaaacgttccttcacgttccttcacgtgtttgccccagcaaaacaccacccaaccaactttccaagaagccctttagtttccacttcgtgtaagttctcctctagaaatgttggtatggaggactgggttggctgcaaggtgcttgctgcaaggctgtgagaatctgagtttggctccgtggcactcacataaaagttgagccctaaagccaggcatagggctggagagatggctcagcagttaagagcgctgactgctctttcagaggtcctgagttcaaatcccagcnaacacatggtggctcacagccatctgtaatgagatctgatgccctcttctggtgtgtctgaagatagctacagtgtacttatgtataatnntatttnnntctttgggntggagtgagaagaaaaaaaataaaataaaataaagccggncataacatcgcncgtttatgtcaccnctgccctctggtccctgcattttgggtggttcaccactgccctctggtccctgcattttgggtgagtgtaactatcatgtttcttatattgaatagttttctgcaatgataggtaactattttatgaccaagaaacacagtatttatatatatn

SEQ ID NO: 493569 - DNA, 146 bp, Homo sapiens
tggcgacacgtacgcttggcattaaggcgacagcgatttctagtgatagtcagtagaattagaattgtgaagatgataagtgtagcagtggaaggttaactggttagatattgctagcggggtaccgacgctctgaattctgtaat

SEQ ID NO: 493570 - DNA, 117 bp, Homo sapiens
  misc_feature (69)..(70): n is a, c, g, or t
cgcaggctgcgctttgagctagcggcgccgggatttgcgctgtccctcccaaaggtgatgaagaggggnngagacaggaccccaatgctcctgaaaaggcgactatctgcctgtcac

SEQ ID NO: 493571 - DNA, 111 bp, Homo sapiens
tctgtttcttaaaattagggctttgtggggcaggcacggtggctcaagcctgtaatcccagcactttcggaggccgaggtgggcggatcacctgaagtgcaggaaacaaga

SEQ ID NO: 493572 - DNA, 217 bp, Homo sapiens
  misc_feature (172)..(172): n is a, c, g, or t
ctgaattttgtaatacccacttaaaaattttattctcagctgggcgtggtggctcacacctatgatcccagcactttgggaggccgaggtgggcggaccatgaggcaggagatcaagaccatcctggctaacatggtgaaacccatctctactgaaaatacaaaaaatgtanccgggcatggtgggcacgtgctgtagtcccagctgctcgggaggc

SEQ ID NO: 493573 - DNA, 622 bp, Homo sapiens
  misc_feature (125)..(125): n is a, c, g, or t
  misc_feature (167)..(167): n is a, c, g, or t
  misc_feature (177)..(177): n is a, c, g, or t
  misc_feature (187)..(187): n is a, c, g, or t
  misc_feature (199)..(199): n is a, c, g, or t
  misc_feature (236)..(236): n is a, c, g, or t
  misc_feature (315)..(315): n is a, c, g, or t
  misc_feature (317)..(317): n is a, c, g, or t
  misc_feature (323)..(323): n is a, c, g, or t
  misc_feature (339)..(339): n is a, c, g, or t
  misc_feature (342)..(342): n is a, c, g, or t
  misc_feature (375)..(375): n is a, c, g, or t
  misc_feature (397)..(397): n is a, c, g, or t
  misc_feature (421)..(421): n is a, c, g, or t
  misc_feature (423)..(423): n is a, c, g, or t
  misc_feature (427)..(427): n is a, c, g, or t
  misc_feature (436)..(436): n is a, c, g, or t
  misc_feature (439)..(440): n is a, c, g, or t
  misc_feature (442)..(443): n is a, c, g, or t
  misc_feature (445)..(445): n is a, c, g, or t
  misc_feature (449)..(452): n is a, c, g, or t
  misc_feature (456)..(456): n is a, c, g, or t
  misc_feature (459)..(459): n is a, c, g, or t
actaggctgcggaagacgggcactgataggaagcgttcacgtagcaggtatttcccatattctggagcccagcccccaccgcagcaggtctcctgctactcagaggaagcttctccctgggagcnagctgtcttgccacaggagccaaatcatcacagaggtcgacncgggtctcanatgagagtgntgacttctcagngagagaagtccgctggatttcagcaaaagctgcatcnggccgagaagatgtgagttttgaaaagtggttgaactgccactcacctcccaagtagagtgagtcgtcctccatgtcgncnggaacnaggatcacaaggtttntcngctgggaccgcaggttgcagaaagacgctatcncttccgagtcttcaaatgacgngctctctggccgcatcagcccttntntaantcacccccnccnncnncnacannnnaccnacncatcaggtgcgcgataaaccaatcaaatatcagcactcaattaaggaatgagtcacagggtgtgtccccttgcatcgctgggaattcaacagacacagcccacatcatgacttctagaacacctgaatcaaactactcctcaggctgatagacacatgtaata

SEQ ID NO: 493574 - DNA, 837 bp, Homo sapiens
cttcctactccctcattgtacccattctaatcgccaatggcgattcctaatgcttaccgaacgaataaattcttaggactatattacaactagcgcaacaggccccaacgttgtaggcccctacgggctactacaacccttctgctgacgcccataaaactcttcaccaaaagagcccctaataatccctgccatatctaccatcgacctcgtctacatcgaccgctcccggaccattacgctctcaccgatcgctctttcttactcatgaaccgcccttcatccccccaattacctcaatctccctgttcaaaacttcaaatcatatgtctccatatatattctaagacagcctctagcctattccgagtaagtacaaagccatcaagatcacggttgaaagcatcaaagatcaagatctacactcatgaagcaggcagtcactggagaagcgagatatcgccgaaatgaaatcgttcatactgaagatcatcccttagctcattcatgctacctatcaagcattgctgaactgaacgtgtgctgccattagaaccatgctctcaccctttagtcaatgatacaacaaggaacacctcatgagttacttgctgctcattgatgaccattggcccatgatagtggtgcagttgagtctccgacattaagcccgaggacaaccgaaaactcccgttcaagctgtgcctgaagcgagattacgaagtcagtctcatgcttaaccattctgaataaaccggaggaccccttcgtcttaatttacataaccgaaataggaaacttttataataaaccccaagcactaaaatttctagaaca

SEQ ID NO: 493575 - DNA, 164 bp, Homo sapiens
gatattatgactgtttcctgattagtgtgaagttgcgctttcgtatttcgggtccaataatctaggatggtcacttaggatgttcccagccttcctggggccactggatttatactgtttagtgaagtcatcatctttgcccccaggataaccattatactgac

SEQ ID NO: 493576 - DNA, 234 bp, Homo sapiens
ataaaatctgacccatgtaactagagcaatctgctgttctccctcttcaaaagatcatttactccttccaatctctctttctagtctctgcagagcattacatatatttcgttctcactcagtactttttagacaggtcaaagttttcatccattaattcctgttgtttcttcattgcagtagtttcattactgcttacatttgctccactgtctgccgttgttcttcgacgaa

SEQ ID NO: 493577 - DNA, 230 bp, Homo sapiens
tcacaggcattgacctattcagacaagccggcctcgggcatcatctcgtacataggaagtgagcggatgaccctcctggctcccctgaattctgtcttcacagatggaacacactccaatagatgcccatacaaggaatatgcttcggaaccagataattaaagaccagctggcctctacgtatctgtaccatggacagaccctggaaactctgggcggcaaaaaactga

SEQ ID NO: 493578 - DNA, 208 bp, Homo sapiens
tgatcgcgatttctgctgggagcctgtgcagcgttactcatcacttaacccccggaatctactgcccggaaacagacaactgcatggagactagcgactgatcggatgatgccggtcacctcgagtgccgtgggttccgtcatgagtgacgctgcccaggccccagccgacatcgaggtacttggtctgcatgcctgacgtaaagctg

SEQ ID NO: 493579 - DNA, 427 bp, Homo sapiens
gcggcgccctataaatggggggggcaggatcggtggctaacatctgcgatcccagcacttataggaggtcgaggcagaagaattgctttaaccttagaaggcggagcgtagcattaagactgagatcatgctagatgcgctccagcactgagcaaccagagcgagacttcatctcagacaataaaaaataggggccaggcacagtggctcatacctataatgccagcactttgggaggccaaggcgggcagatcacgaggtcaggagtttcagaccaatattgtgaaaacccatctctacgatgattacaaaacaaattatccaggcgtggtgatgcacgcctattatcccagctactctggaggctaaagcaggagaatcactttagcccaggagtgtcaaaggttggggttagctgaagatcgcg

SEQ ID NO: 493580 - DNA, 501 bp, Homo sapiens
gaggaccttcataggactcagggcagcaggcagcgtctggaaccagggtctcgcacaaggtcagcacctggagcataggtaggtaaccgacaggagccgaaggccacgtccccaaactgagagaccacaggtcagctgcttgagcgacggcagtttgatagaggtgctcggcgcaggcactggttacattggtgaaggccaaactgaggttctccaggtttccgaaggagccggagctcagcaaacgagccaagtcagcgtctgtggacttggagggcagtgtaagcctggtgggcccgcctttcttttgcagctccttcagctcccgttgccggtcacagagctgctcgtacatgcgcttccccacgtctgtgctctccagggttgagattgtctgcagttgggtgtcgagtgagcgataattttgattccagcatccagcacaggatctccaccatggtctggtccccctcagtgcaggagcctgcggacccagcttgt

SEQ ID NO: 493581 - DNA, 589 bp, Homo sapiens
cattatgcaggtgactctagacggactccccctcttgatgcaagtgtccatggccacgtgtcgtaactaccattgagtaagcacatcaatagatggttgtaattggttatggagacagggtattgctgcgttgcccatgcgggagtgcagtggtgcaatcatggctcgctgcagcctccagttcctggtgctcacgtgatcctcctgtccaggctggtcttgaactcctgggttcaagctatcctcctgcttcagcctcccaaagtgctgggattacagcacttgagtgcccaggcacacagtcactttttgaccacggaatgacgatataagtttcttcaaccattgcatgcctagaatgcaagagaagctctgggatattacactcgagacacagtctctggaaaagaacttaactttgagcagacagaatcttttccagtgtgcactacaaaaaacctgtactccaaaatatccatagaagtgttgcttagaatggggcacaagcccacgggaagacccaccctcacagggttcatgagactcaccagccaggcttgaggcttgtatggtagtcaggcatcaccca

SEQ ID NO: 493582 - DNA, 399 bp, Homo sapiens
  misc_feature (373)..(373): n is a, c, g, or t
ttccccgcacgtgttgtgggtagtgctagcgggaatctgccgctcagtattagtttgttagagttgagatctagctctcagaaagcggctgcgcgcatcctttgcagaccctggggacaaaataaatgggtctcccaccagttgaatcacctgtatcatcagatcggataccaggctcagtttctggatgctgagtggactgtgcgtgcgggactatttcaagacggcatcctatgtcttgcttggctattcaaatagttgatactgttgctccagataattcgaagggttttgtgttctgctttcacttcagaagttatcgggcagtgagttgcggcgcgaagcctttagctttcacttcactacttatgcntcgttgaaaagggctagccactactg

SEQ ID NO: 493583 - DNA, 506 bp, Homo sapiens
gcacgaacatacacaaacccaagcacatcagtagatcggcatggcgcacttccaggaggtggactactgctcggaggaggtgagggcggtgggctacccggtccgccgcggctgcggcggcgtgcaggagcacatcgtcaaggagacgttcgtgcaggagttcgacaccgccggccgccgccatggtcaccacggccgtggctccggccacttcgaggtgcgcgagagtaggctggaggaggacatcaacacccgcaccggcgagttccacgagcgcaaggagaacttcgtcgtcagggccgatgactaagcttacacgttacggagcacactacgatgtgtgtatatgtcggcatcatatatatgtatgtgtgatgttgcgcacagtcgtatagcgtatgcaggcgtgcgtgtttggcggctatcagccccgatcgtgcgcgcgtgcagcgcttaaataagcgctgatcgtgaacaagaataaagcttctcgtgataaatattcc

SEQ ID NO: 493584 - DNA, 601 bp, Homo sapiens
tgaggtctgctcgtgcgcatgctgttgctggtggccatggcgtgggaccgcgctcaagaggctgatggccgagtacaaacaattaacactgaatcctccgtgaatggaattgtagcagtgccccatgaatgaagagaacttttttgaatgggaggcattgatcatgggcccatgaagacacctgcttatgagttatggtagtatttcctgccatcctgagtttacccactatgattacccgttaagtcccccaaagatgagatattacctgtgagatgtttcatcccaacatctaccctgatgggagagtctagcatttccatacctccacgctgccagtgcgatgaccccatgggctactgagagcagctgcggagcggtggagtacctgtgcagagtgttggacgaagatcctgctgtcggtgcgtgagcatgctggcagagcccaatgaccgaaagttggagctaacggtggatgcgtccaaacatgttggtgcgatgacctggtgagccagctctataagattgccaatgcagatctgtccagcacagtctctgcggattgtgagacctggcctcgcaacaggtcgcgcacacactg

SEQ ID NO: 493585 - DNA, 259 bp, Homo sapiens
ggaggggccagggtttaaccggggggtcctcttgaggggggcaaagggtgagcctcccagcccctctttggaggcctttttaggggaggtttttttataagccaaaggtttttaaaagcaaatgggggtttccccccagggggacgtggggcaggaacagggggttttcccccagccagtcagtatgttttgcaaacggtaatttatattgcccttggaacccagggggccatttttaggtactaaaaagcttttccca

SEQ ID NO: 493586 - DNA, 269 bp, Homo sapiens
cataatagtttatataacccagataaatatggttcactatttatagaactacacatagagagctatacagtcacgtgcctaatccccactttacaactacaagcaggatgctggtagcaaactaagatatatatttcatacttttatgtattaaattccactagtgcttcatgaaagacactatcagaacaacaattcaccataatccccctttgccatgaggaaggtaatactggtcagtaagccaggtatcgataacgtaaagtcag

SEQ ID NO: 493587 - DNA, 140 bp, Homo sapiens
  misc_feature (129)..(129): n is a, c, g, or t
tcacaacatgcacgaggctggaattcagtggcattcacagggctgatgtcactacagccttgacctcctggccttagtcagtccagctgcctcagcctccgatggtagctggaactacgaggcccagcntacataatttc

SEQ ID NO: 493588 - DNA, 169 bp, Homo sapiens
  misc_feature (23)..(23): n is a, c, g, or t
  misc_feature (84)..(84): n is a, c, g, or t
ggctgaggtaggaggattgcttnagcccaggaggttgaggttgcagtgagccgtgattgcaccactgcactccagagagttatntgctgaagctcccgcattattgtgctttcctggcttgtctttgaagtgggagtatgccatgggctacttcactgggggaggactg

SEQ ID NO: 493589 - DNA, 1066 bp, Homo sapiens
  misc_feature (131)..(131): n is a, c, g, or t
  misc_feature (937)..(937): n is a, c, g, or t
ggagtttctgcgcttccttctccctctctccagacgtcgtgtcgtccggtcctatgtcgcgcgggccctccggagcctggaggggggacacagcgcggccaggagcccctcggcccgggcgcctggaattngcgatctcggtgatgacgatgacgccgaacaaggaaggggcccacgctggcaagcttggggggccccgggcgccccgggggcccgccaggcgcacgggaggggcgtccaggagctcaaacaacccggagttacggacctagggtgtcggacgcatttggccaggggcctcggggagagattctctgggttaaaattcctcaccaaacacttcttggctaaccaaggggacttggctcctgcggggcattaccatataaggcttaacccccagcggaatcaacgcctcacctctgtgggctgggcactctccggggaggctcgttttctggcccaccgcggcaaatcatacacagtttcgcacgagattggttggacccatgcaggcccttgtgtgaaggtgtcctccaataagccgtggcgccttcggcttgtgcaactcgtgccattcgggggggctccctggagattccttcccactctaaaagcctccttggagattatctaggacctcacacgggtggattgtcaccaccgccccgggtaaatttattcttatcacttcttgcgaacggaacgagttcgcggcttgtcacaacgatggtgaaacatttgggcgcacacatttgcgccctacagccacaatcgtgcgggacaacggcacaaggggatgttccctcaaaaaagagaccctccgtgtagagagcggggacccaaacaagggacgtactagtcgccccatagactgatgtccgttgttcttctgtcttcttcgtgcgctcgccttgcgctacatcctcacatcccngtcgtctacgatgatccagtgcgacgcaatcaccactccaccacatcgaccagactgaactgacacgcgtaccaacagaaccagacacacacgcagcaagcacgcgcagccacggctcacgactatacg

SEQ ID NO: 493590 - DNA, 208 bp, Homo sapiens
taacagccggcgcctgtataaccgatatacggagttcagcacggtgctcactgttgtcgacggaacttgtacagcgcaggcatgcaccgtaatggtgaatacacgtcgaccaggctccatctttacgatattgagagaggtcatcacggtgctcacgtgtcgacggaacttgtccagagaaggcatgcaccgcagtggtgaatacaca

SEQ ID NO: 493591 - DNA, 637 bp, Homo sapiens
  misc_feature (637)..(637): n is a, c, g, or t
agcggcgttaggagagtttggggcgaggctgaaggcgcttggtgggacttcgtgggcggggcctggagtgggtttggggtcgccggggtggagcctggggactggggggctgtagaggcagggcctggagactgcggggttatcggtgcggggcctggagagggaatagggtccctagggtggagactggggactgcggagttataggggtctggagagggtagggggtccctgggatggaccctggagattgggggttataggggcggggcctgaagaggctatggggtccctgggatgaagcctcgtatttgggggcaataggggaagggcctggagagtacgtggggtccccggggtggagtctggggactggggagttttaggggttgggcctggagagctaagggcgttggaggctggacctggagagtacatgggacccctacggtgaagcctgagaatttagggagctggtgactgccctcatgtgtgatttgcggcggccagcggcaggtgggatgatggacttggcctacgtctgtgagtgggagaaatggtccaagagcacccactgccatcggtgcccctggcctgcgcctggtcctgccgaaatctcatcgccttcaccatggcn

SEQ ID NO: 493592 - DNA, 104 bp, Homo sapiens
tggggagtcaacatgcagtactttttaatctctgacaactgagagggcagagttaatttgatctagtaaggtggatgtttgaattgtgggtgcaactgcaattg

SEQ ID NO: 493593 - DNA, 420 bp, Homo sapiens
gtcaggagcatactttgtctccggttcttcaggacgtgtctccacgatgatgcttagtcagcagggtctcactatgttgtccctccgtgggttcctcaagtctcgtggcctcaagcgatctgccagcctctgcctccctgtcactgctggtgcattaccagtctgagccaccacaatcagccccgtgtttcatgagctgttactccattccaggagcctatcagttgggccccctctgattcttgaccaaggtgtccacctccttcatgaaccggagacacagctcctcttcccatggcagagcaatgcactgcacagtcaccagaagtccgacggatcctcttaccgtctctgagaaattcttgtcagaactatctccgtagtaccccttgtagaaggccagttcctcctcgtcctgta

SEQ ID NO: 493594 - DNA, 432 bp, Homo sapiens
gagagggtgaagagtgaggagaggagggggtaagggcatgcacaaggggaaggacgatggcggtgagtgaaagaaggactagatagagatgggagaggtagaggagagtcaggagaagagtgagatgaaagggatcagcatcagcaaaggtaggtagacagagagagaggagggagaggctgtgaggagtgtgtatggagagagagacgaggaggcgaggagcatgggatgtgatcagagcaaagacgtgaggaaggtaagcagcgtgggagacagagggctgaaggataagaatgaatagggtggctatcaatagcgaggtctatagaactctatcgatatagctctctctctctctctactctatatatatatatctatctctactactactactactactactactactactactactacactactact

SEQ ID NO: 493595 - DNA, 170 bp, Homo sapiens
ggcacgagagaagaaggaggttcctgcctgtgccagcaaacccgtaagcaaaaagcgaaggcatattttcgcagcagctgcaggcattcaagcgcccttcagtaaagcagtcttttccccaaaagcatgcgttcgcataggccaaggcaggcaggccttatctatcaaaa

SEQ ID NO: 493596 - DNA, 1042 bp, Homo sapiens
  misc_feature (1042)..(1042): n is a, c, g, or t
aaaacaccaaatggcgtgatgacgccggtgcagcggggtgggcccggggtgccctggtggccctgggatggggaacctgcggtggcttcctgctggaggtttctgtgcagtggcatcctgtgggcctggggtctgcggcctgtggactggtggcctggggccgaatgggcctgcggagctcgctggagtgcaatggcctgaggatacaggacgtggatgccctgtcaccaatgttgggcctgcttggtcaaggacatgaaagactcaatgtcccttgcgcaggagatctatctctttctccctgcccaattaaggaatcacgagatcattcgagtttcattccttggaggtgccctctcgtcaaaggatcgaaggttttcgaaggattatgccgagtgcaaggaaagcaggaaccctgtgccggccatgcgcaaccaggttcaaaggcataacaggttgctcatcggggggactaaccaattgtgcacacacaggtcagtcgtcatgggatgatagtaacaaggagtggcatccccaaaagggcagaggtagagcacaaaccgcgacaaactcacaagatgagaggcagcccaaatcaagtcccattggagccccaaagcctacatcccgaattcctgatgacacccccaggattggaccggccacagaacggtggccttaaccttgagcggcgggggacaccccagagcggaatttctgggtgacaaaattggcacccccaaagcagagcgtgtgtgataaccgcattatggccagacgtggtttggaaccaatgaggtatgcctcatgggcagtttaggccggtggcactttccgtttggcttcgggcctcttggaggattaaacccatggccccatgttaccgaaatatcaacgccaccgatttagagctaacccccacccaagaaggaggaggtagggcacagactcatttagggaggcgcaaaagattccacggggatacagattttcccactgagacgagagcccccgtttagggatatgaccacgttataacagn

SEQ ID NO: 493597 - DNA, 594 bp, Homo sapiens
gtgacttgttccagccaaaatagttaagttggtcgagacatgtagcagcatcatgaagtttgaagattccgcctttggatgatgaattccaaattctgcttgcttgctttttaatattgatatgcttatcaccttccctttatgcgcaaaatgtaggggtataataatggtaacatggacatgatcctctttataattctaccttgagggccgtctccatgtttgatggatctgagcagggtgctccacaggtagctctaggagggctggccacttaaaggtggggagcagagaattcttttatcccacctcaacctcttgggcagatttgaactcttccatctcttgccctcaaagcctggtaagatagttaagggggcataagttaacttcccattttcatactctgcttagaatttggggggaaatttagaaatataattggccggattattgggaatttgttataatgaatgaaaccttttgtcatataagattcatattttctttttatacctttgataaagtaaggcatgggtgggggtaatttgggttatttttgttcccccagtttaattaatccttaaacttgga

SEQ ID NO: 493598 - DNA, 1014 bp, Homo sapiens
  misc_feature (47)..(47): n is a, c, g, or t
  misc_feature (74)..(74): n is a, c, g, or t
  misc_feature (77)..(78): n is a, c, g, or t
  misc_feature (110)..(110): n is a, c, g, or t
  misc_feature (134)..(134): n is a, c, g, or t
  misc_feature (137)..(137): n is a, c, g, or t
  misc_feature (179)..(179): n is a, c, g, or t
  misc_feature (181)..(181): n is a, c, g, or t
  misc_feature (188)..(188): n is a, c, g, or t
  misc_feature (203)..(203): n is a, c, g, or t
  misc_feature (1002)..(1002): n is a, c, g, or t
tccgaaaatgtccatgcgctaccatcatctatgctatgcctggctgntcctctgcactctgggtttcctcatgngannaacagaaaagttatgaacatcttctcctattnatgtctggagattgtgtgtgtctntgnatatccctcttaatttatatccccaccgcaaaactgtgaatnancccccanaaagctgttcgttgnattctagtcattattgccctgggcatctcaggatctctcttggcaatcacattttggccagctgttcgtgagaataaccgacgcgttgcattggccacaattgtgacaaattgtgttgctccagtatgctgctttctgtgggctgcttagcatactttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatgatgtctgtgtctgcantttgtgactttg

SEQ ID NO: 493599 - DNA, 1065 bp, Homo sapiens
  misc_feature (47)..(47): n is a, c, g, or t
  misc_feature (74)..(74): n is a, c, g, or t
  misc_feature (77)..(78): n is a, c, g, or t
  misc_feature (110)..(110): n is a, c, g, or t
  misc_feature (134)..(134): n is a, c, g, or t
  misc_feature (137)..(137): n is a, c, g, or t
  misc_feature (179)..(179): n is a, c, g, or t
  misc_feature (181)..(181): n is a, c, g, or t
  misc_feature (188)..(188): n is a, c, g, or t
  misc_feature (203)..(203): n is a, c, g, or t
  misc_feature (1053)..(1053): n is a, c, g, or t
tccgaaaatgtccatgcgctaccatcatctatgctatgcctggctgntcctctgcactctgggtttcctcatgngannaacagaaaagttatgaacatcttctcctattnatgtctggagattgtgtgtgtctntgnatatccctcttaatttatatccccaccgcaaaactgtgaatnancccccanaaagctgttcgttgnattctagtcattattgccctgggcatctcaggatctctcttggcaatcacattttggccagctgttcgtgagaataaccgacgcgttgcattggccacaattgtgacaaattgtgttgctccagtatgctgctttctgtgggctgcttagcatactttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatgatgtctgtgtctgcantttgtgactttg

SEQ ID NO: 493600 - DNA, 786 bp, Homo sapiens
  misc_feature (17)..(18): n is a, c, g, or t
  misc_feature (30)..(30): n is a, c, g, or t
  misc_feature (32)..(33): n is a, c, g, or t
  misc_feature (50)..(50): n is a, c, g, or t
  misc_feature (61)..(62): n is a, c, g, or t
  misc_feature (774)..(774): n is a, c, g, or t
ttcgtgcggactaaccnngacgcgttgcantnntggccacacacttgttngacaacttgtnngttgctccactactgcgtgctattcctggttgggccctagcttgggccattacttttgttttgattgccaccaagaagattgggacccatcttccccaaacaaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatgatgtctgtgtctgcantttgtgactttg

SEQ ID NO: 493601 - DNA, 777 bp, Homo sapiens
ccacgcgtccggcgacaccctcccccccacatacacacgcagcgtttgataaattactggttttcaacgaaaaaaaaaaaaaaacaaaaaaaaaaaaaaaaaaaaaaaaaaaaaaaaaaaaaaaaaaaaaaaaaacaaaaaaacaaaaacaaaaaaaagaacaaaacgaccaacacaacacacgacaaacaacgcgacagcgagagccacgcagcaagagagaccgcgagcagaggggacaagcccgcaaagacaacgagagcaacaacgcagagcgcgcagacacggaaggggggtgcggagagaaaaagagaggagggaagaacgccgagagcagacacgaagagagagcaagaggggagagaaaaaagagggagagacagaagcggggaagaaaggacggaagacacgcgcggaggagagccgaggacaaaaacaggaggagacgcgacagaacagaacagagaggaggcgcagacgcagagagaggagaagagaggaagaagcgaagagaagggaggagaggagagagaagaagaagggaaggaagaaaagggaagaggaggagggagaagaaagcggaaggcggagcagcggcgcgagatggcacgggaatgccagaccgcgaggcagaagagcgcggtgaggggagaagagaaagacaaggagagaagaaggagagggacgaagaaagagaaggaggagagagagggacagccgcgaagggcaggagagcaagaagacagacaaaggcggcgaggaagaagggcaacggag

SEQ ID NO: 493602 - DNA, 301 bp, Homo sapiens
cggtcgttctagaggatccctcgaagatggccggctggtatgagactgccgacgactgggggccacacttgccccccaagatagaggctggactttgacttggagaaactgtgttctatctccctctcgaacacatcaatgcttatgcctgtctggtgtggggcaagtactttcaaggccggggttggaagtctcagcgcctacattcacagggtcgagtttcagccaccgaggtttgcgctcaacctccaacagcctcgaagttttactggccttcgcagaccaagtaatgcagatcgat

SEQ ID NO: 493603 - DNA, 144 bp, Homo sapiens
tggatctcgagcatgttggcctactgagatgctgccagggtccctgtaagagggaagacacgcgggaaacaggcttgcacccagacacgacaccatgcatctcctcggcccctggctcctgctcctggttctagaatacttggc

SEQ ID NO: 493604 - DNA, 359 bp, Homo sapiens
gcgcttcttctggtcacgccgtcatcgtagaatcgcctaccatatgtgtgcaatcaacaaacgcatcagcaatcggacaggaaaagaatggcatggaagcagattgccacacaacaagtgctttgcgcgggattgcaccaatagtttcagaacatgagcagtgtagaactatatggtcgaaatcgcaatttgctgtctacttagcatctaaaggccagaaacaaggaaagtgccctgcactgatattggctctccaagtttaggcttgcacagagcccttgtttatatcaaaatctggttatcatcgagatctgcttcagaacatggtcttgtggtcaattgctccagaatacctagcc

SEQ ID NO: 493605 - DNA, 1315 bp, Homo sapiens
agcagaacaagctgtaggagtgctgcattatgaatctctgatggaaatggtgagaaagagtagcgcagagggagtgtgatcctagctgtacaggaaaaaagacctatggatcactcatggtaacgaacatggccaacagggttcttcagaactggagctcaacggtattccagacgcacaatccgactagaaatccagattcaacgtgatcgcgtgtgcagatccttctagctgctgtgcaacatctctccaggaagtgtgtcattctgggataaggtagctaaacaatcaagatgcatagctcttgagccatgattcatctcgtatagttgggtatctcggtcatacctcttgattcaacgggatagttaccgatatcaagcgcctcaagcgtggagtgatactagggggcgaggtactaatgagtgaaatgctcctgtatggacagattaggagctacatggatggacagatggttgggatggatggactattcctcaagtgtatagtggacggcctatttaaaggctttgctgggcaattggattaaagatacacttatgcgtgtacatgaccctaggttagctggtgggctcagcctgatgggcgtttagtcgtgagtagtactttgctgacctgtgctccctgtgaaatcgcaacgagtacaataccctattctagtggacgtaggtgatgcagctgctttctcggcagaaatatcggtggacaatgcagaaacgttcgacatggttctgtgaaagccgaacgattcatgtcaggtgtataggtgatatttggacctttgcttattggaggaggacgttttcacaagaattaatttaagagggtggtattcgacactactcttccagccagaggcttccccaaagacccaggtggaacaaagtacagaactatcgaccaaggtgggattaacctgacatggcactaacaggcgaaaggctggttgggaaaccataataatggaatcgagacaccggtacaaaaagagggaacacagaaaacgaccaacccggacgggggcgcgcgggaaaaccccgaaagaaaacacacacgggaaaaattgcacgatagcgggaacaaggaaaccaacgggcagacaaaagaagccacgaggaaaaaagaaaagcaatacgagcacagagagggatacacacacacagaaaagaaaacaaagagcgtaaagagcagcaaacaatacaacaaagacagcaaaatggacagcacagagagcgacgagaaagacctgaaatcaaaaaacacgaccgcagcagaaagcacaacacgagcagag

SEQ ID NO: 493606 - DNA, 184 bp, Homo sapiens
agccatgcacaggaaggaacacatgacccttctgtctgtgactgttgctgagtatctgtttcatgtggtagaattgtggataagtgtttagtgaccctatcatcactgtaaccgtcgcgcctggcatagatgtagtgatttggatggtgtgttttcaataaatgcctctggggccctgatgata

SEQ ID NO: 493607 - DNA, 342 bp, Homo sapiens
taggtgacctagaggatctccaaacacgcaatcttccaagagaaaataaaaacataacttggcagcttgcttaagtttctgtcatcctgcctacacatattcttccagtggttctcaaagtgagggtactaggactggtagcatcagcatcacctggggacttgttagaaatgccggttctcagaccaacctcagacctaccgaatcagaaactctgggggtaaagcccagcaatctctgtgctaataagccttaccaagtgattttgatgggaattccagtataagaatcattgacagacacgcctggcccactccttttttcctgttagcacagaaaagg

SEQ ID NO: 493608 - DNA, 194 bp, Homo sapiens
cgttttcttcagcttataacatggcggttgattttaatatctacttcatagcgtaaatttgtgctctatttaaagtacttggactgcagataatggcagcgtatcattactgtttaattatcacctggagaggccatcacgggataccggagctcgacattctgtaagtcctggtcgatagcctgtttccgtgt

SEQ ID NO: 493609 - DNA, 569 bp, Homo sapiens
  misc_feature (141)..(141): n is a, c, g, or t
  misc_feature (205)..(205): n is a, c, g, or t
  misc_feature (207)..(207): n is a, c, g, or t
  misc_feature (210)..(210): n is a, c, g, or t
  misc_feature (225)..(225): n is a, c, g, or t
  misc_feature (227)..(227): n is a, c, g, or t
  misc_feature (233)..(233): n is a, c, g, or t
  misc_feature (246)..(247): n is a, c, g, or t
  misc_feature (255)..(255): n is a, c, g, or t
  misc_feature (261)..(261): n is a, c, g, or t
  misc_feature (264)..(264): n is a, c, g, or t
  misc_feature (270)..(272): n is a, c, g, or t
  misc_feature (278)..(278): n is a, c, g, or t
  misc_feature (285)..(285): n is a, c, g, or t
  misc_feature (290)..(290): n is a, c, g, or t
  misc_feature (296)..(296): n is a, c, g, or t
  misc_feature (311)..(311): n is a, c, g, or t
  misc_feature (326)..(326): n is a, c, g, or t
  misc_feature (347)..(347): n is a, c, g, or t
  misc_feature (358)..(358): n is a, c, g, or t
  misc_feature (380)..(380): n is a, c, g, or t
  misc_feature (388)..(388): n is a, c, g, or t
  misc_feature (393)..(393): n is a, c, g, or t
  misc_feature (397)..(397): n is a, c, g, or t
  misc_feature (416)..(416): n is a, c, g, or t
  misc_feature (418)..(418): n is a, c, g, or t
  misc_feature (422)..(423): n is a, c, g, or t
  misc_feature (449)..(449): n is a, c, g, or t
  misc_feature (452)..(452): n is a, c, g, or t
  misc_feature (467)..(467): n is a, c, g, or t
  misc_feature (478)..(478): n is a, c, g, or t
  misc_feature (498)..(498): n is a, c, g, or t
  misc_feature (505)..(505): n is a, c, g, or t
  misc_feature (565)..(565): n is a, c, g, or t
ctgggtgctttggtgtcggagatccgagagtcggagatcggagagtcggacacaggacagtcggacaccggacagtcaaacaccggagagttagactgggcttctcggtggggagaggctctgggataactactgttacanctttgaagggtcaaggaaaaaaatttggattattttaaaaaaaaatttggaaaaaaaaaaaatngngtncgtttcaactctaantnaagaantggattctataannagtaagcnaaatgnagnaaaaannnaaattnaaaaaantacgnaaaggnaaaaaaaacttattnaaaaaaaaaaaatantaaaaaaaaaaaaaaaaaaangtttaaaaaantataataaaggggcaaaaaatnaatataantattnaaanaaagattggaataaaaaanantttnnatagtatggtaaagttaaaaatattntgnaaaatgtatttaaantggaaaagttnagaaaaattaagcttgaaantattaangtaaaaatggctggaaaggaggtatttattgttatgaataaaggaggtggaaagagcttntgtt

SEQ ID NO: 493610 - DNA, 428 bp, Homo sapiens
  misc_feature (147)..(147): n is a, c, g, or t
  misc_feature (151)..(151): n is a, c, g, or t
gctcgatttagcttctagcttaccaatggctgtgatcccatttttgacagcaaacctgtcctacccaaagtcttgtaagtttacctttgagtacaggtgatttgaactgtgaaacctgtaccacaacacggggtgcactagttggtntggntatgggtggtctgtaccctatccttttggctatacccgtcaatgggggccttgctgccaggtatgaatcaagtcccctcccacagaggggaaacatcttcaactactggattacagtttctaagcctgtctttagaaaaatgttatttcctactttacttcagactgtgtttgcatcctatcttgggtctagacaatataaactcctcataaaggcccttcagttacctgaacctgacttagaaattcattgaagcaaatatgtacaaacaaaaata

SEQ ID NO: 493611 - DNA, 326 bp, Homo sapiens
  misc_feature (58)..(58): n is a, c, g, or t
  misc_feature (229)..(229): n is a, c, g, or t
  misc_feature (244)..(244): n is a, c, g, or t
attggtgggagttgcccaagggaggcccaccaaaaaagaaaaatcccttgataactgntgcctgccctttttaggcaaccccgtaaacaagggcacacagccagcactgtgtcttgcctttcagatcttaacagagcaggagggcttaacgtggtgattttggagcctcttagtgacctggtttcgtctgtgacagggacttaaactttctggttcagtagtgtgttanacataacactgaatnccttactgggatacagatttttgctcaggaatggctatgacactttttctaggctctaccaataaaagccacttgaaggttc

SEQ ID NO: 493612 - DNA, 149 bp, Homo sapiens
gacagtactcccgtttgccccaggatcgctggtccccatacatgcccacgctgtggagcaggccagatgaggctgtatacaaactcgcatgaatcaggtagggaggttatggaggaggggcattatgcccaagagccattggtggcacc

SEQ ID NO: 493613 - DNA, 114 bp, Homo sapiens
gtggagctatgtcaagctaccccttcatagggaaatatgagtgccttggtgatcaagcattaacgaacaattaaggtaaaacttggatgtgtggatttctaacgcgggactcta

SEQ ID NO: 493614 - DNA, 199 bp, Homo sapiens
  misc_feature (70)..(70): n is a, c, g, or t
ctgttagaactcctgggctcagtgatacgctgcttggctccagagtgtgcgataaggtgtgagcgcgcanccggcttgtgtttattttcttttcagatcaatccatctgattggaatgaatcttgctttttgcaaaatgcatggatatactcttttattgtctgttccccggcaaaaaacacacgtgccacacgaataa

SEQ ID NO: 493615 - DNA, 299 bp, Homo sapiens
cttttgttagtttttaaggaaatgaaactgcattgttccctttggcttgactgttcttttttatggcgtcttttagtgttgtagttgtaatatgaaaaccttaggtaaatgttgggcagtaatgtgaacaaaacagtgggaagggagtaatttttaaaagcttatctacattgctgctgtaatacttacattcaactccagatctcaaataccaccaactttaatatcaaagtcccttaaagtcagaaggtgttataatgtcagtggatggggttattccctgtgtacaaagagtcagg

SEQ ID NO: 493616 - DNA, 939 bp, Homo sapiens
gcggaatccagggtcgtaattatatgtaaatctctgcgtcgtgctgcgtgcccacgagtatggctgaataccgtgagtggggccgggctcgggctggagggcgggatcaggggctcgacctgtatcctccttctcgcttggtcgcaccggcagttccaccatctcagccctcttctgcagttaacggggctgtgcgcgaggagagcgatcactgcaagtcggtcgagtgagatctcgacgctgtgtgcagaagctggtccgagccagtcgggctttgtgacgtgatcctgcatactgtaaagccctttcaatatcgactaacctagcatccagtggccagtggcaccccttcacaaaaaggcgacacgttccggggctaaggccccgagaggttcaggatcctgcccagccagtacaaggcacagtgaagagtttgcccacaaatgcaggccccaggctttggactgttactccggtaaaggtggttcttcccctttgggattcaaggccaggcaaatggagccatcaatgtggcgagttgaccagaaagttctggttgggataatgaagagctgctgtttctttccagtgctgcttcttggggcagtgactttgtgaaccacttcattttttatggcaaggtggggatccctaaaaactgagatgatgaagacttcccggtttacaggggccctggttttttaactccacctggtataatgatctccacaccccgcgagaggcctgagggtgcgttctgaagaacctgcagtcttattggacgaccctgagctacggaggctgctgggagtgggaagactaatatggtgcgtcgcgcttacaacgcgtgttaagcttccggtcaagcaaaagcgggtctttcgtggaaaagagcacaacggcgtgctcgttccccgtgtaaggatcggccaaggcata

SEQ ID NO: 493617 - DNA, 1313 bp, Homo sapiens
actcataactcggaggcttggcaagctgactaggttcccctaagtaatcggatgcccccgatatggcgtattccccgacagtaaacaacataagcttctgactcttacctcccgtctctccatactccgtgctcgacgatcgtgctatagtggaggccggagcaggaacaggttgaacagtctacccgtcaccattagcagggaactagctcaccaccactggagcctcacgtagaccataacgcatcttcatccattacaccatagacaggatgtactcactcataatcttagagggaccaatcaaatgtatcatcacagcaacaaattaatcaaatactcaaacacccacatgcacagtaacaccaagtacacaaacagcccacgtcagattcgatcatggatcacagaaccataaatcaacaagacaaggaacactacaatacaaaccgtcatactcatcacgcagggtcactagccaaggctgggccagtcacacactataagctaccgtaaacgagacacggacacaccatccaaaaccaacacgacaaacacaagatccatacagaaaaccccgggaccggagaaggaaagagggagaaacaaacaagtaaataataacaccaaacaacactcatacaaggaaagagaaaagtagagaaccaacacacaggacaagtacaaaaaaccgcaaacaatcgcagataaccacaaggaggacagaacagagaccatacaaagtcctacccccacacaccgggacaccacaacaaaataaaatccggcgacacccaacagaagcaacaccaaccaagacacatacacgataaacgacaacggaaaccgaaacaaccaaaacaaatcacaaagagcaaaccccccgccgaggaaaccagagcagcaagcaaaaccacaacatacatgaacccagacaagagaaataacaacgggaagaacacaaccgaaccaacaaaacacccaaccggcgaaccaccaaagacagagcatcaacccccacccggcagacagcggacacacgcacaggactagaccaaggcaccacaggacagcaagcacgaacacaaaaaaaaacaagacatacaaccaaaaaagcaacaaacacaacaacagaaccgccaaaaccaacaagaaacacgccacacaacagaccacgacaaccccaaacaacacaaaacaacacaaccacagaccagcacacagaacacaaaccaaaggacagaaagaaccaacaaaagccagcacacaaaccacaaaacaacacaaaacgccgacaaatccacacagcacaa

SEQ ID NO: 493618 - DNA, 145 bp, Homo sapiens
gggattaaaatgctccctaaaagcagaaactcttggtgtctgcctcaatgcaacaggtaggtagttccaaaacacttgtgaaaaaggtctttgtttgggatatactctctctggaaaggaacaaggagcttatttatctgtgccg

SEQ ID NO: 493619 - DNA, 244 bp, Homo sapiens
cttccatccgtcggcggcagaccctgccgggagccggcttgccgctatggatgatcgggaggatctggtgtaccaggcgaacgtgggccgggcagcctgggcgatacgacgaaatggtggagtcaataaggaaagtggcaggcatggatgtggagctgacagttgaggaagaaacctcctatctattgcatataagactgtgatgggagctagaagaccctccgggagataatcaggcacattt

SEQ ID NO: 493620 - DNA, 158 bp, Homo sapiens
gctcgtttcagtttttgtctttttggccggcagaagaattaaattgtccatgaagagactgagttcaagttggatttaaagggagcagttgaggaagaattcctaagaaagtcatcattctggccaagcacgatggctcatgcctgtaatccagcact

SEQ ID NO: 493621 - DNA, 437 bp, Homo sapiens
gacacggagctgaactacgggagggctcgagcgggacacagctctggagctcgcaactggggctggcatcatcaccagagcttgcaggatccacgaacacctgaagaacagggctagtgacctcatgaactttgatgacccggcttgactacaacaagatcaccctgtggacaagctgaccattcagggcctgaaggacttcacccctgacaaggccccgtgaagtagcatcatcaagcaccccaacggaacccaggagaacatcctcctgaaccacaccttcaaacgagacgcagaattgagatggtaccgcggctagtcagttgccatcaacagaatgaaggaactgcaacagtgagggcagtagcatcccggccccgccgatggtataaagtaccagctccagttccagctccggatcatagggaccggagctt

SEQ ID NO: 493622 - DNA, 422 bp, Homo sapiens
ctgctgcgagtaacttggacgcagagtagtgcgactagatatcatagtggtgatagtgtgcgacagacacatgtggagagtacgctatgagttgtgagagaagaggagagagcacagcgcagagaagacacactcgtgagagacacaatatacacaacaccacagaatactcgtgtgtggaaggttcttaacacactataaaggcgcgaggactgggttccaatacacacgggccaaggacgttagcttgacacatatcaccatggtcaaaggttccggccatatttgcatttgggctatattttggagggacacggtatccattccccgtgtgcctgagatttctctcttctgtgcacgcgccatcggtgtgtttcacactgtgttaaggaagttaacgcgaggattctgagtgcggctct

SEQ ID NO: 493623 - DNA, 310 bp, Homo sapiens
  misc_feature (89)..(89): n is a, c, g, or t
  misc_feature (220)..(220): n is a, c, g, or t
  misc_feature (252)..(252): n is a, c, g, or t
  misc_feature (263)..(263): n is a, c, g, or t
  misc_feature (283)..(283): n is a, c, g, or t
  misc_feature (290)..(290): n is a, c, g, or t
  misc_feature (295)..(295): n is a, c, g, or t
gcccagcctggggggcccgcccagccctccctggcctttccactgtttccactttccagggcccattcaagtttttgctttgagtcaanggggttccctgcctgcagccccccatcagcattatgccaaaggcccgggggtccggggaagggcaaaggtccccaggctggtttaccaggtagttggggagggtccccaaccaaggggccggcttttgtcnctgggctctgttttccctgttggtctgcggtntgggttttttntttggcaaacaccaatgatnttccaanaaaanatttcagatgcccca

SEQ ID NO: 493624 - DNA, 1935 bp, Homo sapiens
  misc_feature (1248)..(1248): n is a, c, g, or t
gcgtgatgcgtggcgatcgactcgacgcttactggtctctggtttgggatattctactatatagaaaccctgtagattataacaagactaatttaggtataaccttatagagcaaactccatatactcatcctcacgccacagctgtgagcgtacttttcgtgtgtgctttctcctctctctatctacattctatagcgtatcaactcagtgtcatacatttaaagtcgatgatattccatgttttatagatgattgagagtctcgcgaagagtatctataattctgagattgggggacatagaagttatctctagacaaatatcctacctagtgccttagcgtgggatactttaacactatggggacattcgcgtctacctatgcttctaccaaagtgaccaagaacgcgatctttagcttgattactacgtggctcgtgttaatcctgggtgatctcaactcgtgaataccttgcatgtttactactagcctggacatgggtattcaagattgggacccataacccatgcagcacgtgcgccctacatttaagcgatattttgcaagggatcaccaattgcgtctctttggcccctttttgccttagggctcttcttggaatcactctacatacatttaatcaccctcaattgtttgcacttaaccataacgtttaatgccccttggcttttcgcccctcgggcccttaggcacattaaacaaaagggacaaattattaggaccatatatgtgtgggaccccaacagatgttttttaaaataacggttggggcaaatggtttacaactgtgtgccgtatttaaagctaagcctaccctttagataaataccaggcggcgggaacacaccttactgtgttgtgaaaacaggggttaagccatccaagacgggttacccaaacacggatcccttatgtaagagatcttattccacaaataagactctatatatatcacgagtagcccaagatatttttttggtttgttcggccatagctttgcaagacaagcgggggttggctccccccaagtatgaggggtgactccacacatttgccatcttggtcccgactttttggaggaagccataggtctttgggaaagcacccaacctataaatttggcttggtgtgtgtttggcccgacagagtattccatatttgggagactctgcgtcaaggagtagctctcccagaacacacagagagaggggcccttatgggtatngcatttgtgagtcttgttattataatttagcccctcttatatttggttataacacagggagccagagaaggtttcaaccaggtgagtgagagcgttaacagaacggcttatcacagttcgagataggtgagagcctcgagagggtagacaaacaaaaatcatagagaaataggcagacgtaggacgcccaattaggagaggaatattatactccacccagtcgggtaagtcggtcgacgcaccacaagcagtaatattgtacagtagtagccgacgagcgatcctccagtgttagtctagcagaccgaagaagccgccagtaattgactagataggaacacggcatgactaacacgtccaagcgcacgcgtgagagagtagcgcggctatgtgagacgaggggatatatggaggtagacagtatgtacaccgatattagttgtgaagagaacaataatgcaagggggagtagacatgattagatattgaagcaagaagttattagttgcgacagatgtgatgataatgatggtgaagagtggttgaagcagcaattatggagagatgaatatagatatgtaaagaacagtcgggagagttagaataaagaatgaagagatttatgatgatgataacgcatgattgtatataggtgagatgtatcgacagtagagaaaatagaaatag

SEQ ID NO: 493625 - DNA, 268 bp, Homo sapiens
caacgggagctgtagatggggcaagctggtacaggtgtgtgcagacacggagacgatggcaatgtcagaaaaggtgggggtcaaactcgttttggacatcgatcggaattaaggaaagcatagatgtggacaggtgcagtgtgtgtccatatcacggcagagtgtctgcgggagagtgacttgggaggagctgtaggatggaagatcttgaaagctccacattagaggtgaacttggagcatcttgtgattgcagggcaaatgggtcg

SEQ ID NO: 493626 - DNA, 260 bp, Homo sapiens
ctagtaacaccccttccccacagtgagtagaatcaaattttgcaggcatctcgcatccagtcattctttctcatccctctctaacatgtactcttcaaactatgttcattatttctacaatcactctttccaaattgaaatgtaatccacattacataccacataattcacccttttacataaaattcagggagttttagtatattcacaagatcgtgcaacaatcaccactaattccagaacaaggctaggcaaggtgg

SEQ ID NO: 493627 - DNA, 110 bp, Homo sapiens
ggagacagggtctccctcccgggctggaatgcaatggcacaatcatagctcactgcagccttcaactgctggacttgtgacccttctgtcgtcttctcacaaaccgtata

SEQ ID NO: 493628 - DNA, 112 bp, Homo sapiens
ttttggtcgtctctgaggttcccccggtaagactggacctctctgtgctttgggcacggcgacttagattatagagaggtccaatcttccggggttccgagctcgatcttcg

SEQ ID NO: 493629 - DNA, 1248 bp, Homo sapiens
ccgcgggggggtgctctttctgttgttggtgatatctctgctcgctcccccccacctttttgtttttgtcgctgaagcgtccttgttctctctgttttgttctcccccgggtggtcacaccctttgtggggtcgccctctattttttctcacttttttgtttgatctctcctcggtctgccatcgtaggtctccctcctcctgcggatggtgtgaggggctgtaatttttttcctctcgggagcagaaatataatatcctccttgtctttactaaaagtagaagcagggcggttgtttttttttgggggcgaaaaataaaaaagggttccctcgcagtgatatagggttgtttatttatatacgtttctatttgtatctttattatcccctctccccccctccccgctcgtgaatatagtttatagagaacatttcgtcggcgccagcgtgttttttttttttttgtcacacagaagattggttgtttttccgcccccccacgtttgttttgttttttcgcacctctcttgtttgtgtgggaggtatctgtgtgtgtacacacattgtcgtctccgtttctctcttctcactcgcggtaaccaccacgcactctctctctctccactccgggagaagatgtctcaacatttgtgtgtatatttctctctcacccacgcacaccacgaagagatttttaatctccctttatataataaatagacgcgcccgccacacccctctcggagaggtattatatttggtgcgaagacaatataaaatatttgtgtgtctccacaaagaacaccacacacttttatatatttctctccccccctctctttttatatatattgtttacacctcatatataccccacactctctgtggtgggatatttgtgaggaggggggtgttttgtgtgagagaggaatatatatattttataaataaaattattctatgagagagagaggagggcgccccacatatagttgtgggagatatatacacacctctctctttaaaaagtggcgcgccccacacaagagatatctcttctaccacccctctcactacatgttttgtgagagagagacccacacacaaatatataatatttccccccttatccacaaaaaaaacgcgcccctccccccctcccccccacctttgtgcgcccccccttttcttttttcttccccccccccccgggggggggaaaaaaaaaaatttttttttttttttta

SEQ ID NO: 493630 - DNA, 320 bp, Homo sapiens
atcacatagacggtattgatgctgacctcattgcaacgtggtagggactagacaccacccaatttagagtgcatcattatcataaagatgacgagaatgatgctctacttggtggcccagcacagctcactgctgaagagaaatacaaggtactgtgaaagatgccatcgtgtccactgccctacatgtggaacctgagaactactttatgctcctgtctttgatggttcgggaacagatatggagcccagactcgtatcgatagcagtcacatcgattgtaaggctacacctctaaccttatacgggtactactgcggt

SEQ ID NO: 493631 - DNA, 164 bp, Homo sapiens
  misc_feature (123)..(123): n is a, c, g, or t
  misc_feature (139)..(139): n is a, c, g, or t
  misc_feature (162)..(162): n is a, c, g, or t
cgttcatgatggagcttggctctccttcctctccatggctgacatcttcctcctcgctgccgctgtactcatattctgtctcctctttctcaccccgcttcttccgggatcggtcaatgtggnccttaagctggatgcngacctgccgctccgtgggctggncc

SEQ ID NO: 493632 - DNA, 342 bp, Homo sapiens
aataactggacactctgtgaaccaaatgtttctacataaggggactccctccactcgcatattttacggtgacgtcccacctgaattggacactgcgcttctcttactgtcgaagcagtctttgatctatgataacagatgaagtacacgtggcaacctgtgtttacattgcacttggtatatactgatcctttgtatgcactaatttcgtatcccctaaggttctatcacacggacaaagagaacgagactaacggaaccgggactctatcatcgttatcttcgcgtgtgtctgatgggaacaataaaaaggcaccaaataaaaaggacacgatacgcata

SEQ ID NO: 493633 - DNA, 343 bp, Homo sapiens
gctgagttcatctgatgcacctgctcaggacacaggttccagtgcagctgctgtcgaaacagatgcatcaaggacaggagcccagccgtaattgagaattcctgtggcgagagtccaggccttaccaacgccggcaacaaatggaaacaggaataactttcagaggacaggattgactggccgagtgtttatttccaagacagctcagaatgcagtggctgctctcttgagacagcacgggctcacagccctcatacatagcagaagatgaccatttcaaacctcgaagcccgatatcgtataaaacactacgtcttcacgtggaaaacacaacttcccgact

SEQ ID NO: 493634 - DNA, 667 bp, Homo sapiens
atctcaatttgaattgtatctcccagaattcccacgtattgtgggagggcaccagagggaggtaattgaatcatgggggccggtctttcccatgctattctcgtggtggtgaataagtctcactagatctgacgggtttatcaggggtttccgcttttgcttcttcctcatttttctcttgccccttgccacgcaagaagtgccttttgcctcccaccataattctgaggcctccccaaccatgtggaactgtaagtccaattaaacctctttttcttcccagtctcaggtatgtctttatcagcagtgtgaaaacggactaatacacatggtaattccatgtttaactttttgaggaacagccaaactgttctccacagtggctgcaccattttacattcctgccagccgctcatgaagcttccaatttttccatatctttgccaagatttattattgtctgtctttttgattgtagcctttctagtgggtgtggagtggtatttcattgtggttttgatttgcatttccctagtaattaacggtattgataatcactttcatgaacttatttgccacttgtatgttttctttggataatgtcttttccggtccttttgcctattttaaaatggtaccatttgtctttttattgaattatataatc

SEQ ID NO: 493635 - DNA, 569 bp, Homo sapiens
ttgagatatactagattccattccgtgaaatttcgttccattctattccattgcattactttccattcaattccattccatttcatttcagtccattcgcttcctttcctttcgattcaattccatttgattccactccattctatgcgatttcattccaatcgattcaattccattcgatgacattcctttcgtttccattccattcgagtccattcaatttgagcattcgtgtccattctattcgagtccattccattaccgtctattctattcccttccattcctgttgattcaatttcattcccttccattcgattcctttccattcgattccattcctttccattccattccattcgttcccattccatgtgatttcattccattccagtccattatattcgagtccactccactccattctattacattcaattccttttgagtctgttccataacactccattcatttcgattccatttcttgccagttttcttccattttattccattccgttcgattccattccattcgattgcatctcattcgaatacttttcattctc

SEQ ID NO: 493636 - DNA, 310 bp, Homo sapiens
ccaccgcccctttccccatccgtcccccctcagggaccaaaaagtccaaaaggggccgtgggggttcagggcgttaggaaaccgggtgggggtgagggtagccctttagccctgtcccttcggttgtgagagcagcaggaccctgggccagttccaaaaacctgggggtgtgtttgggggtggggtgtgagtgggtatgaaagtgtgtgtttgctggggcagctgtgcccctgaatcatgggcacggagggccgcccgccccgccccgcgctcaactgctcccgtggaaaattaaaggggtgaatcatga

SEQ ID NO: 493637 - DNA, 367 bp, Homo sapiens
  misc_feature (21)..(21): n is a, c, g, or t
  misc_feature (27)..(27): n is a, c, g, or t
  misc_feature (32)..(32): n is a, c, g, or t
  misc_feature (47)..(48): n is a, c, g, or t
  misc_feature (54)..(54): n is a, c, g, or t
  misc_feature (56)..(56): n is a, c, g, or t
  misc_feature (59)..(59): n is a, c, g, or t
  misc_feature (72)..(72): n is a, c, g, or t
  misc_feature (76)..(76): n is a, c, g, or t
  misc_feature (94)..(94): n is a, c, g, or t
  misc_feature (101)..(103): n is a, c, g, or t
  misc_feature (115)..(116): n is a, c, g, or t
  misc_feature (150)..(150): n is a, c, g, or t
  misc_feature (154)..(154): n is a, c, g, or t
  misc_feature (162)..(162): n is a, c, g, or t
  misc_feature (188)..(188): n is a, c, g, or t
  misc_feature (195)..(195): n is a, c, g, or t
  misc_feature (206)..(206): n is a, c, g, or t
  misc_feature (237)..(237): n is a, c, g, or t
  misc_feature (254)..(254): n is a, c, g, or t
  misc_feature (285)..(285): n is a, c, g, or t
tcccccccctgcagccgcggnggtatntcccnccagatcctcgccanncttttnanaanttttttccccctnaaanttcccaaaaaaaaaaaanccccccnnngtttaaggggannacctttccctggacctgggggtctcgccgtatcncatnaccaggtnctaaatgacccgacatgcatcacctncctttcnatgaccaaccnccctgtccccgtcccgctgacctgcccccgnggcgtctcacggtgatncctgcccctgacattggtgttcactgtagcnaactacattctggatgggaattttcatgtacatgtgtggcatgtggaaaatttcaaataaaatggacttgatttagaaagcc

SEQ ID NO: 493638 - DNA, 428 bp, Homo sapiens
acttagcagagacggtgtttcagcatgttggccaggatgctctcaatctccttacctcatgatccgcagccttgggcatcccaaagtgctgagattacaggcatgagccattgggcccagccagatcaacttttcaagagcccacaggcaatgttctaccaaatagcttattaaaacatctggatcctggaatattagctaggtttaaaaatagcttcctggtttgaatactgtctttaccttctctccatgaatccatatgccatccatccatgaatttatgcatgcattcagcaaatacttatcaagtgcctccagggtttcagacttctgtgtatgcactcgaggtagaaatgtaataggctaagcgaagtctctggccttactgagtttaacatgtagtgcggacacgtgagccagacaaacct

SEQ ID NO: 493639 - DNA, 1299 bp, Homo sapiens
ggatccacttcctcctcagggaataaaggctcagggaccggcagttctacgtactagaagcccaccatgcctcatcaggagctctaccggatgacatggcctgtgtctcccaccatggaatggacatgtggacaggacgctagactcactccatggcaagacctatgattgctaacaccatccacatggactgaatgagtgcacaccacactgaccactgacgactatatgtagaccagtgggatgacatggaggaagtggagtccacccaatgcccacaattccaacacgggcccgggaacactggccaactgccaacggacgctcgcgccggcacatgagcaagaatccatgggatgcagacatatcataccatgatctctaaggggacaaatgacaacactatcacatggttgatacaaagaaccactcacactgcaccaagcagcgtacaccagagagaaccatagctgcacggaaccgtaatactactagaacacggcatcccatctacggcacaagaagccgcgagagataccgctgcaacgcaccagggaaacacgattgaagccaaacctagagacaaaaggaacatcaaggccccaagaataggcacatacatcgtaagagaatacctcacacaagcacgcgtgcggaacgaagacaccaggcaccgcatcactcacacgccctgaccacataacaacgaataccccaaaagaaaccacaggggaggtccatggtcggccgcaatgcacacacacaggcttggcgaccaccgagtggacgacttcatcgtgcgaaagccgcacgcaatcgaacatccccgcaggacccagaaggccctcgacagagggcccgcagaagaaaaggtgggaaacccgggcaccgacgaccacacgtgggccgagggctcacaacaaaaaaacaaagaacaggggcgccaagagacgggactaccatgactaggacagattagagccaaaaagccacgagagtacggcacaagagccacacccaccggcgcaatagccacaggaacgagccaaagaaacaccaggaacagggcgaggggagacaacggggtcccggcacaaacgttacggcacaaaatagagatagagaaccggagacgagaaagagggaaaaagagagaagaggccgaggaaaccgaggaccacgcaaggaaggacgaagcaaagagcaaacgcaagaaaaaagcaaggaaaagacggacccccccgagaagtaacggacgcaaaagacgaagcagacagaggacagaggcagacagcgaaa

SEQ ID NO: 493640 - DNA, 694 bp, Homo sapiens
atttcagatattgtatagaattggtgaatccattgagcttaacttgacccctaaaaggcttctgtatgtatgctgggccgatcaacggtactacatgaccagtgggaaattcctgtgactatccatcaccatttgcaaagctctcttcacctgtgaaacaagatactctatcaatattacaaggccattgtcacgctgggacagaaacaatcaaggatctgaatgcttttcgtatgtctccagaagacacgactgtacgcctactcattcacgtaagatctctgtgtcgtttgacgacagagcgtccaacgatctactttatcttcactccgcttgtaaggtttctacggctgacggaacatgtttataactaagtcacgcacagctctcactgtttgcgtacatatttgtgttccttgctcacagtacgtgccgcacagttaagacactgggagtccttggacagaggatcgaagaactttctcgtacccgatacaagcaacacagagaaaaggaattcctgtggcgtaatgacaccatgtacttattgaacttgggaacacaatgtctcagccgtccacgttccccaattgtgtctgccttattagccccgcatagtgcttcaaggcgtggaacaccaacgtctactgtgtcaaaactggggcatctcaacaagtgagaagaatatggaccc

SEQ ID NO: 493641 - DNA, 180 bp, Homo sapiens
tttaaaaaggggggggtttccccgccccggggggcccccccccttaaaattttttttaaaaggggccccccgcccgggggggaaaaagggggccccccttttgggtttttcgggggggcccttgggtttttccctagggggggggggcggggggttcccctttttttttttttgggggga

SEQ ID NO: 493642 - DNA, 406 bp, Homo sapiens
cttgagggaaaattaaagaagcatggaaaatatatcacagtttttcacatccataagtatgagttctcagagcaagagatttaggaaccatgggaaggatagaataatgaaagaaataattgaagaaaatttcctgagctgtagaaacgtaatgaattttcagattgaaagagcccatctagtaaccaaaatgcatggaaaaagatccacaattttagcactcttaaggacaagcgactcccaaaattattgccagcgagagcgaaacaatacggacactccaataactaagttcttagccgctcgtcttgaatgcttgaagcacgtcgaccagtgacttcactctctgcgacacaatagattttgccctatgtcttctactactcagcccctacatcttatcatg

SEQ ID NO: 493643 - DNA, 186 bp, Homo sapiens
ctgtcgtccagcaggtctgcccagggtgcctcttctaattcggagtcttctacttcttgctcagtgtccatcttgcagagccagatcaagtctccccaaagcagtgacttctcacagcaatgtggcatttggccctctagtgggcagaagctgccctgattcttcctgaaggtcaaacaataaata

SEQ ID NO: 493644 - DNA, 1204 bp, Homo sapiens
ttgtcaccagataatggctcttatggcagcttactcttaattacctcatactatgtataatacaaattatagtgaccggtaattaaaaagtaagctgacatgaagccagtatcgtgagaatgcctctgagataaaagatcgcaggagagctaccaggtaacagaatcgtcagtggaaacgcagctaaagaggcagctacctctgagggaatactctagcagacagtccagatcctagaagggcataaacactccgtctaccagtaatcagaacaaaacacacaacacaaccaaaccagagaagacatcaagagcgaagaacacaaccacacaccaggagaacacacacaaaaacaacctagacaacacgagaactggggagacgcagacagacaagagggaaacaatgcaacacccaagagacggctagcagcaagcaaaaaggaaccaaggagaagcaacaaaacaacacgacacagcaacagcaacagccacacgcgaagcaaaagagacagaacaacaatcgagacagcagcgccacaaaagaacacaacaacattacagacgagaggaaaagcgcaaaccagccaaaacaagaacacaacacgaagcgagaacaaggacgacgcaccgaaaaagcacatgaaaaagagacaacaggcaaccacagacacacacactaacacagagagaccacgccacagcgaggaacagacccacacgccgcgaagaactacaggagcagacacgagaaagcaaagaagagcgccaccagacactaacagaacgaaacacgaaagacaaagcagaaggagaacgaacaacgagcgtaagcaagcagaccagcacacacaacgaccagacaagcacacacgcagcaacacacgagacacaggacgaacaccagacagaaccgtcggagcaaacacgaggctggccacgcgagcagcgcagcagcagaagacacagacacagacgcacgagcagaggcgaacacgaccagaacacagaccaagaacgagacgaagcagaacaggacaacacccagaaccgcgacagcaacgcgcagacgaccagcatcgaaaacagacaacgaggaggcgagaagctagcagcgcccgaggccacccgacaggcacgcagccgccacgccgcagagtactcacagacgaccagactggagcagcacacaccagccgaggagt

SEQ ID NO: 493645 - DNA, 478 bp, Homo sapiens
agcggggaacactcacttaatctttaagctggttttctttttttttttgggaaattaagtaacttgaaaagattaagtgattaatattcatgtggctgtgtcaggaatccccgagccttctctcaggcttgatgatccactaaaaggactcagaagagctgtaatagtcacagctgtgttttaacggcaaaaaggatacagattaaaattagcagagggaagggtgcttggagggaagtccagaggaaactaggcacacgcttgggtgtctctccccaggggcgtcacgtggatgtgcttagctctcccagcaatagtgtcacttcatgtgtgaagaatggtaaaccaggccagcgcacctgagcctcgagtctagagatttggtggggggccagtcacatacgcaggcagtgcccttgtgattgacctcactcaggctccagtgccccagtgcaaaaacaagtgatggttccccgct

SEQ ID NO: 493646 - DNA, 151 bp, Homo sapiens
ccgcgctattatcctaaggtcagataagtgtcagcctcatcttatttttatgagtaatgaagacttgcctccactccctctttctggagtgtaacatccgaaggcatgcttgaagtacccctgggcttctcttaacatttaagcaagctga

SEQ ID NO: 493647 - DNA, 135 bp, Homo sapiens
aagggcgcatgcagatgtggggcaggcaatgtgggtgggtctttgtcatgttccaacactgtccattttcatttttcaacgttgttcagcattcatggggcagtcagttgtgcatctgcagacgtggcagtcagc

SEQ ID NO: 493648 - DNA, 309 bp, Homo sapiens
ggccccggtccctggcctgtgtcctgcctgcgtggtggccccttgcgtcacagtatttgtcccttctgctcatccctgctgcaggtgcctcctcctgcccccgcactccactcccagccatggctccccttccccaggcaagctggaacctactgtgaatgcagccttggctcagcgcgacgctcatcgccctcttgtggtgctggcggcatcagtgcactgttctgtgcccgcatcgtggaattggtgcttggggcaagggtgaacatgcccgagcaagtggaaacaggttggtggagaattttgggg

SEQ ID NO: 493649 - DNA, 106 bp, Homo sapiens
tgctgttctggcagtgggtaggtcatgttctgagaggcatagcttggccagcaggcgcatgaagggcaagtggggtagccatttccttgagacgtcactccattct

SEQ ID NO: 493650 - DNA, 316 bp, Homo sapiens
catcatacacctcaggagtggaacctcagctgaacatacctatcaagaggacatgattcagtccacttctggatgactctgcaaacggctgcagatgtatcatactcggtacattgaactacttacaagatctggagactattacaggttcttatgtgcgatgctgaagagtttggacgatctgaagctgaaaaatatcaagatcgaagtttatggatgaggagctcagactggcccggagatgccaactcgtgaaaactagtaatcaagaacaaattccttggatcatgaacctgcaggaaataccagtgcagag

SEQ ID NO: 493651 - DNA, 1393 bp, Homo sapiens
  misc_feature (284)..(284): n is a, c, g, or t
  misc_feature (505)..(505): n is a, c, g, or t
tggaaacaggttcttgctctgtcacacaggctaaagtgcaagggcgcaatctcggctcactgcaacctcgtccctcccagggctttaagcaatctcccctcccacctctcagcccctcccaagtatagccggaatctcacgaggcagaaagccaccggcgaaccagcttaatttttagtatatttttttgtgcaaagaacggcatttgtgccagtgtgtgtgccccgaggcctcgcctctcttgaacacctcctgtgagagccctcagagcgaactcttcaccncacaccctcggcccctcccaaagagtgtgccttgaggaattcacgagcgcgtgtggaccccacccacgccccgggccaaaaaacaaagagaatttatatatataaaaacaagtgtgtctatacaccgagttctcggtggcgcaagggcgcgttataaagagtgtgtataataaaaattttctcaacccggtgaagagagtgggggtcttccccatctcacnctatagggagattgtaggcgactgtgccttctcctgtggaggtgtggagaggctgtagacatgtgtgaaaatctccacattctctataccgtgagagaggctctatatgtcgcatgtggagtacattgtgggcaagaaaaaaacagagtgaagtgagacacacttataaacacactctctcaaatatctcttctctctcgcgtgtgggagagagacacaacacagagactctcctctttgagagagagagagagactctgtgagagaggtgtctccaaaagtctccctcttatctccccccagtgtggttcctctctatattctcagggaccactctctcacaagcctgtgtgcaagggtgctcccgtgtgtcatatatttgtaagcccacaatgtgtgggccatatgttgaggcccgttgcccccaattcgcggcaacagaaaattatttctcttagggggcccccattcacactgtttgtggccctatttctgtgttgggccacaaatggccccaagggaaggattccttctccagcggcgggggggggcacccccagccccgtggagaggggttggcagtatccaccacagagaactacagtgtgggagcagtggggagggtagtacactctccattatggggcaccccccccaagagtataaaggccacacacaaaaaaagttgtttccccccccatagtgtgggatataattagggggggctcttccaaaaaagagcgattgtgtaagacacccccacaagtattcccccaataataagagtttccctggagaataataatagacccacggactattgttgttgtgtgtttttacaacgcacacaaaaaggcaccacgaattgtaattaggagaaaagagatc

SEQ ID NO: 493652 - DNA, 413 bp, Homo sapiens
gaagtatcggatcccacagcaatcccctcattctctatagggagtatgaaccactcctcttgtctctccaggcaggaggctgagttcaataagtccatgggagaactcttgacttgtacccacatcctaaacgtcactggtgagtcaggcaatggcaattactcagttctccatataccctgggctgatgtctggtggtactgtggggagaggaacctccataacctgttacggtccaattggaccggtacttgtgctttagtccaactggctgttccctttaccctggcattccataagatacctgaaaattcacatggccaccaaaaccggagacatttaacaaattcctttaatcccaatatctacattgacacagtgagtccccaggggggggaaagggcaccgcaaaa

SEQ ID NO: 493653 - DNA, 319 bp, Homo sapiens
tgatgaatctagctgaatccctgatgatggtgtgacaatcacctgagagctgcatgtggcatcccacatgtagatcccacatgtacacatcccaaggagctccacaggagacaggtctcctgattactggaaatcatacaggctccctgcaccctatatatatttagctttcatgcacatcatctatctttcatcttactgctcagcactactacagcttttaatagaatacgcaattcatcagtttttttttattaggagcacagtctaggctctggtaggctcacggctggaagtagcagtgggccacacatacata

SEQ ID NO: 493654 - DNA, 103 bp, Homo sapiens
tgtggcgacggggtcatcaggtggaggatcacacttgagtcgggaaggttgaggctgcaatgaacggtgatggtgccactgcactgcagccggggcaatagaa

SEQ ID NO: 493655 - DNA, 157 bp, Homo sapiens
  misc_feature (142)..(142): n is a, c, g, or t
gctgcgaggctaccatggaactccacaatagtttcttttaaaagaaaaagaaacaccattaaattccatttaacagttcatatttattaagaaccacgttgtgtatatgatttctaacggtatctactagacttgttctccnatagtggctatacca

SEQ ID NO: 493656 - DNA, 900 bp, Homo sapiens
tctgcattcacacaagtcccgtcatggtaatgttagcgtctctaactctagacagtaagaaggctcctaggcacacacacagaacaaggttggcattgcgtctcctttctactcacttgtatggccctaggcttctacaatgcggcagggccctgagcgctcagctacttgagccttggtacccttgcctgaaaaattgtttattggtgaggtaacatacaagtgtgtgtaagttttctaagcacagtacctggctgactgtcaaacactccatggatgctagttacttggtatgattagtattgccaagaggcactcatggagctctgtaaaaggcaaaaatttagtaagcccaatccctttaatctaatgttaagcactgtgtcttcttcttattcttaaacttaagtgcgtgttgaacactagttaacaccctgagatgattacctcctatgctgttttataattccccatttggaacagggttggtccgataacggtcagtcaaggggacacttcgacaatatttgtctttattggtgaagtcataactttggctcgatgtatatctaatttgggatcccattaccatcggagaggagcagatcaatttctatacagctctataaaattttgcgtatcacagtatttaagacaggttgcgatcttcatgatgtgataccacttaagcttggaaccaaacaacaagctatcttggataggaccccactagacgcaattaggccggtccccacgacccacaaagcaccttgactggttgccacacatcctcgtccaaagcctccccacgcacagcggcgctatcgcgagtctctcccaggttgccaaacgactcctgcgcgccccaagaatggactagaaccctccctcaacagggac

SEQ ID NO: 493657 - DNA, 258 bp, Homo sapiens
  misc_feature (79)..(79): n is a, c, g, or t
  misc_feature (99)..(99): n is a, c, g, or t
cgcatgcctcctcctcctgataaaaaggtcaatgatatttgatgacttttgaacaggaggtgacagagggacccaagantaggaagatttatagtgagnctcagagcccatccctagtaacagggcagagagactcctgtgcccgcgtaggctgaaggcctgccctagggcgacacagagattccatctggccaaccctttcattcagccaggacttcctgagcatccacgctgtgccagatgcggtcctagacagta

SEQ ID NO: 493658 - DNA, 159 bp, Homo sapiens
gtggggtggagctgcaggaagtgcatcaaaagatcagggtttaaaacatttgccatttgagacagcgctaatcagcggagagaaataaaggaaatattcatctttatacagattaaccattgagataatctctgtaacactcacacctgtgatgatgga

SEQ ID NO: 493659 - DNA, 269 bp, Homo sapiens
agcaggagagcagcaccacatagctggttctatgtcggttcttaataaaatgatgctaggcttcccctttggttactattatttgtatagtatttccttgatacgactccagtgaaaaaagaggtgagtgctataatttagataccagagttctagcctgcaccccttaccattatatcctctaacattttcttgtccatattaccaagttttatctattttgatgcacattccaattgggtttattacattctttaaatgtactttca

SEQ ID NO: 493660 - DNA, 138 bp, Homo sapiens
gtcgtcgacggagcaaatcagggggagcacatgtgagaagtatagagggcagtagatgcaagagatatgacagtggagaaaggagaggcctttggggtggaagagcacttgtggcgagaccctgcttgcacaggaaca

SEQ ID NO: 493661 - DNA, 212 bp, Homo sapiens
gggggccccccccccgtttttttttcccccttttaaaacccgggggcccttcccccctccggtttttttcctgggggggggggggggtttctttttttcccgggggcccctttttcccttttggcctttttttacccttttttttgggccttttttgggggggccccccgggggcccggtgcggtttttccgggtttccccccggggctcca

SEQ ID NO: 493662 - DNA, 102 bp, Homo sapiens
aaatgagctcggtaccgattgtcccaatcctcactatctgcttcatcgcgccaactatatttcactttacatccaaacatcactttggcttcgaagccgccg

SEQ ID NO: 493663 - DNA, 1330 bp, Homo sapiens
  misc_feature (978)..(978): n is a, c, g, or t
gcccgggaaatattctcccccggcggataattgtcgtggtccgagacccacacaacagcgcgggtttcctccgatagctcgctgaagggggggaagtttgcggatagctcacaagcccggcttctcgcccccccccgaatatggggtgtgttttctttttgtgcgacgaaaagccggaacgaccaacagttgttctccccttcgaacgcggggggagagccttgtgaagccccgacaacaacagttgtgtttgtcccgccacggaaaaaaggtgcgcccccgcggacacccgcttccgcgggaccaaagacgcgctttctataaatattgtgtcaccccctcgtgcagagagcaaaggttaatatagacaccgcggtttccggaggagccgccccagaagcccccccacatgtgccccacacagagaaaaaagcggtgacctcgtgtcggggaagaggggggccttctgtggaggggctctcgcccacaggagacacacacacaaagtgggtgctctctgtgtatatagagagagtgcttacacccgtgacatgtggggggagaacagagaagagacagagtttcacaggcacactctgtgtggtgggagagctctccccacacagggagaaagtgggaaattaaaagtgtgttacacagagagtggggcttataatatgtgcaacacactctctctctctaaagagaggctatacacacatcggcgagatcggcgtgtggagaagagatagagagagagacacacacacacagagagacacacacaacatctcaagagagaagagcccacacaagccacagcacaggcacaggcacagcacagtcacagtcacagcacagcgacacaattgcccgcacagcacagcacacacacagcacagcacacacacacacacagcacagcacacacacacacacagcacagcgcacacacagcacagcaccacagtataaagnggcgaaaacacatttcctcgctttctacaccacaattataaccacactgagaattgctatattttttctcctttggccacagaataagctaaggttttctggtttccccacacacagtaaggtggttttacaacaataaagaattagggtgccttttggagaaagagaataagttgcacgtggtttaataaggagataagttgtggtaagaaatttaagtttatattttgcacatttggctaaattggtctgtgctgcaatggttaaataaatcctggattatagattataaagtttctgtagacattctctgtgaagagcaagctatcccccaaaaaagtctgtttatcca

SEQ ID NO: 493664 - DNA, 143 bp, Homo sapiens
cgttattgtgactctagatgatcccccgcccgtacatgggcctgccccagtggttgcccgagtcgttaagtgcgattggttagagtggattccagtctgggtcattcatgcggagtgatgcggctgggccctggctggttggg

SEQ ID NO: 493665 - DNA, 879 bp, Homo sapiens
cgcccacgtcaccgtaagtcgcacggcggccccggcacgcccacagccgttaagcggacacctgttagcatcttgcgtttccttggcctcttctctttgctggttctgcaaagaatggctacaggggccactttccctgaggaagccattgctgactcgtcagcgaatctgtctaatgcgccttagagccactggtgaagatgaaaacattctcttctctccattgagcattgctcttgcaatggcaatgatggaacttgcggcccaaggatctacccagaaagaaatcccgctctcactgcggatatcgacagtctagaaaacggaatagactctcctttctccgaacgacatttcccacatcccacctgctcaacacacccatccccgtcatgcaccccgcctcttgctggcctcgcgcaaactagatccccctggtaacgaagagtgtgcggccaggtgccaagagattcgcccgccgcaccctaccgttacccgcacttcctgcccccctggagcatctagcccgcccacacaccccagacgagcgcggctaccccgccccccaaccccggtgctgcccgccgtcagctcgcaggtagacatacctcagtccactccccactcgcctcgccaccatccgcctccctctcatcaccgacacattaccgcccctccccgcgttcggtcactcgacgacccccatgcgccccgcttcccgccacagccgacgcgcctgagcatcgaaggcccccccgctgagcagccgccgtagtgcgacccgcgctccccgccaccatgtacccctgccaccctccccgcgaatattcgaccgctcttacttttacccacccgatcaccacatccccgtcaccacac

SEQ ID NO: 493666 - DNA, 278 bp, Homo sapiens
aattctaaaatagaggggctgggcacagtggcttatgactgcaatcaggtactttgggagtctgaggcaggaggattgcttgaggccaggagttcagacgagcccagacaacatggcaaaatcctgtttctaaaaaaaaaaaacttaaaaacttagccgggcatggtggtgcatgtctgtattccctgctgttcaggagactgaggcaggagaatcgcttgtgcccaggaggtcaagtttggcactgagccgtgttcaagccactcccgtaccagggg

SEQ ID NO: 493667 - DNA, 757 bp, Homo sapiens
gggagtcgggacgtggagacccggggtcccggcaggcgggcggtccgcgggcgcaggtggggatgcaccgtcgggggtgggagctgtgtgccatcgccaagaagaaagcttgcagaggccaggtataaggagcgagggacggtcttggctgaggaccagctagcccagcatgtccacagcgagtgtgggacatgttctagagacccaaactgggaggaatttggcgatgcagatacaccaagctcggaggatccggaagcagtccatgagttccgtgtgcagattcccagggacatgtgtgcaaggcaattggctgtggatccagcgtggctctctgggagaaaggcattgtggtctgagcatgctgggcgtgggggacttctattgacgaactaggtgtccgaagattcatcgatagtgtgccgtgagcagctgagagcaatcgtgaatgtgaggtcgtgatgactttggagtgaactacatcaaacaggtgttgacagggacaggggccaagttcggccaggatgtcaggtccaagatgactctggtcagagccatcaagaaactactggcacttggcactggcttcggcatcatccctgtgggcggccacttacctcattcagtcgtgttccagctgagctcaatatggatccacaccggggtgctgcagactggcgagagaagaatggtacgtgactgtcagtgagatcaaaggccagtcttaatgggagaccgaggaacgcggaagtggtga

SEQ ID NO: 493668 - DNA, 683 bp, Homo sapiens
tattgcggcctcgggtcggcgccaattgttgcgtgacatgagactgtctagtggcggagggaaaaacggtcaaaaggggattattcaaatgtaccgaaaaccttctcccgggatcaggcgcggcggaacccccaggccaggggcaccatctggtggggcagaaggtgattgaattactcagatatgaagatcatcatctaggtttcagtgtaaacaggccctggatattcttaagtggccattttggactttacagatgtattttggataattttgccccagaagtttattacacattggcaagaatcgtctgtgaaggtgaattgatagtagtgaacaattcagcaagctacattacacaagagacccaggcagccatctcttcagatatcaaggttcaaacggattatatcactggctacagtatttcagctggtgatacattatgcctcccctatcccacagccacgtagtaggagagttcttacagccgaacactgagaagacgtgataatgtactgagtagtaacagcaagttcaaactgacctgacgtattgccggaagtttacatggaccagtgaaattctaccattataagaacagtgtacgcactcattgacttcggctccttcatgtcaacaactgggaccctttcaccgactgacgagactttgcacagaca

SEQ ID NO: 493669 - DNA, 263 bp, Homo sapiens
atcgggtagccagagtcacgcggagaaaccagttttcacactgctcaatctatttttactgtgaatcactttctcttcggcagcgatcagtcccccatcctgctctcccactccagatccttttttcattgggtgagtacaattcccgctgagtgtacttcgtactcaggtagggctgttcaagcgggtgaaaaggagttgcaacacgggagatatcttcctcaactctcgctcagggggtatcctctagaagtcgagcctgc

SEQ ID NO: 493670 - DNA, 924 bp, Homo sapiens
ccgatgagtaacccgaagcccctagaggagtgtgtcacctgcctgagtggcacttctgtcccaccagcatcagaccagtgcctgaccgagtcccctggcaccatgttttgggacgagtgaagaagcgggtggagatctcctgcgccgtaccaacttcgagcacctgtgtgcacactgggcttcgaccagcactgagcagaagttcactggtggctgccccgccagtggcagagcctgatctgaggagtcgtgctcgccgtgcccaatgcccctcgtcgaccccagcctgcatcacctccatccatgaccggtggccccacaagaccatctgtgcggggcagcaaagtgtgccaaagatggtgtgccctcaccgctgctgctggactgagtttgagaacatgtcggtgacacgcatccaagatcacctgctggacgagacagccctgctgccggcctgcccgtgcccgccagtgacgacatgggatgccagaggagcctggcaccacggcccagagtgggggaccagtacaacgtgcatggccagccgagggacggctacgacaggtcacacgcgcaaggccgggctggtccggcacatggtagacaggtcgacctgggccggctggccaagagaaaagaggcgccaaggtacttcgcgtgacgggcctcaagggaggatcccacacaggcacgtcctcacgggcggacaaaaggggcacccaccaatcatactgaggcccttgccttgttctggggaagcccgcgcaagagcattgactggtactcttgtgacgcggactggggtcacacaaaggttggcaagctgggccttgggacctcttaacagagcgtaacccgcacggtgctcaaatgtgtaaccagcaccaggccacggtggtgcgccaaggtatagaacccccgatg

SEQ ID NO: 493671 - DNA, 650 bp, Homo sapiens
  misc_feature (301)..(301): n is a, c, g, or t
  misc_feature (440)..(440): n is a, c, g, or t
  misc_feature (443)..(443): n is a, c, g, or t
  misc_feature (481)..(481): n is a, c, g, or t
  misc_feature (511)..(511): n is a, c, g, or t
tggcagtagctttatcttttgagcctctggaatcaggtgtcatgagggcagtgagtcagcaatagccaggaaggaggctactctcagagggtgaagcacaagggacaagccttcccgggactgcggcaggaatctcagacccttgaagacacacgcctcactaatgggcccaagcaggagtgtctcagagagtcacttgctctgtgccatcaggggatcccctttccctcttggagtctcagtttgctcatctgtgaaatgaagcagcatgactgtctccctcagtccctccggccctggncttctggtcttgcttcgtagtctccgttctgcattcacatcgctctttgaccatcgctcctgatcactgcaaatggagaagtcccttccaggctcccccagcctctggggctcctgcaagggaactcaccctccaggtngtnctgccactcatgcatccaacatggttattatagaaaanaaatgatgacaatactcacaaggactgtangttaaccctccttggatgcctgcacatgctggacaattgacatgcatcatcttatcgaagcctcacagcaatttgatgaggaaagcgctactgtgatccccattttagaattggcaaaactgaggctcagagagaacat

SEQ ID NO: 493672 - DNA, 356 bp, Homo sapiens
acattgcagtacccagttctgacacaaggagccaaccatgggaccttgttcggccaccaaggtaggggccgaggacctcatgagccaaagagaatgaaacaaaatgtggatgggctactgttggacacactggtccgtcatactaaatcatgtagataatgatcaggaacctccctattcaatgataacattacacgaaatggcagaaacagatgaaggatggttggatgttgtccagtctttaattagagttattccactggaagatccactgggaccagctgttataatattgttactagatgaatgtccattgcccactaaagatgcactccagaaattgactgaaattctca

SEQ ID NO: 493673 - DNA, 623 bp, Homo sapiens
gctggacgcagtggctcacacttgtaatcccagcactttgggaggccgaggcggttggatcacttgtggtcaggagttcgacgaccagcctggtcaacctggtggagccccatctttactgaaaatacaaatattaggacaggcgcaatggctcccgcctgtaatcccagcacttcgggaggctgaggtgggtggatcacaaggttaggagatcaagacagcaccctggccaacatggtgaaaccccatctttactaaaaatacaaaaattagctggatgtggtacgtgcacacctgtggtcccagcaactagggagcagtgacggcaggagaatcacttgaacccgggcaggcaaatgttgcagtgagccattgcacttcagcctggcaactagggcaacggtggcgtgcgatcacaaggttaggcagatcaacgaccaccaccctgtgtccaccatgcgctgacaacccccactctttacctaataacactacctacacaacttacgctggcatgtggtagctgcacaccttgtggtcccaggtcaactatgggacgacgtgacgtgccacgctgatgaaattcatccttgaagccccgggacggcaaccactgtttgcag

SEQ ID NO: 493674 - DNA, 860 bp, Homo sapiens
  misc_feature (470)..(470): n is a, c, g, or t
  misc_feature (834)..(834): n is a, c, g, or t
taaaatccccacggaccggactggtatagtttccaggtatctgcaagatttgcagcgtccttttgagaactcggacggtttccaggcagaaaccttctaggtacgctagccttctgcccggacgaggcgcgacgtgagccttcagaccggccctccatattagcggaccttccaacagcacgagcgtcaagggctcaaatgactctcggctttctcaagaacaaagccgattccagaggattcgaagaagactgatgtaagcagggatgcgggactgtgctcctgtgagtggataagttcgccgtttgtgacacaacggggtcgtggaccgctggtgctgacatggacttcactcctaccccccgatgcccgtccacggactcggagacgcctgaacatgcattacagtcacgggaagcggactctatgcgaatggtaaatcgacagggcctacgtcaatattctcctcnagacatacacgaatcgctgagtacgcacattgcagcagcaacgaagagagacgtaatgctatgctaactcgcgcaaccttatgctgatggatgtgcaactgccacgtcttctcttgctgtagtcatcccctcgagtcccagcgtccctacgcattgcctccaggtacatcaatcccgtccggataaagaaggacccagagggtaagaaggaacattggaggcgggacgccactccatgtcctcggagccccgcgaggtccaggcccagcaacttcccggcatccgcgctgaacagcctgaagcctggcctgggccgagcagtggcagcagagagtggcctggagagggaagccacatgccacantagacagccacagcagtcaagaataa

SEQ ID NO: 493675 - DNA, 221 bp, Homo sapiens
tctgcaggcactgcgtcacgggcggaggaggtgaggcacaaaagcgacaggcgcaggaggaggcgagcgcttgcggacggcaggtgcaggacgggaggcagcgtaagcggcaggcggaggtggatgctggcctcgcgcgtgaaggccgaggccgaggcggcgcgcgagaagcagctcgcccctgagttagcagctcgcccctgagttaacccagcagctcg

SEQ ID NO: 493676 - DNA, 392 bp, Homo sapiens
  misc_feature (18)..(18): n is a, c, g, or t
tgagaagaacagagttanagaatatagtcccatgggaaaagaagcccatcattgactgataaaccaaggagattctatttgctttacagaaggagctactgaaaggctagctgtggtttataaatcttttagtcttatcctgacatagtagcagcacttgaatgctgaccttgaaataaaaagcactgtgctctgtgtggaattcaagtagagatatttccatataacctgatgttacttatatattttgtctattttaacaagcgagaaagaatgagagagaaagcattaataagagctatgtagaagaggtggcatagagcctgaaaggacttggaaggatgattctaattgcaaacagttcaaataaaaaaattatggccaatctgaaa

SEQ ID NO: 493677 - DNA, 176 bp, Homo sapiens
ctaatgacgacagtgttatattctttatgagcgaacaaccgggtaggcttctttgccgggcgatatagagcactgtgttgctctgcaccatgtcgtccaccacgttgctcgtggacacctccttagagcggaactgcaatggcgccgacgggttctccccatgcgtggatagccag

SEQ ID NO: 493678 - DNA, 1589 bp, Homo sapiens
gagcgtctctacgaaaggcggcgcaacatggagccaagcatgactgtggttgagtccactttgactcagaaatacttgggtctgagtagtgaagagcatctcgtgtctatgcttcacactatacatgaaccttacttgcgcagatgacggctcgttcagctagggacccacaggatacccaaagagtcgtcattcgtgcatggctctcgaacggtgtgctgtagttgattcttgtagcggatcgatgctcctttcatcatcggactatttgcgaagaatactggattgggacatgctttgaggccaccttcatagtaacataacagtttccacacgcctcgaattctcatctgggcaaggcacgtcgctctgcccatgtggtgtgagaacatacacataggccgctgcactatacaacctcatctcgatactaggggcccatgttaggtcacaatccgtttcatactacccccgtttagcaacctatcacatcacgttggcgtgtactacatctcccatagtggacgcatcccagcaaaacattccgaccgttgtggccatcctagataagcaccagtagaagggaggtctcctcggaatacgtcgcatcccacgcataagttcagggagtttggcatcctactagactagggaactatacaaccgccggccaatgcgaggctttcatcacctttaggaacgctggcgccaggtgtctctctaggatatcgccgtcagaattagctcatggggcgatatcattcgcaacttcaccataccataaaccgccgtcgaaacacgcctacatttcctcaggctatatgagctaggtgagaactaacgggaactgcattacctatgtccagttggtcgtccacacacgcgtgaacctccagataaatttcatagcgggctggcgaccggccccccatacaaagatgcctcccgtggcaactcagcaacacgggaacttcgtaaatttgcgggaacacactgagatacctaatttggtaccaccatcccgaacggagcatgttggtctggcgcggtggaatcccatagccgtttgggaccctatttggcaacaatagggcacactgtatagaggttcacaacgactacacatttctccccacggatatacctcaggggcacctccacaggcgccatctatttctggccgaataacatcaggcaccgcgctttcggcatatccccatatgtgacttatgtggtcgacgatcccctccgtatactattctaaacaccgccccttcaccatcttccagatgtagtacactctgcattccactctccgcgcacgctcaagtgaactgtcactgagtatacaacacatacactccgtctttcgtgcagatggaaacacctgacccctagttcccgcgcctcgtatggagacattaaggcgtacgaacaaccgccgaaccgcagtgggtgcacgcgtcttcacaagtgtgagctagctatacgacgcgacggtctgcgaccttacgatggcagacacagtcgcacaagagcttggacgccgaaccgcacgctgaccagcagtatactgctacatcatagcg

SEQ ID NO: 493679 - DNA, 325 bp, Homo sapiens
gcattattctcctctccatggacccgtgatgcatgcctctccctagtcagtgtaccaggcacattcacacgacaccaactccttaccctctcttcacatggatcctcttcaagcttaaacctgggaggactcacaaatggcagtggaacgatcctctctgctgctccaggcgctggtgctcagtaccgcagatgcacgcagcgcctccagcctcttcagcccgagcagcactcttttctcttcctctcgtttgcgatatggaatgtctgatgtcatgccttctggaaggagcgggcttttggaagattttcgaaacaaatcggta

SEQ ID NO: 493680 - DNA, 124 bp, Homo sapiens
cgtccttatcatacctaccagggtttaattctctgaatcaaaagatcagttcagagaggagcctgttttgtcctcatgcaggggtgaagatgtgcagagcaccgtgggaatgtccaagcccaga

SEQ ID NO: 493681 - DNA, 160 bp, Homo sapiens
gagagagagagaaagaaagaacaaacaaacgaaagaaagtcttgctgtgcccaggctggtcttgaactcctggcctcaagggatcctcccaccttggccacccaaagtgctaggattacagacatgagccactgtgcccagcctaatatgtggatccttg

SEQ ID NO: 493682 - DNA, 298 bp, Homo sapiens
  misc_feature (58)..(58): n is a, c, g, or t
  misc_feature (250)..(251): n is a, c, g, or t
tgtggtgttagaggatcggagtatgctgacagtcatgaaggaattattgaggtcaggncacggggctggcaggaggtgccttcaaggaagaacaacttatttgacttcttcttgggacgcaggttgttggtgtgacacacttcttcttgcggagttgacagcacgagggtgaaggcgagcatagcacttgcggcagatcatcttgtcgcagttgtatttcttgggcaagcttggcggagaagaaggctcnnaataatgcacctctgcaggcgcaacacccaggtgcacgggtggactc

SEQ ID NO: 493683 - DNA, 197 bp, Homo sapiens
ttggacctaaatatcacatctgtgacatgcaaatagcccagttgtacatgtgacttgcctgatccttttcactctgaatgattttttttttgtttttcagttgggttacacgccagtcagtctgggggttgtacagttcctccagggttccaaaccaatgtgcagagtctcaggccctgaagagctcacggcgtata

SEQ ID NO: 493684 - DNA, 316 bp, Homo sapiens
cctgtggttagcacaactagggtcagtttgcaggtggtaagccattaagatagttgtaggtaaagaagggcagatttattagagaaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 493685 - DNA, 419 bp, Homo sapiens
cctcagagcccgagctggctcccagcaccagtgtgaatggtcctgtatcgactacagcttgatggacatgctgactggcgggcaggagaaggacggctgggagccccggggcaggtccaggtccagggggtgtgtgtgatcccatcctccgctcccagctctgatgctgccatgcagggacagggcaccatgggatgtctgtgggaccttccaacactcttccaggaccccaaagctgcctggggagctgggaaaaggacggcttgtgagcctggaaatgctgggcatgaacgggccaagctcgaccctggggacagagaaaatgacccgcagggaccatgctccgcatgggcagtgagtgagctctcccagcgccctgggtgcctggaggctgtgattcacaggaaagtgtgcggccg

SEQ ID NO: 493686 - DNA, 126 bp, Homo sapiens
atgcagcggtactgatttgcagcgttatggtttgcagcgcatactcagtttgccagcggtactgtttgccagcgttgggcccaggttcttggtgcagggggtcccgcagctcgcaattcgtcacat

SEQ ID NO: 493687 - DNA, 194 bp, Homo sapiens
cttataagacccagcattattattatattagactggcttgcttttggatttaaccacgccgcttgttcctgagaaaacaaagtattaggtagtagccaaaggtccaaacacatttgtcacttcctacacatccctacatgagccccttgagggagaaaaactgtttatggctcttgaaatcccccagcaacttt

SEQ ID NO: 493688 - DNA, 130 bp, Homo sapiens
tcggtacccctcacaagacctggcagaagcaggaagcaccactctgtgcagtcatcctaaatataggttcagagcatctcctggtgaatgacatattttgtcaatcactgccaggatctccatttaagcc

SEQ ID NO: 493689 - DNA, 237 bp, Homo sapiens
cagtaggggaagggagcctccatagggatgtagaactaggaagtatgtgcctgcgttcaggcgttcaggctggttgcctcatcgggatgatgatagccaaggtggggataagtgtggtttcgacagacagactattacaactatgacttagttctgtggctgacgactgttatacttacaggagactttgtacgggaggatagtactacgagacggtagacgtttatttcgtgatag

SEQ ID NO: 493690 - DNA, 612 bp, Homo sapiens
  misc_feature (593)..(593): n is a, c, g, or t
actgacaggcgggcctgaccgcgcatgcggattttgacacttcatgacatgtaattatttagagcagtaatgaatattgacctgttttggattaactgatgaccttaggaaatgatccaatagtatctactatggagaagctgaatatactccatttggagtgaacagaccggattgttacagaattttcacgatgacagatccaatgatggacttttttgatgatgccaatctttttggagagaccttagaaggattgtcaaatgatgcattagctcaatcaggacctgtttcactagatgatgaattgaatttggatgcagaatatgaaccggcgtgcatagattcactgaaccatgttcacggtactgcaacatatgatggtaatcaatcttacggtagcacaactgaacatgtgttatctccacactctcagtttaatcgatctccaatgcatgctcagaaccaacgcaatggatggtttctagatggtatcatatggccgttcgatgaggcgccgataaacagctactaccagtttacatggaatggatgtctttttagcaactagacattgacactctatgcattanagtgctatgcgcacatctg

SEQ ID NO: 493691 - DNA, 414 bp, Homo sapiens
  misc_feature (49)..(49): n is a, c, g, or t
  misc_feature (91)..(91): n is a, c, g, or t
  misc_feature (350)..(350): n is a, c, g, or t
tttatcctcacagccagctgtaaaaggcagctgcttattggtttttacnccattttacagatgatagactgaggaacagcgatattacttnataatatatatatatatattttttttgttagacagagtctcactctgtcacccaagcttggagtgcagtggtgtgatcttggcatactgcaacctccgcctcccaggttcaagcaattctcctgcctcagcctcctgaggagctgggattacaggcatgtgccaccatgcctggctaagttttgtatttttagtagagacggggttttaccacgttgaccagactggtctcgaactcttgacttcaaatgatccacctnctcaggctcccaaagtgctaggattacaggcatgagcccctgtgccaggctgaaactgattctt

SEQ ID NO: 493692 - DNA, 614 bp, Homo sapiens
gagagagagaactagtctcgagtttaatttataatttcctctaaaggtttgaggggaaatgctggacaattgtacgtgggtatggaaacatgtcatataagtaatgctagggtgagtggtcaggaagtttttccactaggaggtgtatgagtgggccgtagcggaacccgggggtatgctgtacgaattcataaggacacagggagtgttcagaaagctagggtcttggtgcacaaaatatgtcgtgctagagtccaggggagagtgcgtcatatgttgtccctaagagaagaattggtagtgggtaagacgggttgttcatcaataacatcaatggtaagagcagttatacccggactcatagacaaacataagggcagaagcgggccctgagcgacgtcattaacgcacagctaagaagccctgaaaaactaaaatacacgagaacaaccccgaatatcgggccacaaggtacggaaagcggagagtacacggggagagagacaacgagactaagaagtgcggaagataaaaatcataattaatagggaccaagggggtacacagaatagagaaagaaaaaataaacacaaaaggggagaacataaacgaag

SEQ ID NO: 493693 - DNA, 128 bp, Homo sapiens
accatcagttaataagactgttcggtcactgtgcctgtcagactcgaggcagtggtaacactgcacagtgctatgtggcttctctttgaggatttttgggtttgtaactaaattcctgcttatctcct

SEQ ID NO: 493694 - DNA, 730 bp, Homo sapiens
ttggcacgagggcccgcagtgtctgtcgaggggccgcgccgctctcccgcagcccgcgccccgtccgcgaggcccctggttgacgcggtggcctgcgaggcgcctacacccgcaggccgctggcaggccgtcccaggaggccccggcgccaacgggacccggcgcgtgggacagcggctctgctggcggctggcgtggagggatggcctgtgaccggggcgacggggacgaagccttcgcccgcgggacctgtgtccggggtgggggctccagttcctccgaccgcccgtgcgctgggagggaggccgagcccggggaacgccgctgtgccctgcctcgtcccccactgtggccgcgccagactccatcccggtgccagacgcgtccacgggcccaacatcccagagatctccgtcaggactactcgacctacagcataagagagagtagggaatagcgacaacaagagaaaacggaaagaaaaacgccccatagaacagaccgatttgagaacgatgataagacaaggatccggacgcaaaccaaccagacactattgaaaataaacaaataacaaagggaacagactatgacagcacagaaggccatacgcagggagaatcagccaacacacatcaatattgaaaggagggaatgtaagacaaatagaagacaacacatctaaatataacataactgagaggatacataaaggcgagagtgtaattgc

SEQ ID NO: 493695 - DNA, 185 bp, Homo sapiens
cctcgttaactgatccttaaccaccaagtgaggtcaaggataacctgtgtctcaaggatactagtcaggttcattactgctgaaccacaatgggaactcatcttccatcactatttttatgctccagtcaacaaaccggctcctccatccaaaacaattatttgtattatgattgtcaatgtgcc

SEQ ID NO: 493696 - DNA, 300 bp, Homo sapiens
acaccagccgctttggggaggagctcctagcctaccaagagagatggaaagcatagactgggacccgaatgtcaccaccatcatctcatcttcaccaccatctggcagcttccatgcctcctaagccagtgcgtcccaggcactgggcacagctctgcccaccttatcaccagtcctccggacagcactgcaagccagctacctttatcaacacacccggttgatagatggctcatgtatgctatttacttcatgtatactctatttgaaattttctgtaataaaaagtttaaagaaaaa

SEQ ID NO: 493697 - DNA, 112 bp, Homo sapiens
ctgacaccattctctctccatttacttcttggtgggtaccctaactctctgactctctagaagtgcccccagatgggggtaaacccttattaaacacatgcaattatgagtc

SEQ ID NO: 493698 - DNA, 112 bp, Homo sapiens
tatactcaatctgattagattttaaattcagcactttatcatattctgtatttcacttgaacctccagctgaatgatggatcacacaattaaatcgttacaacagtcatact

SEQ ID NO: 493699 - DNA, 161 bp, Homo sapiens
atcaacatatccagaagcgggacctggaggcggagcatgtggaggtggaggacacgaacctcaaccgttggacctgtagcttccgaatcctggtagtgtcggccaagttcgaggggaaaccgtgcttcacagacacagctcggatcctagcatgactatac

SEQ ID NO: 493700 - DNA, 162 bp, Homo sapiens
cccggtttttgggaaaaaattttccccaaaaccccaaaaaaaaaaaacccctagatttttttccccaagaccggttcccggggcccagggggttttttttcaaaccgccaaggtttgggttttaaacaaaaaaagtccccgttaatgggaaaccccgcccca

SEQ ID NO: 493701 - DNA, 393 bp, Homo sapiens
  misc_feature (151)..(151): n is a, c, g, or t
  misc_feature (168)..(168): n is a, c, g, or t
  misc_feature (217)..(217): n is a, c, g, or t
gatctagaggacccgggacgggagatgtctggaggcagaagataacagcagcatctcgaccagcctcggcctgaaaggaaatctttataatcaggtagggttcacagataattcttttttaaaaaaaacccaccctcctagagaagcacancggtcaagagtctggtncacacaacttcagcttggcatcacgagtctggtatcccaagaaaatcangggggtacaatgggtgggttaacactaggatactttctaaataaactctttttttttttttttttttttttttttttttttttttttttttttttttttttttttttttttttttttttttttttttttttttttttttttttttttttgtctttggggggggaaggccacaacaa

SEQ ID NO: 493702 - DNA, 278 bp, Homo sapiens
  misc_feature (75)..(75): n is a, c, g, or t
ctggttaatacttcttaagatcttgggataattagtggtgtggaaagtaaagaagtcacaggttgggacatttanacaagggtgaaggaggcgcgaggaatgtgttcattcttttattgtgcgtggttttaacctgactgagtacaagatcaacaagagcactgtactcctggcaattattacatatgttagaacatggattttgcactgtaacacatttacaccatctatggggacgtgattgctttttataaagttcaaaataaagatttattttc

SEQ ID NO: 493703 - DNA, 189 bp, Homo sapiens
cgagtcggaccagtctgttctacatacaaaaaagaaaatctctacccagatagcttcactggtgaattctaccaaacatttatcaacataaataaataaataaccacgattctacacgaaggtgttccaaaacaagtttgaaacacctttatctcattctatgagggccagcatcatcctagagagcaa

SEQ ID NO: 493704 - DNA, 307 bp, Homo sapiens
ctgacatctctgattaacctctgggcaggaacagagtctcagcatgtgttttaattaatgaaacaataattgaccagccttttctctgcaatcattattaattcattcattcaatcaatcaatcaatccatccacaggtaggtaggaaaggctttgcccgtagggtgcagagagtatcccatcagagcctcttcatactatattccaagacatagcgtttgcgcgatgaaacatatctatatctctaagcgctttagagcacacacagtagctctcacacacttctcacatgatcttgtctctagtc

SEQ ID NO: 493705 - DNA, 222 bp, Homo sapiens
cacgaggtgtccctgtgcgtggccgtggttggcaattgtaacaatcctggtcacctctaacaggtcaaaattcaaatcttctcgaaaacccctatcggcaagaccatcaccctttaagtggtgcccaatgacaccatcaaatattttacggccaaaatccattataacgaaggaattccccccgaccatcaaaggctcatctttgcaggcaagcagctggaa

SEQ ID NO: 493706 - DNA, 85 bp, Homo sapiens
ccccctttttttttcccaacccttggggaagccccttccctttaataaattgcccgtgtttaagtgacccttgagaaaaaaaaaa

SEQ ID NO: 493707 - DNA, 857 bp, Homo sapiens
  misc_feature (50)..(50): n is a, c, g, or t
  misc_feature (59)..(59): n is a, c, g, or t
  misc_feature (89)..(89): n is a, c, g, or t
atcgcattcagtccacaatttccgctatactcactcaatatacccacaancacggttantagggaaccttctcttcgcttgaccccggnacacgccctcaagcatgcttggattcatcagatctcttatacctcaagccacagcccacgccccagaccctgaggaaatccaattcctttttcccctctgagacaaggaaggacaaggatcaaggctgtcatcactcgagcagataagcagatgacagcaccaactaaactacagacacaacacgcgatagcccctctaagcactgtttaacttcacgtgatcaaccacgactgcttccacgatcgccctctacactagctcacattcttacaccgctgtaagcgccccaccacatcatattccgtcccctgcccgccagatatcctcaactcccaccccctccccacccatatcctctctccaccccaccttcccacccgcacacaatctcccctcttcacaagcctacaatatcacccccgcagctctccctccccgagcattctatgcccccctcttataccaccctgttcggcccccatccttaccagctccttccctcacacgccacacccacctgttctaagccgcttctgttccccaccgtgcgcgccatctcgcccctaggtttttatccataccctaccaataactatacactatcgtctcaccacacacttgtagccaacccacatgccctcaccccaatacccctacctgcgcccccagatcaaacccattccaacaccccacacacccacaatcagccgccatcatctatactaactccacttaaccatcgccttcaccccagcgacccactgcat

SEQ ID NO: 493708 - DNA, 495 bp, Homo sapiens
ttttaaagcaggaaacaaaggctactgactatagcatagatttatgttacatgttacaagcatgaaatgttaaaatatatccatttacaacagagtaaacagacaacgtacagaatgggagaaaatatttgcaaactatgaatctgacaagggtctaatatccagcatctataaggaacttaaatttacaagagaaaaacaaccctatttaaaagtgggcaaaggacatgaacagacacttttcaaaaaaggacatccatgtggtcaacaagcacgtaaaaaaaagctcagtatcactgatcattagacaaatgcaaatcaaaaccacaatgagataccatttcacaccagtcagaatgactgttagtaaaaagtcagtaaataacagatgctggtgaggttgcagaaaaaagagaacacttatatacggttggtgagagtgtatgtaagttcaaccattgtggaaagcagtatggtgatgctcaaagatcttcg

SEQ ID NO: 493709 - DNA, 514 bp, Homo sapiens
aaaaaaaaaattttaaaaaaaaaaatttttaaaaaaacaaaaaaaaaaaaaaaaaaaaagcaaaaaaaaaaaaaaaaaaaaaaaaaaaaaacccgttttttttttggggaaaaaaaaaaaccttttttttttttaaaaccccttttattaaaaaaaacccccccttttttgggggaaaaattttttaaaaaaaaaaaaactttttaaaaaaaaaaggggtttttttttggttttcttaagggggggaaaattaaaaaaacccccccccccccttttttttttaaaaaaggtgaaaaaaattaaaaaaaaaaggggtttttttaaaaaaaaaaaaaaggggggaaagggtttttttaaaaaaaaaaaaaaaaaattttcgggggggggaaaaaaaaaaaaggggggggggaaattttaaaaaaccccccccccttttttttttattcccggggggggggcccaaaataaaaaaaaaaatttttttttttttttttaaaaaagggttttttttttt

SEQ ID NO: 493710 - DNA, 746 bp, Homo sapiens
  misc_feature (28)..(28): n is a, c, g, or t
  misc_feature (58)..(58): n is a, c, g, or t
agcgatttgtctcctaaaaggcgtttgnctatcctaacttgaagatttgtcaggctcntcgatagagtcgcaagtccagtatgccacataagaagtgcatctgatcagatgttctctcatatatggtgtcgatctttagtacctccatcagcatctggatggtgtcatttcatgcacacagcttggtcatagcaagacccgtgtacatactcaggggtgtcagtaaaatgttatctttgtcatccatggaatctgccaggtgctgatagaaagtggtatcatagcgggcattggccttgtacagttcccagactcgccggttgatggcctccgggatcttctgttctgagccctcatcctcagttgccttcttctccatggatcggtaaatgcacatgggcttcatgggaatgttgctcggcttgactgtgcagatgtccacagggctaccgtgacaggtcatacagtccccaacgcccatgagcagcaagtctacagactattccttcctggtgtggccaagagaaaggctgactcctttgaaccaagtgcaggggtccgggacaggttcagtcctagacttcttgccagggtacagttcagttgcctggacgtggtcatgttgtaatgagcatcatgttatggctatttggagtattatgtgctctattcctcgcgctttatccagaggttacagttcctatcccattggaatccatgagcgcttatcttccacagggttgggc

SEQ ID NO: 493711 - DNA, 105 bp, Homo sapiens
tcgcgctatcggtatcccgttccgccctggtcctgttcgcgttcagcagcagttgactcttgtcctgagcccctgccgcttcggcgatcatcttcagcgtgcggt

SEQ ID NO: 493712 - DNA, 276 bp, Homo sapiens
agatcccgaatcggcttccatacagaacagtgattactctcacttcacaaatgactgtaaaatgtcggcgtcgttcctgttcggcaccgggtctacactgaggtattttaaaaataaaggttatattagaatcctcaacagatctctttaaaattacctcctgtgtaaccaccaccaaatcctatcttctaccacaattatcccttcccccaatgccaagaccaaagcacaataactgaatatttctattgaagtccgatcttcataaataagttg

SEQ ID NO: 493713 - DNA, 515 bp, Homo sapiens
  misc_feature (18)..(18): n is a, c, g, or t
  misc_feature (22)..(22): n is a, c, g, or t
  misc_feature (61)..(61): n is a, c, g, or t
  misc_feature (101)..(101): n is a, c, g, or t
  misc_feature (103)..(104): n is a, c, g, or t
  misc_feature (107)..(107): n is a, c, g, or t
  misc_feature (119)..(119): n is a, c, g, or t
  misc_feature (149)..(149): n is a, c, g, or t
  misc_feature (152)..(152): n is a, c, g, or t
ggaaaaaaaaaaaaaaanaaanaagattgatatttaacaagagaaaaaaaaaaaaaaaagnccgggttttttaaaaaaaaagaggggggcccccccaaaanannaanaaaaaaaaaaanaaaaaaaaaaaaaaaaaaaaaaaaaaaaanaanaaaaaaaaaaaaaaaaaaaaaaaaataaaaaattaaaacatataaaaaaaaaaaaaaaaaaaaaaaaataatacaaaaataaaaagaataaaaaaaaaaaaaaaaaataaaaagataatcataaaaaaacaaaaataattttaaaagttaatgaaaaaaaaaacaaaataaaaaaaaattaaaaaaaaatactttcaaaaaaaataaaaaatttaaaaaaacaaaacaacagaaagcccagtttctaaaaaaaaaaataaaaaataaaaataatattaaaagaaaaaactaaaaacaaaaaaaaaaaaaaaggagaataaagaaaaaaaaagaatacttaaaaaaaacgaacaaaaaaagtaa

SEQ ID NO: 493714 - DNA, 779 bp, Homo sapiens
ggtcccttggtgaagaccccccgagcccaggcatctggccctcggtcccctggccccgcctcctgtcagtggactgtcctggcacgtgtggccctggcgcccctgcctgcgctgtctgccatcgcgctgtgactgcccgcatgctgccagcctcagctcgtggggccgcccgtgctgtgcctgcaatccttccgtgcgcctgccaggcgggacagtggggagggtggtcgggggtgtctgtgtgggccgtgggcaactgagcttgtacacatgggtgccttctgtcggaggactggctcaggtgctctgtgccggttgcttggagcaggggctgcgggaccccaggccccttggggaagagcagataggaccaagcctagcatgaggaggccaggtgtgtggggcccgggtgtgcaagtgctgggcctgccagtgtggatgtgcctggagccccttcgccaggcggctttcactgacggtgctggccagggcagcagggccggtttggcgacctggaggtggatatgggtagtggctgccagcccagccaagcctgtccccttggggcattctctcgaggctgctgggtgtcctggcaggcacgtcctgtggggtcagcacgccggctgcagcgcagggtgggcctgagatcgggtgccgaggcccccatctcagctgtctggacacgcagccctgagctgtcattgcagcttcctccgacatccttggcggagtctgtgtctcggcccagcccagacctctttctgggaaccctccag

SEQ ID NO: 493715 - DNA, 253 bp, Homo sapiens
cacgttcatctatcacaacttggtgttcttatgcagaagatgtgggtcacacacaggtgcaattattggactcatggtgggcggtgtagtccataccgcccgtgctcgtcatcaacaggtgatgctgaagaggaaacagtacacatccatacatcatgatgatggtggaggttgacgccgatgtcaccccagcggcgcgccacctgtccaacgctgcagacagaacggctacgaaaacggcatcttcatcgag

SEQ ID NO: 493716 - DNA, 778 bp, Homo sapiens
  misc_feature (20)..(20): n is a, c, g, or t
  misc_feature (667)..(667): n is a, c, g, or t
gggggctcaaacttattttnagcggacagggcgcgggctatcacaaacacccgaatggcactagcctcacaacccggcaccaccagaagcaagcgaaacaaactttttatgaaccaaatgacgcgcatgagaccacgacgtacaggagtccatcctctgatcttctagacatgctccggttgtattctgagaaccagggcggtgccaaaaatgtcatgaagaaagatattacgcgcacacggggcctctctctgggacaatcctaaattaaacactattactatgtttaggccaccgctgaccttaaaagcgagcttcttgtggacagttccgcctaaaactaggaggtgtaagccacaacgggggggttcttatccagtcgcggttactactacatggatgactttgccttcataagaccagtgccatggcttttccctttggcataacattggggaacataggtgaaacgcgcgtccgcctttctcttccaaacgagtgtccccagtaggaaacgggaaaatgggatttggaccggtttcctacctaactaacacttcttgtaacaaaagtgggatattattccatggagtccccagtagggctgaaccttgttgaattccacaaacactagaaggacccatctttgatcgcgtaaagtttattncccctttctacacaggaaagcctgtcctataaaaagctggcttcaaacggcaaaccgggaaaatacccgcacatatggcgtttggaacatacggtggccccaaaccctagc

SEQ ID NO: 493717 - DNA, 802 bp, Homo sapiens
  misc_feature (16)..(16): n is a, c, g, or t
  misc_feature (18)..(18): n is a, c, g, or t
  misc_feature (82)..(82): n is a, c, g, or t
  misc_feature (123)..(123): n is a, c, g, or t
  misc_feature (226)..(226): n is a, c, g, or t
  misc_feature (256)..(256): n is a, c, g, or t
  misc_feature (262)..(262): n is a, c, g, or t
  misc_feature (313)..(313): n is a, c, g, or t
  misc_feature (338)..(338): n is a, c, g, or t
  misc_feature (340)..(340): n is a, c, g, or t
  misc_feature (346)..(346): n is a, c, g, or t
  misc_feature (348)..(348): n is a, c, g, or t
  misc_feature (463)..(463): n is a, c, g, or t
  misc_feature (483)..(483): n is a, c, g, or t
  misc_feature (488)..(488): n is a, c, g, or t
  misc_feature (566)..(566): n is a, c, g, or t
  misc_feature (588)..(588): n is a, c, g, or t
  misc_feature (595)..(595): n is a, c, g, or t
  misc_feature (611)..(611): n is a, c, g, or t
  misc_feature (686)..(686): n is a, c, g, or t
  misc_feature (701)..(701): n is a, c, g, or t
  misc_feature (703)..(704): n is a, c, g, or t
  misc_feature (713)..(713): n is a, c, g, or t
  misc_feature (734)..(734): n is a, c, g, or t
  misc_feature (794)..(794): n is a, c, g, or t
aactccccggtgtganangggtagggaatgctcccggcggcgacggggccgagttcaccagccgccggggcagtagtcgaangcccggcgcggcatgtcctgggtgccgcggtgcgggcagtnaacgcgcgccgggcgggatgggccggcgccgggcgccaaaactgtaccgggctccgttcccgttgtacgcgcttcaggtcgaccccagcactgggctgctcancgctgcgggcggaggaagcgccgccaaaanaggaanaaaaaatggcgtgcactttctgcagctaaagctgattaatgggcgcttgantgcctccttgctgcactcccataananaaaaanangggccaccataaacttggcactggctggtgacatccttgctgcagggcaggatgccactgtcagctcctgcgcttccaggcacatcaacagcagggcaacaaagcaaaaaaagcnggttccaaggagcaggggcntcganaaaagaaaggagcagccccagacagagaagaaatgtggagcggaaacccagcacgaggggctagaactcagggtaganaatttgcaggcggtgcagacanactttanctccgatccactgcanaaacttgtgtgcttcaaccacgataataccctgcttgccactggaggaacacatggctacgtccgtgtctggaangtgcccaccctggananngttctgganttcaaaccccacgaacggganattgaacacctggctttacggcctgatggcaacttggtaaccgtgggcggggaccttaangcctctgt

SEQ ID NO: 493718 - DNA, 669 bp, Homo sapiens
  misc_feature (8)..(8): n is a, c, g, or t
  misc_feature (64)..(64): n is a, c, g, or t
  misc_feature (106)..(106): n is a, c, g, or t
  misc_feature (108)..(108): n is a, c, g, or t
  misc_feature (132)..(132): n is a, c, g, or t
  misc_feature (138)..(139): n is a, c, g, or t
  misc_feature (182)..(182): n is a, c, g, or t
  misc_feature (189)..(189): n is a, c, g, or t
  misc_feature (212)..(212): n is a, c, g, or t
  misc_feature (218)..(218): n is a, c, g, or t
  misc_feature (251)..(251): n is a, c, g, or t
  misc_feature (273)..(273): n is a, c, g, or t
  misc_feature (277)..(277): n is a, c, g, or t
  misc_feature (282)..(283): n is a, c, g, or t
  misc_feature (323)..(323): n is a, c, g, or t
  misc_feature (325)..(325): n is a, c, g, or t
  misc_feature (373)..(373): n is a, c, g, or t
  misc_feature (468)..(469): n is a, c, g, or t
  misc_feature (659)..(659): n is a, c, g, or t
aattaaanaaaaaaaaaaattaagcatgtcacagaatatagtttatgattattagaagaatgangttaaatcaatacttgggagattgtttattaatgtgtgaatnangtctttttttaatattcataaatngttttnnaattttaaatgtgttttagaaagaaattggttactccttgggnaaaaaanaagtgtgcattacaacggctagnggaagngtttaaaggatagattttcatttatatttaggnaagaatgtgtctctggccttcngggnttggnnccatagcaaaagacataaatacatattgtaattataaatngngcattgtaattataagtggtaaattctactacaaaggtcagctatggntagattcagtgagttttaccttaaaatattggcttaaaacaattcaaatcaaatggataaaacaactttttgctttccaatggcattatgatttnnggtggtatgggaagagaagttctcaaaccaatagtcttcaaggttgcagagagaagcttctgtctgccactttcctgatgtactgaatggcccttggtatatctttataaaaatgttaaacccacagagctatttaaagataaaaaaaacttacataactttatttttcaaagactaatatgtctcaggnacatttagct

SEQ ID NO: 493719 - DNA, 291 bp, Homo sapiens
gtaattgttttctttgtaataagaaggtgtggttgtatgatcacccaaatggatgtaggaatggcatttgacaaaattcagatcttttcatgacacaaacacttaacaaactaggagtagaagggaatttcctcaatctgatgaagtacatctatgaaagacttacagctgacatcatacttaacagtgaaagattgaatgctttccccctaagattggaaacaagacaggctgtccattcttgccaattatatttaatattatgctgcagattctagccagagcaattgg

SEQ ID NO: 493720 - DNA, 2371 bp, Homo sapiens
  misc_feature (42)..(42): n is a, c, g, or t
  misc_feature (52)..(52): n is a, c, g, or t
cggcggaaaacacattaggctttgggatcgaaggtccgtggnttttgtcagntctgggccaccgaccggggacgacgacgacgacgacgacgacgacgacgacgacgacgacgacgacgacgacgacgacgacgacgacgaacgacgacgacgactaccgacgacgacgacgtacgtacgtacgtacgcacgacgcacgactgctgctagctgctagctgctcttgctgctcgggacgcggcggagtcgggcgctatctatctggtcggtcttaccgccgtcgtcggtcgagcgatgatcgatcagcatcgaccgaacgaaacgaaagatcgatgagaagcatagtacctagagatcgagcgaaagtgcgtctagacgtagagttcgagaggagtagatcgtcattagtcgtcagttcgctcgtggatgatagtgactattactttcttccttgcttgatgcgcgcgatgctttttcttgctgcgttgtgattgttgctggtaggttgttgattgttgttgattgttgttgttgattgaatgttgttggttggttggttgtttgatagatgatagattggtggttcgatggtggtagaagggtgggtgagtgataggatagttggaggatggagaggtgagatacaagacagtaattcgaaagatgcaacggtgttagataagtgagtagtctacgcttctatctcacgctgaactcaacattgcagatagctagctttcgcttccctcgctctcgctggtgatggtgttaggtatacttaaggtatagtcatcctttcctgtctattgctatctttgcgtgtcattggcttggagatgatttgcatactgtttactatacatttacttatcatatgctgtggctattcactatgccatgttacttgaattgcacgggaagcacaagccatgcatgcgaatggcaaggaaatccatgctggcgccgccacggcagcgtagcggacggcgaggacggcgcaccggcaggtgtaggacaaggagcaggaggagaggcgagaggcagaggatacggaagagtcagtcagtacgcaccccgtcagcacagcacctactcgccggcgcacgggagagggcaggactcgggacgctgccagcaacgtcccgagacaggggcagaggacgggacagtacaggacctgcacgaggcgcgcgcagcgtcacgcaccaggaccgacacggatagctcgcgcaacagtccgcccgatcgagcagcgacgcgaagactcgttcggtatgaatacgataccgtaccggacacactcgactccgatagcaatcgtaccgtgaggatgggacagagcagggaaggagataggactagcatccatcacgattcgcacgagaggtagagactagagctaccggaaggcgaaagaaagagataagagcgaggagtgaatcggataggtatgctcgagtacggatcgcgctaagataagacaggccacgggcagagaagatcagacagcgcagagaccggtacggacggtcagcactgtctgcatcaccccagcacgcccagcccgctcgatccctaagcatgcgtaggatcgactgcgtcgcttacactgagtctcttgtgtcgcttcgttcgattcaattgctcatgtgattcctcagttgcgtctctttcttgtgcttgtcgttccttcgctgcgccgtcgctgattgaccacaacggagagatgtgcgagacctcttgcacactgctgtctgtactactctgtgtgtggtgtgttcggcgttggagtgatatcattgagcagacgacgtgaggccgagctgatctgagtgagagcagagagattgatagcgggagactggagcgagagctgcagcaacacgatagggtgtagcacaatgacgagggactcacccacagagctcgacgctcctggaccgtggatgcctgattgtaggctccacccgaacggccgactgtccgtacctggtagctcgggacgaaccagccggctagccgacgacgcgaatcgcaaggacacaagacacagcagacagaagacagaaggaccaggcacgctgcgccgacgacgaccatcggatgcagcggcaccgcacgtgatgcggcctgatgacgtgacgagcccgaccgcagagacgagagaacagcgacactcgcgagggaacggctaacggacagagcgcgacccgagagaggcagaagtttgaaggaggagacatagaactccactcccagacgcgcgaggatccgccgacagcgaacggctcacccgcgcacgaccgcgaagtctcgccgagaccactcaatctggaacgcctgactcctgccccgggaccgtgcattactg

SEQ ID NO: 493721 - DNA, 611 bp, Homo sapiens
gcaagacaaaggactattgtcaaagagtcagcgtgcttcgcattcaacatgctgccgttaaacttgacgtgccgtaaatcatgtttgatgtgccatagcactaccaacatacgaggtatcccgacgagaagaggtcttgtatgtagtcaagactccagtgcagaccatgcatttaagctctgcaagcaaccagcttgcaaggctggccagaattgtaaggcctcaggtaaggatgggctatttaggaagctcctaacccatatttgcgagtggatggcatctttcgaaagtttaatgggcatcaatacgttaaacgacagtgtcccaaagtcacatttctacatttccctcagctgggttttactgaagaacgtttctatcggggccgtcccaccaaatttgttctttatatcatcttagggggttaatagacgcatcatggtttgactaagttaacaagtgaattagtcatcttatcacacgttgcatgcgttttgtgtgagaacgctggattaacacatcttaagtggaacaacttgtgtggtacagtgaatcgtaatggttgacacgtgtgtgaagctttggttaaaaaattgggacattgtctggta

SEQ ID NO: 493722 - DNA, 1302 bp, Homo sapiens
cccacgcgtcgctccccctcgccctctcttcggcccccccgcatttcagcgttcactctgacgtgctcccactatctctgcccccctctatccttgatacaacagctagagctcaattatacccgagtgaccatttgtccgcacgcccgaaaagtagcaacatctggacgcgcgcccacagcgcgaagacagagccgggcgtaccgcggacgactcgggacgacatcgcatcggaataccgctaagagcggccgacccagaacagacaaaggagcggcactccatcaacaagagcacacgcacaaataccagcacccccacggagccgagcgacgacacacaaacacagccaaacgacacagacaacaaacagcacaaaacaaacggagagagacagcagcaggagcggacaacacaaccaccacgccccacggcacccacaaacaagatccgcagcaacacaccggggcaccacccaacgagggaaggcaacagacctccacacacgacgaaaacccaacccgaaacaaaccgacaaaggcgacacacagaacacaacacacaacccaacgaccgagcagccaccacacaagccacacacacaacgggcagcccaggaacagacaccacacaacccacacgcaacaccgcgcacgcgacaaacgagcgccacacgcggcacacaggaccccccgggacaaacagcccccccagccgcacgagcgaaaggagaccccacgaggacgaaccgacgccagcacaaaaccccgcggcaaccaaaatccaccaggaccgacgaggcagagaaggcgagacagagatcagaggacgacagcgacccacgaaaccagacgacacaacatagccagcagcagccacaacgcgcagagggaccaacgcagacgaagaggccgcccaccgcaggagagaggagcatggccacagaacaaaacagcaaggcaggagacgaaacagcaagacacccagaaagcggcaacaacagaacacacaacaaaagcacagagagcgcaacagaggcgacaaagggacccagagcaaacgaagaaagagcacagcaccgccgccacaacgcacccccacggcggacagggacacccagcacccacgcaggacgcaacccccaccgcaccgacagaaccaccacaagcagacacaacacaacccacccagcccccccacccagccacccgccgcagcccacccacagcacaacgcacaccacaccgacaagcggagaacacagccgagcaaacccaacaacacacgcagcgcccacgccga

SEQ ID NO: 493723 - DNA, 127 bp, Homo sapiens
ggggatagatagtggggcaaacccattgtctctaacccacaatttcttgggttcttaaattctgggtttcttgttctatgtggcaggtgtgtgtgtgtgtgtgtttgtgtgtgtgtgcatgtgtgtg

SEQ ID NO: 493724 - DNA, 192 bp, Homo sapiens
  misc_feature (28)..(28): n is a, c, g, or t
  misc_feature (53)..(53): n is a, c, g, or t
  misc_feature (56)..(56): n is a, c, g, or t
  misc_feature (111)..(111): n is a, c, g, or t
  misc_feature (113)..(113): n is a, c, g, or t
ccgtccagggagcccgggcctgccggtnattgccaggccgcagcgtcagatcnggntacctcctggtgaagcacagccagacggaccaggagcccatgtgcccggtgcatngnaacaaactctggagtggatacagcctgctgtacttcgagggccaggagaaggcgcacaaccaaggacctggggctggcg

SEQ ID NO: 493725 - DNA, 692 bp, Homo sapiens
ggtttgcttaggcgcagacggggaagcggagccgacatgccagctggcccggagctgggtttgtcgcaaaatcttatgctgagccccgacggcagtacccttacgagcaaatctcgtctcgaccaagagctgaaagctgatcggcgaggtatgcggctccgagaacaaacgttgatggtctggagggtcaaactttagcctggccaagatccgcacatggccggccgggaactgctgacgcttgatgagaaggaccacggcgtcctgtcgaaggcacacgccctggtgcggcggctggtccgcattggcggtgcttggatgcgggcacagatgaggcttggattcacgtcctgggcctgaagcagtagaggattgcttgagagagacgcctagcagaggccatggtcttcaaggctgggcttgggcaaagtccatccaccacagctccgcgtgctgatccggcacgagaccatatcagggtccgcaagcaggtggtgaacattcccgtcctgtgcattgtaccggactggcatacaccgagaaggcacatcgacctttcatactcatggcagctcatcacctacacggggcgttggccagacccgaggcccggcggatgaatctgagaagggaatgtgccaaggacaggggccaagggtagagtgagcttgaggggcttggaagacagacca

SEQ ID NO: 493726 - DNA, 383 bp, Homo sapiens
ctgtgaagactggttgctgggaggcactgaatagtgaacaacgaagctagttcaaatttgcataaatcatccctgctatagcctagattctcctaggtagtagttactttcagaacggcaacatgagctgtgcaggtccatatgagggtctacttaatcctattatgatatctctagtaactctggcagtaacagaagcaaagtaactctggacatgacagacatttagacgaatctggcagtacactgagtttaaactggacaccaagcaggcaaaggcctggaaggtttcgctctctttgtgcctaacaggttttgaaaaccttgaaggccagtccacttttgacaagaagtactgtgtagtctgcttgcagccttctctt

SEQ ID NO: 493727 - DNA, 202 bp, Homo sapiens
cggcacgaggcgtccccctggctcacccactctgtgtcagcatgcaagcctttgggagctgtgagccaccatgttgaataggacattcagaagggttgagatcctagctatatgacaggcactatgatatatgttctcattctcaagttttaatgctcataacaacactgaagataggtggcattattctctccctgcagga

SEQ ID NO: 493728 - DNA, 248 bp, Homo sapiens
gaggatccccaataaattgttggcattgatacattaaatatgaccatgcttatgataaaggtgttgctattgttttagaagttgctaaagacaatacagcaatagcctctgaagactagtcagatattttaaaaatagaattaattaaattatagtaatagtaataataagattgtgttttattcgttcaaagttgaatagtttattaatttattgaatgaacccgatcaatgaccaacaatttattg

SEQ ID NO: 493729 - DNA, 135 bp, Homo sapiens
gttgttcagagtggaggaggagggtgatagtggctgtttactaagacagcaagggatgtgaagggacagccaggcatcagtgcaagaagcatgcagtagacaaagtggaagggcaaacacaatggcccagatggc

SEQ ID NO: 493730 - DNA, 344 bp, Homo sapiens
gaaagggtcttggtgaatgaaagcattatatagttgtgatggagcaggatcagaattgtgaagtacaaaagacaagacgtataattattaaactcagtcttgattaaagggaaaggctataaattataggcgtgaaaagtattcagcatgaatctcagattctatataagcatgaaagagtacaaaagatgttggagtccagtaagcccatatctaaagtatctgtaaaggcttcaaggactttaggtttattttgatatactagtgttcttctgtgacaagttgatgtatatctccaagacttaaggccattccctggctcttggcacgaatgcttatatggc

SEQ ID NO: 493731 - DNA, 160 bp, Homo sapiens
  misc_feature (10)..(10): n is a, c, g, or t
  misc_feature (53)..(53): n is a, c, g, or t
  misc_feature (91)..(91): n is a, c, g, or t
agcataagtnatgtccgccccctgagtgacccccagacaagggggaggagcangtcaacttctgtgagtccaccaatgactatgggccatntgatggtgggggtcctgtggcagctcttgatgaatcaggggggccaactccctcttcctatggaggaat

SEQ ID NO: 493732 - DNA, 1000 bp, Homo sapiens
aatggcgcaaataaatactaccgtatggaccaccataattaaccccatactccttacactatgcctcatcacccaagctaaaaatattaaacacataactaccacgctaacctcccgtcaccgaagggccaaaaaggtaaccaaaagacagcagaaaaattattcctgtgcgcctgagctactgcagaagaaaggatttggtcatcagggttccgtgcttgccgcagcaaattatgccaggggaccatgtgtcagggtggtggacttacagacgccagttaattgggactgagggggcagggatccatcctactggttgatgaaactttcgcgggatgagacctgcagtctctaaagccatacgggtcacgcggcactctgggcacatggcaggtgctgataccacaggacacatggttccccatgtaatatcatactgtcaacctgcccaaatgcatgtgagtgggttgtgatggcaagcatgtgatgtaggcaaacgtgaacagaaggcaagactatttgtggaggccatgcagcgcttacgcggtccaggaaatggcaacgaccagacaagacagatcacccatctgcatgactgtggacaacctcgcaataagtttggcgctcggcgtgcgcatctttaaacaacagatcaattcccttcttgtagctcaggagaagcacccctccaacccaattggatcgacaagaacccagaaacattgggcactccgcgagtcccactgagctccatgtatccttgtacctcccatggctagtggatggcgaataaggtaatgatatcacataacacgcactacacggcaaaaaaaaaaaaaaaaaacatgggggacgcacagcgagtcacgacaaggctgcgggcaaaagagaacagcacagacaaagacacagaacaaagaccacaacaaccgacaggcaacaggcagcagaaaacagaacgcaacgaacgagcaaagagcaaaaccacgacgcagctaca

SEQ ID NO: 493733 - DNA, 184 bp, Homo sapiens
atggagaggtcacagcttgccaaagggtaaacaactcgccgcaggtaactctcatccgtgtggttatcatacagccacggagcatcaagcacatcatgcatggtcaccaggtgggtccattttcactcatagactccagcaacgaaccctccgcaagctccatgcatcgtgaccacacaactcc

SEQ ID NO: 493734 - DNA, 303 bp, Homo sapiens
aaaaaatacccaatttttatttggcatacctgaacaaagctggaaaaaaaatttcaaaaagaaaggggcccgggggaagcctgttcaaaaggagctttgtttcctgcaggctgccacctggagaaacactttttcccaggaggggcttggtatgttttaatttaaggccacgctgcctttgtccaaattaacagatgtttttttttgcacttaatccctcccccacagtttccagggagaggcttttttcaagccacaggatcgattcgtcggggaaggaatcaatactggggtttttcgggc

SEQ ID NO: 493735 - DNA, 761 bp, Homo sapiens
  misc_feature (475)..(475): n is a, c, g, or t
cagattactggggggggggagctttatactacgatgattccgtaggctcatatccatgaatgctcacaagaactgctacttaacctcatagacccatacaggcaggtgcagctgaccacatgctctggcccgctactcatcgagggtctgtggctatgggttaatctagcgggaggatgtctaataggagtaccacacagaggccttctatgtcaagttcactggacaacctttgatggcatgtcacagatcatctgtctcacatgacaatggatctcaacgggttgccgctgggagcaaggcactcagcagacactgatgacttggtctgaagaattacatcttctgtaaaggcacatgggagacacccttctgagtcaatgacaccgtagaataggactctcactgggaccacgtgcacacggtcattgtgcatattatcaagccgatatgcatgttaacatccattactgtntgaagcacttcagctgtttcatggtgatgtatgaactatgccacgacacctgcatatttatactgactgatcaagagagaccacatcggctggactatgaacatacccaggatagtatcacctatgttgtggataatgatgacagtaaggctgcctgctgacacttatccctgtgcataactgctacctattattccaagagctgcctgagttcactggacatcactaatgcctctcaggacctgataatgctgggcgggtcatcaacagactaggactgggctct

SEQ ID NO: 493736 - DNA, 432 bp, Homo sapiens
  misc_feature (197)..(197): n is a, c, g, or t
ctcgctgtgtcagccaggctggagtgcagtggcagaatctcggctcactgcaacctccgcctcccgggctcaggcaattttcctgcctcagcctcccgagtagctgggattgcaggtgtgtgccaccacgcccggctaatttttgtatttcgtatttttagtagaatactaaaacaacatggtttcaccatgttggnccaggctggtcttgaactcctgacctcaggtaatcccccaacctcggcctcccaaagtgctgggattacagacgtgagccaccacgcccagcctaggaccatctggttcttgacacagtataggaaggagggaaacagggttcaggaggaaggcagtctgggtacagtgggggaaggaacacagttcccgaaggttttccaggaggttttgttgttacatagtgtttttaggggt

SEQ ID NO: 493737 - DNA, 535 bp, Homo sapiens
gaccagattgctcgaggcagcggagtgcgatggcgacgtgcgttttgtgctgggcgattcgtcgttgcccaccgcgccgttgcagggcggctcgtattaccgtgtcctcggtgggtacggcggtgtagcaagccgtgtgaagcgctgaatgccaagttgttgcaggtcgcccggcagacctacccggtgttcaaggacgccgaagccgtgcggtttgaagagggccaactgcacgccggtgatgtgagtgtttcgttggcgcaactggtcaaggacagcggtgaggaggtgctgcaagcacaggttgacagcgagccggacaagaagcgccagggctatgcctgcgcgacccatacggcggtgtttgtcgaggtgcgggttgatgaagacctgggcaccatcaaggtcagccgtgtggtcagcgccattgccgcggggcgcgtggtcaaccccaagatggcccgcagccagatccttggcggcggtggtgtggggcattggcatggccctgcatgaaggcgtccgtagcgggccg

SEQ ID NO: 493738 - DNA, 126 bp, Homo sapiens
atcagcggcacggccccgatgggcttctgcaagcttgcgcacctcatccaccgggcccaacatgagggaagtgcctgtgtccccaatggcctcacagccctccttggcaagggtcaggccgctggc

SEQ ID NO: 493739 - DNA, 463 bp, Homo sapiens
  misc_feature (103)..(103): n is a, c, g, or t
  misc_feature (110)..(110): n is a, c, g, or t
  misc_feature (115)..(115): n is a, c, g, or t
  misc_feature (139)..(140): n is a, c, g, or t
  misc_feature (152)..(152): n is a, c, g, or t
atgagtgcaggggccaggggaacccgtgaggatcactctcaaatgagattaaaaacaaggaagcagagaatggcagaagggaaaaaacaaattgggcggcggnaatcttncaagncaatttcgcggccgcaaaacaacnncccttgtgggangatgagagtgaccaggttgaactgggaagtggaaaaaggagtttgagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggctcaggagttcttctgcagagatggcgctatctttcctcctcctgtgatgtcctgctcccaaccatttgtactcttcattacaaaagaaataaaaatattaacgttcactaaa

SEQ ID NO: 493740 - DNA, 201 bp, Homo sapiens
taggacgtcactgcacgccaacctgggtgacagagccaacagagcagactgtcaaaaaaaaaaaaaaagcctgtgtatctttctcatctcaaatcccttttattaccccttattaatccattccattccatcagtttccctgtaaaacctctatttggaaattatttcctgattcgttttatcaccatttcccctgttatc

SEQ ID NO: 493741 - DNA, 440 bp, Homo sapiens
aaggattctggtgatcgcagctctggggtctgtggctgtgtcacactcaggtcacacacagcatgtggagtagtgagcagttcacttctagtcatctgttgatttaattatccccattagggagacatttttaacgggttttagagtcctttggcaaaactgactgtgccccttgtgtcagtgaaaagactttcacttggatggcaacccatcaccatcaccatgtacaatgcacagatgaatctgggctgggcaatcacaggcaatgcttgacaaggggtgggtgacatcatgtccacaaagatgcccagaaatgaggtcgtgaggaagggtgggtattaggaagcaatgtggtgggtcctggccgaggtctaacatccctagcagccttcctcaggcacactgtgacagtggagtgggcacacgtatcgtttcaggca

SEQ ID NO: 493742 - DNA, 123 bp, Homo sapiens
  misc_feature (34)..(34): n is a, c, g, or t
tgctatcccggtcggacgaccgactttgcacgtnggaccgctacggacctcctctgtgcttccacctcctctgtgctcctcctctgtgtgtccaccctctgtgctgtcctcctctgtgcttgt

SEQ ID NO: 493743 - DNA, 645 bp, Homo sapiens
atggtgcagcaagtgcggcaagatcaaggctcgagatcttcgcgggaagaataaggaggagctgctgaaacagctggacgacctgaaggtggagcttgtcccagacctgcgcgtcgccagagtgacatggcggacggggcctccaaggctcgtctaggataccggagtgcgtccggaaatcgcattggcccgtgttctcacagttattaacccagactcagaagagaaaacctcagggaacattctagcaagggtcaagaagtaggcaaggcccctggacctgcgggcctaagaagagcacgtgccgtgcgcagtcggttcaacaagcacgaggaggaagccgtgaagaccaagaagcagcagcggaaaggagcggctgtacccgcgtgacggaagtacgcgggcaacgggcgggagggtgcgccgattgtataaatatggaggcaacagactggggtggaggaatatagcacactagatattagagatttgacacaacgagatcattattgtgcggttggattcgtgcctggaaaatagaagtgaaaagaccggattgttgtactgtgtaggcaaccctggatgattggcactagagtcttgaatgttgtaatagtagcttgggggcaagggtcgggataccag

SEQ ID NO: 493744 - DNA, 178 bp, Homo sapiens
caggcgcttagtcgttccgagttcagctgtgtgaaggcgacagtggtgcagggtcttccgtgtggtattacgacggtccctatactaggccgtccccttgaataatgcagtaagggacccccattttacgacacagggcaggcaagaagacaaccagcttgatggaagcgtcgcgcat

SEQ ID NO: 493745 - DNA, 269 bp, Homo sapiens
gaatccaaggggcccttggttttttttacaaaaaatacatttttcaagaggaaaatgttaagggcataaaagctttccccttagctttttaagcttggtttggggcatcataaaaaaggatcgggatcattcttatggggcccggaggttttgccccaaatccccgaccaagtcccctctttttaaaaacaaaaaagggggaaataaagggtaaaaccttttaattgggggaaggggctgataaatgactttattttacaaagctcctt

SEQ ID NO: 493746 - DNA, 382 bp, Homo sapiens
gggggatgaagggttttttttagagacaggcctcactctgatgcccagcctggaatgcagtggtagatcacagctcactgcagcctcgaactccgtggccgcaagaaatcctcccaccttagccaaccaaagtgtggggatggcaggagtgaccactgtgtccagccaggaaagcccttcggtttcactggaatgatatttctgccgcagacctacagccatggtggtattaaacggcatcatggcaggaaaagaaaaggtgagaggtgaccgtttggcttttttctgaacatatcagaccaaaccggggctgtctggcacttttttttttttttttttttttttttttttttttttttttttttttttttttttttttttt

SEQ ID NO: 493747 - DNA, 825 bp, Homo sapiens
  misc_feature (825)..(825): n is a, c, g, or t
ccaacacaacatcacctctagccatcaccagtacttagcaggcaccagccgatgcccagccgacacactgttctacccggccgcacgatacccctaacccgtgcaacacggctagccataatcaccttgctacccttaacttccgcggcaccatgatactgaactggcctccaacgacggcgatatcaacacatgcatcatcatatacctattctacaccccagcatgcacacactcgacccctgcacccggtgaaagaagcgccgagagcccactacaccaacaagccacagcacgcacgaagaaccgccatactgggcagacctctctaccactataagactacaaacccgccaaacacgacgctaacccataaacaccaaacagcaccccaacaaagagtacaccgttgaaccagcctaaacacaaaacacacgcatagaccactatcaaccaacacaaactattaccggcgctacagcagagacgacggaaacgccactacggccgaacgcccacggcagaagccccgccgaaaaagcacccatttccacggcaatgaccacatgcagatgatcctactattgcccaccactacggatacacgttattccacgcccacaagaagtttcctaccaacgtgccccggaccaccccctaactcccttacacttaaccagcttctcacaaacatatagtgcaactccctcagaatatgacttacacacctatgcatggcaagtccgcaactagccggcgcgcaaacaccccactagggaccttatagcaccctcattttacggcgcgttgcatcattatccaacn

SEQ ID NO: 493748 - DNA, 409 bp, Homo sapiens
attgctggcgcgttcaccagtgaacagtataccattatacggatcacgggccgtcgttacaccgggaaccagttatcccattgataccgattcaggggcggtcgtgtccacccgcgaaaccgtataccgattatgggattacaaggcgcgtcttcctgctcccggaaacacgctttggccggccgtggtggttcactcgcctgaggtcaggagttcgaccagccttgccaccgtggtgacccccatctctactaaaaacacaaacttcgtcgggcatggtggcgcatgcctataatccaagctactggggaggctgaggttgcagtaagctgagatggtgccattgcactccagcctggccaacaagagtgaaactccatctcaaaaaaaaaaaagggggacccccaaa

SEQ ID NO: 493749 - DNA, 148 bp, Homo sapiens
gcgttaggacacgcagcgtgcggatgtgagtgacatgcgtctggatcacacagggttgctctgtgtccccttcttccctcccctccagcgccccttatgggggtgtgtggacacaggtcctggcacttagcgttcagcgggagctttc

SEQ ID NO: 493750 - DNA, 250 bp, Homo sapiens
atcagctcggcccatgttcagatattgccgcaagaagctcctggctgatcaggctgatggcccgcaggtctaagatcaaggaagcacgcgagccccgtgaatagcgcctccaggccaggaatggaggatatcatcaagactttatccaaggaggaagagaccaagaaataaaatctcccactttgtctgtacatactgtgcctcgtgtgattacatagatcagccattaaaataaaacaatccttatctg

SEQ ID NO: 493751 - DNA, 297 bp, Homo sapiens
aggagaaacctggctctgctccttgccgtgtgggtggccggctgtgtggctttgaggaagtgacctaagctctctagacctggttccccagctgggaaggactggacaaatgcaactcggaagatccccgtctgactccaaaattctaaggctctagggtttaacagttatttgtagagtacgcacggtggaatcttgtgctggttgctatggggaggtggagggggagtgagaatacaaaggaacgagtttcggtccgggtggaggtaaaatataggcacgacgttttaaaattaa

SEQ ID NO: 493752 - DNA, 1655 bp, Homo sapiens
cgggagaccggggttcgattccccgacggggagcacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgctatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctagcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagc

SEQ ID NO: 493753 - DNA, 992 bp, Homo sapiens
agcggggtggtcgctgccccaacccacgcactgcgacgccgcgggcctgaattgcagttcctgtgccctggcactaatgactggcacctcctgcggcccattgcccttctgcctgcattgcccactgagtcccactctggactgtcttcagcagcggttcacacttgatgacccagccctctcccgctggccccgatgcagggcccaccatattaggacgggcgtgactggacaaggccccatgagacaactgcgggatgacgtccccagaactctcacgtggccatgcccaaccgactgtgagcactcctgctgtgctgcacgctttccaggggattgccctggcgcacgcaggacggcaaaccttgcattaccgcaaagaatagcacctggttctacagctagtggatccacaaggggtcccttcacaatggcactccaaccccatgtcccgctgtggcatcaacacccaactcgctttgcagtgatctcttagcaagtgggcaaggacccccttctgatccccatgcgacccacttaccacagcttaaatacccgcacaaaggccttggccagcaaacttggcagcgctccgcgagcccagaaattggcctccccattgcaggcggggggccccacaagtcacgaaaggcatgcctatactccgaggattcccatggtttccaagcacccagagggtacccaaggtgccccacgctgtcatttggcgacagcattggcgcaacctgacagctcacaccccgctatatttgcccccccccatacttggatccccctcgcgcacaacccgattcctaggacccctctggctcctcacacaacgtgcgctgtacatcaaaggcctggaccacaaccaccccaagcggacgcacaccacagcacaactgccctcaaccgggcataacccccaagcgtgttcccacgaatatcacaatagtcccgaacagtccagctttcatggataccttctg

SEQ ID NO: 493754 - DNA, 1250 bp, Homo sapiens
cttccagtaagcggacgctgggtgggtccacggcctcttgtgcctcggtgcactgtgtactattgcactgagactgttgtaaacttcgaagtggtctgggcactggggacgttgtgttgtatgtggttgctcctccctctcgggccctatgggccgtacatggtgtttactcagtgggccaagctaggcctcgcctacggcgttgttcgttcgagtggaaaatgacctcgcctacatgtgtattgacccttcctgcattggtttttgcgtgtacaccattcgttgtaatcatgcccccattggccgtgttgctctttagatcataaagtttcgtaatcgggcgtagaaattctctggggttgtgtccatcacactttgatgttcctcttggccccttgcaaactgctacgtggtaagctcatcgcccattttcgcaattcaactctgtgcacgcattttgtgtgatatttttgtgttttcgtccatgcagtaacgtgacgaaggaacgtttggctatgaacctctaagcaaggcataatgtgagtggcactatgtcttgatcctctggtagaaactcctatgggtacagtgcacttcaaactgactcaggacgaagggggtcatggagttcaaagatccactacgccatcgagagggtatgcgcctgtcattatggacagtcttcttgcctcgcatcggctagttcctgtggtccgttaaggacgtaagacacttggcttcacatggctactggaggaattcaatgtcctggtttggcagtgtgaatcaaaggggctgggcagttacctttcgggagggtcacgcaatgcgctcatgaaccgtgcccatgtgccaggctgcttgtggcttctgtcccgtcagctttctcgtgaatgctgtggaatctgatgagctagtgggcttactctttggggttcttctggtgatagctaagcctgcctggggatgacttcactaccatgttcaacaacaccaaaccgaggccaggtacggtggcccacacctggaatccctagcagctgacgggaggctgaagcaggcagagttgcttgagcataggagttacgagaccagctctggacgacaaagtgagaccttatctctacaaagaaatcataaaaaatatatcgtgggcatggtgctgggcacctacagtcccagctactcggatgaactgaggtggaaaagactcacctgagcctggagaattcgagggtacggtgagtcca

SEQ ID NO: 493755 - DNA, 555 bp, Homo sapiens
  misc_feature (33)..(33): n is a, c, g, or t
  misc_feature (539)..(539): n is a, c, g, or t
  misc_feature (545)..(545): n is a, c, g, or t
  misc_feature (551)..(553): n is a, c, g, or t
gagctcggtacccgagaggtgggaccacgggtntcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccctcttccttttccagccaagggacctacatggggggctgggatctaccccaggggctgagtaaagaaaccaggccaccgtgtaatgcttctgcatctgatcaccttagaccccgacccaaaaccccaaaccactctccatcctccccagcctcgcagactgctggcttctccaagccatctttctgattttctcctctgctcaaccccatgtgccactccttcccctccccattcttccctctctctgtcctcagaacactgcctcatatccttccctggtccctggctctctgagtccctccttttttgttttgttttgttttgacagagcnagaccntgcttnnnca

SEQ ID NO: 493756 - DNA, 1669 bp, Homo sapiens
cgggagaccggggttcgattccccgacggggagcacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgctatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaactcacagaaatgcaagttgagagtagttattacagtccacagaaagtaaaatctaaagaagtattgtgttgggaacaagaaggaactacagttgaggcccttatgatgggagaacctttctttgattgccagattgggtttgttggttgcagagccatgtgccttaaaggaattatgggtgttaaagattttgaagagaatatgaatagaagtgataactgaagcctgtttcttcatttgtggtgacaatttgagtacgaaaggtttcacataccttacaaattcattgtttgattaccggaagcccaaaaattatggaactcgcg

SEQ ID NO: 493757 - DNA, 475 bp, Homo sapiens
gtcaaatccaggcagtctgacttagaaactctcattctgcatttctaattttcctttgtgtgggggctcaggttctagataggatgttcagaaatggactaatatagctgaggggcaagaattactcttggcaggcagggatctccttggttctgacaactttagcattctgatccataggtcagtagacattaaactctatcaataatgacagtgtgactgttccattggataagcgccccagaaatgtggaactccttcataacagaagctgcctaaaaatagtttaatatagcaggacaaaaaaagaataacaatattgaaattggaaagaataattgattctgcctccttcccagtgcaggatttttctagatatctctaacagacagtcacttggtctcttcttgaactaaactcccctgcagttacttcaactgcttattagagaagaattttctgactaccttcttgg

SEQ ID NO: 493758 - DNA, 565 bp, Homo sapiens
  misc_feature (59)..(59): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (69)..(71): n is a, c, g, or t
  misc_feature (75)..(75): n is a, c, g, or t
  misc_feature (86)..(86): n is a, c, g, or t
  misc_feature (326)..(326): n is a, c, g, or t
  misc_feature (521)..(521): n is a, c, g, or t
tttttcgggtgccctttccacatcaaccacaaacgccatcgacctcctctgggttcccntnacanangnnncagntcgtccccctngcatcactcgaatcactgtcaaatgctccctgctggggtttcctggagtctctccccaagccagggggcttcctagtgcagcctgaacatctttccaaagcacgacaacctcactgcccacctgaacaacttccttagctgatgcctttctctatcgaggccagggtccacagtgtcaattctaccctctctacaatctctacaagcacactggctcgccatcttggtatttcctggctnggcttcactgctccttccaaatgccctccactcgactttgtgtttgtgttttctgtctgggtgtcccgcacacatgtggctctgaagggaaggacccattccttgaagtcagttcaccccacagcctctgtgatgccttccctcatcttccaacttctgcatgcccgtagctctctagttacatcctgttataangtgacattgggattaggtcatctctcctgattgtgtagaaattg

SEQ ID NO: 493759 - DNA, 176 bp, Homo sapiens
tacgagcgcaggaatagaaaattagaggatctgcaatataggtagagcggataacattttaaagctggagaaggcttttactttgcgatctggggaagtagccaggttgtaagggagaggatgttgaatttcaagtgcaatgtgggaatagcaactagaagctggcgtcgtaagag

SEQ ID NO: 493760 - DNA, 142 bp, Homo sapiens
tcagcagcaacttcgtcctctcaggatttctcggtactcgcggcgagtgtggtgcacacgccgaaagctcctaataccgacgcgagtccgatagatcacatggacgaagttgttgcagatcgttgtggacgaagttgttgga

SEQ ID NO: 493761 - DNA, 124 bp, Homo sapiens
gttcaagtctgaccgaagatttggaaaagtcccaatggaactatccggaacatcctgggggggactgtcttccgggagcccatcatctgcaaaaatatcccagctgcctagtcccttgagtgtg

SEQ ID NO: 493762 - DNA, 474 bp, Homo sapiens
taaatacatctgcaggaaaaagtcttagcttattaaagctactctataaaattagaagtgattattagaggaggtgcacagatatcactttagggacacacaaaaaaatctgaaaaagaaaggaaacatgatacctcaaaggaacatagtaattctcccataacacaccccaaataaaaagaaatttataaaagacctgaaagggaattcaaaataatgattgtaaggaaactcagtgaagcgcagagaacacaagtagacaatataaagaaatcaggaaaacaattgattagaatgagaaattcaacaaagagatagatataaaaaaagagccaaatagaaattcttgaatcaaataattcaataaaggaaataaaaaatataatcaagaccttcatcagtagactagacaaggacaagaaataatttctgagtttgaagataggtttcttgaaataacccagacaaaccaaa

SEQ ID NO: 493763 - DNA, 1507 bp, Homo sapiens
  misc_feature (59)..(59): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (69)..(71): n is a, c, g, or t
  misc_feature (75)..(75): n is a, c, g, or t
  misc_feature (86)..(86): n is a, c, g, or t
  misc_feature (326)..(326): n is a, c, g, or t
  misc_feature (1491)..(1491): n is a, c, g, or t
  misc_feature (1497)..(1497): n is a, c, g, or t
  misc_feature (1503)..(1505): n is a, c, g, or t
tttttcgggtgccctttccacatcaaccacaaacgccatcgacctcctctgggttcccntnacanangnnncagntcgtccccctngcatcactcgaatcactgtcaaatgctccctgctggggtttcctggagtctctccccaagccagggggcttcctagtgcagcctgaacatctttccaaagcacgacaacctcactgcccacctgaacaacttccttagctgatgcctttctctatcgaggccagggtccacagtgtcaattctaccctctctacaatctctacaagcacactggctcgccatcttggtatttcctggctnggcttcactgctccttccaaatgccctccactcgactttgtgtttgtgttttctgtctgggtgtcccgcacacatgtggctctgaagggaaggacccattccttgaagtcagttcaccccacagcctctgtgatgccttccctcatcttccaacttctgcatgcccgtagctctctagttacatcctggacactgggattaggtcatctgccttgattactcccagtcccattagactagatgcctgtagaaggcagggtcctggcaaaatatcaatgtattcaatttcttttatttttttgagacagacttgccctgtcccccaagctggagtgcagtggtgagatcatagctcaccgcagcctcaaagtcctgagttcaagcaatcctcttgcctcagcctcccaacgtgctagcatctcaggcgtgagccactgcacctggcccgaaaccaagctttctcatcccaagcgccaacctttatcaagtctagcctagtcctctatcgtctcctaagtgtccctcatgagtgatcacttctgagtcctcctgcgtggagagctcagccactgggggcgtatctttcccattggaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccctcttccttttccagccaagggacctacatggggggctgggatctaccccaggggctgagtaaagaaaccaggccaccgtgtaatgcttctgcatctgatcaccttagaccccgacccaaaaccccaaaccactctccatcctccccagcctcgcagactgctggcttctccaagccatctttctgattttctcctctgctcaaccccatgtgccactccttcccctccccattcttccctctctctgtcctcagaacactgcctcatatccttccctggtccctggctctctgagtccctccttttttgttttgttttgttttgacagagcnagaccntgcttnnnca

SEQ ID NO: 493764 - DNA, 183 bp, Homo sapiens
  misc_feature (72)..(72): n is a, c, g, or t
gaccgagtaatctgtctggtcataagtataggtagtcaagagtgattgcatactctcccggcctcacacccntggggtaaagtttgtttctgtgtgtaagcacacacacacacacacacacacacacacacacacacacacacacacagtgtgaggactaacatgtgcgctccgagacaggga

SEQ ID NO: 493765 - DNA, 1785 bp, Homo sapiens
  misc_feature (227)..(227): n is a, c, g, or t
gctgagaacaggtccttgttagatgctgaatccacagggtgacacactttctggccggacgagtcatgactccgacgccaggtgaacatctgtggtgtgcagtgcctaggcaacatgtggcctctcgagacccaagtaacaacgctcactaattgtcctacgtgtctcttaaggtagtctatcactctatatatccttgtgctcgtgcgagcctgctcacatgaganatgattgatgcatgatgcttgcagggctcgtactcacagacctcgtgcgaccgtagacccatgggcatgccgacgccgtagaagacgacagcatggattgcacatggtggcatgcaaaagcatgtgtactcagccttgcttccctttccggtcgtctcgtatccgatcacaccacaacggctgctttacgaaccgacgcgagcagtgaagacaagtccgtaagcagacgccacttggagaaccatggcctctcgcatacatccaacccacgcatggcgaacaaacattccatggccattctcctcccgactctcttcccttggagacatcaggggctggatcccaggcccaaatcgtctggccaccacacaccggtcctggctccgttagcgcgagaacttctggggaccgtacccgaccataaccctctgcatctgcccaaatgcaatgcgacaaaacgcccccaacattccctacgtacaacttccaacaccgcgcgagctacaccacacaaccagcacgcattccctatgggagcccaatatggcgcaatccgatggcacaccgaacccggtgacctcaatacccatctccattatccaccccaccatactgcccacgcaacaaaacgaggctccaacagcggcgcgcccatacacactcagggagccctaggacctccccacatccctgggaacgctatcacgaccgacgcccttggaccgacgcggcaccacactagatgcggcgcgatcgacagtggaccgcaacccccaaacacaaggaccattggcgctccccactagaaccttcgcacatacgcgactggcaaaggagccccacaacgcagaaaaagccagacacgcaacgcacccacccgggccaaacaaacgtccggggcacgcagaaccttccggcgaccagaccacgacttcctccgccgcaaccccaccgccacccgacccctgcaccggagcccgcacgccccacccccaaccgcacacacgctaccccacccaacccaccccacgccccacccgctccgacaccacccacacgcgcgcaccgtcacccacaaccccgcacagcctccacactgccacccggagcacccatagcgcaacaggacacgccacagtaacaaacgaagacagcaaaggacgcagacgacggcacgaaccaatccagcacgcggcaccccggacacccgacaggcccaccaagctcccacaagacgaggaatccacacgagaaaggagcgcagccggagcgcaccaacagaactagcgtagcagaccgcagccgtcccgcgccagcagcagaatgagcgagaagaacagcagcgacggggccgcagcaggcggaggacgacacacaacaggaggtggacacatcaaaatcgatggaggccaaccacacgccgctggcgtccaaccagctgatgcccaacgcagaacgagcagcaaacaaggctcgtgcgcgaaccaacaggcggtgcagcagcccacagcgcgacacacaaacagacacgcgcccacaacaggcgagaccacagcat

SEQ ID NO: 493766 - DNA, 1134 bp, Homo sapiens
  misc_feature (98)..(99): n is a, c, g, or t
  misc_feature (102)..(103): n is a, c, g, or t
  misc_feature (105)..(105): n is a, c, g, or t
  misc_feature (109)..(109): n is a, c, g, or t
  misc_feature (115)..(115): n is a, c, g, or t
  misc_feature (128)..(128): n is a, c, g, or t
  misc_feature (134)..(134): n is a, c, g, or t
  misc_feature (136)..(136): n is a, c, g, or t
  misc_feature (138)..(138): n is a, c, g, or t
  misc_feature (143)..(143): n is a, c, g, or t
  misc_feature (152)..(152): n is a, c, g, or t
  misc_feature (163)..(163): n is a, c, g, or t
  misc_feature (173)..(173): n is a, c, g, or t
  misc_feature (186)..(186): n is a, c, g, or t
  misc_feature (199)..(199): n is a, c, g, or t
  misc_feature (212)..(212): n is a, c, g, or t
  misc_feature (215)..(215): n is a, c, g, or t
  misc_feature (219)..(219): n is a, c, g, or t
  misc_feature (228)..(230): n is a, c, g, or t
  misc_feature (233)..(235): n is a, c, g, or t
  misc_feature (237)..(237): n is a, c, g, or t
  misc_feature (242)..(242): n is a, c, g, or t
  misc_feature (244)..(244): n is a, c, g, or t
  misc_feature (1118)..(1118): n is a, c, g, or t
  misc_feature (1124)..(1124): n is a, c, g, or t
  misc_feature (1130)..(1132): n is a, c, g, or t
gcaatgccatgatatcagctcactgccacctctgcctcgtgggttcaagcgattatcctgtctcagcctcctgagtgcctgggatacacaggcatgcnnggnnantttntgtatngttagtataaatnaggttncncnatatnggtctggtnggtctcgaacnactgacctcnagtgatccacccntctcagcctcccnaagtaatgggatnacnggcntgagctacnnnccnnngncttcntntttctttggacacagggttttgctctgtcacccaggctggagtgcagtggtgcagtcatagctcactgcagcctcaaagtcctgagttcaagcaatcctcttgcctcagcctcccaacgtgctagcatctcaggcgtgagccactgcacctggcccgaaaccaagctttctcatcccaagcgccaacctttatcaagtctagcctagtcctctatcgtctcctaagtgtccctcatgagtgatcacttctgagtcctcctgcgtggagagctcagccactgggggcgtatctttcccattggaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccctcttccttttccagccaagggacctacatggggggctgggatctaccccaggggctgagtaaagaaaccaggccaccgtgtaatgcttctgcatctgatcaccttagaccccgacccaaaaccccaaaccactctccatcctccccagcctcgcagactgctggcttctccaagccatctttctgattttctcctctgctcaaccccatgtgccactccttcccctccccattcttccctctctctgtcctcagaacactgcctcatatccttccctggtccctggctctctgagtccctccttttttgttttgttttgttttgacagagcnagaccntgcttnnnca

SEQ ID NO: 493767 - DNA, 994 bp, Homo sapiens
tgactacctcaagtttctgtgcaccgtgctgctgaaaagatcgtcacatggagtctctgtggcaacagaatcgtggcccaaacagtagagggcacccacaaaaggggtcgcgccgtgtttcctcgccctgtgatgttctccagacgatttttaaatctcgccgctgttgttttacacgccgcgagcttcttttcgggagagggcaaagagagttttcgggaccgcgatttgcctctccccgcgaacgcatgagctgtgcgctctctgggataccatggcgaacaagccgcctggttggcggcctctggaaaattctggctctgttcgcccaaactcagaaacttgaggggtactgcagagctcttaaaatgctgtcttgtgcaccaaccaccactctgcggaaaattgggttgtggcccccgcccactgttggtgcaaaacgttggcgaacgagacaatgcgtcgtcgccccggggattgcctcatataatgttacaaaaaaagtggagtagaggagcccccttttacaaacaatcaagggcggcgtgcaaatacataatacaatcgagcgcacatatcctcttagagagactggctgacttgttacaagagatgctgttaaacaccaacagcactgttgtttgcggagcaccaccacagagccgtaaaaatttgtttcattgtgaaaaagaggtgcatcaggcgcggtggtgtcccgagaaaatagagatcagatctttttggtccgccggggagatggtttcaatactcttatatttataagcgcggctaataaagatttttgaggaaatatacaacaagagatgactagacgcgctccacaatcacaagtataataaaccaagtgggggcacactctcaccacagaacttagaacgatacttaaattttgacacactaaggggaagacaggacaagctcgtgttaaaaggagcgtgtgttttaaaaaattttttaaacaccccacaaaaca

SEQ ID NO: 493768 - DNA, 1506 bp, Homo sapiens
  misc_feature (59)..(59): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (69)..(71): n is a, c, g, or t
  misc_feature (75)..(75): n is a, c, g, or t
  misc_feature (86)..(86): n is a, c, g, or t
  misc_feature (326)..(326): n is a, c, g, or t
  misc_feature (1490)..(1490): n is a, c, g, or t
  misc_feature (1496)..(1496): n is a, c, g, or t
  misc_feature (1502)..(1504): n is a, c, g, or t
tttttcgggtgccctttccacatcaaccacaaacgccatcgacctcctctgggttcccntnacanangnnncagntcgtccccctngcatcactcgaatcactgtcaaatgctccctgctggggtttcctggagtctctccccaagccagggggcttcctagtgcagcctgaacatctttccaaagcacgacaacctcactgcccacctgaacaacttccttagctgatgcctttctctatcgaggccagggtccacagtgtcaattctaccctctctacaatctctacaagcacactggctcgccatcttggtatttcctggctnggcttcactgctccttccaaatgccctccactcgactttgtgtttgtgttttctgtctgggtgtcccgcacacatgtggctctgaagggaaggacccattccttgaagtcagttcaccccacagcctctgtgatgccttccctcatcttccaacttctgcatgcccgtagctctctagttacatcctggacactgggattaggtcatctgccttgattactcccagtcccattagactagatgcctgtagaaggcagggtcctggcaaaatatcaatgtattcaatttcttttatttttttgagacagacttgccctgtcccccaagctggagtgcagtggtgagatcatagctcaccgcagcctcaaagtcctgagttcaagcaatcctcttgcctcagcctcccaacgtgctagcatctcaggcgtgagccactgcacctggcccgaaaccaagctttctcatcccaagcgccaacctttatcaagtctagcctagtcctctatcgtctcctaagtgtccctcatgagtgatcacttcacattcctcccacatggagagctcacccactggggcctatttttcccattggaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccctcttccttttccagccaagggacctacatggggggctgggatctaccccaggggctgagtaaagaaaccaggccaccgtgtaatgcttctgcatctgatcaccttagaccccgacccaaaaccccaaaccactctccatcctccccagcctcgcagactgctggcttctccaagccatctttctgattttctcctctgctcaaccccatgtgccactccttcccctccccattcttccctctctctgtcctcagaacactgcctcatatccttccctggtccctggctctctgagtccctccttttttgttttgttttgttttgacagagcnagaccntgcttnnnca

SEQ ID NO: 493769 - DNA, 119 bp, Homo sapiens
tagaggatccgaatcgtgctggtgcttgaagcagagccagctagccctgagcgggactacagcccctactacaagaccattgaagagctccgggacaagatcctgaccgccaattccct

SEQ ID NO: 493770 - DNA, 410 bp, Homo sapiens
tatgtaaggaaaccataacacagattgctgagtgccttctacaaagtgccaagattaattgcagagccaagactagatttctaatccagtgctctttattttgtgaactgtcttctatataagcatcggtgtttgggttggaggttttctgcttcttaggtacaagaggaagaagaatctgtacagaaccaaaaacatcttaatttttgtaatcaggatgtctacctttactgacaacatttactgacaacatttccttctgaaaataggttattgaaagatcaaggatctttgccagtgaaatccttaactggaagtgggtgggtacaagatagaaaactcatttggtataacaattttgttgttttttagtggaaccttgcttctctgttctgacatttccatgtctc

SEQ ID NO: 493771 - DNA, 1487 bp, Homo sapiens
  misc_feature (59)..(59): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (69)..(71): n is a, c, g, or t
  misc_feature (75)..(75): n is a, c, g, or t
  misc_feature (86)..(86): n is a, c, g, or t
  misc_feature (326)..(326): n is a, c, g, or t
tttttcgggtgccctttccacatcaaccacaaacgccatcgacctcctctgggttcccntnacanangnnncagntcgtccccctngcatcactcgaatcactgtcaaatgctccctgctggggtttcctggagtctctccccaagccagggggcttcctagtgcagcctgaacatctttccaaagcacgacaacctcactgcccacctgaacaacttccttagctgatgcctttctctatcgaggccagggtccacagtgtcaattctaccctctctacaatctctacaagcacactggctcgccatcttggtatttcctggctnggcttcactgctccttccaaatgccctccactcgactttgtgtttgtgttttctgtctgggtgtcccgcacacatgtggctctgaagggaaggacccattccttgaagtcagttcaccccacagcctctgtgatgccttccctcatcttccaacttctgcatgcccgtagctctctagttacatcctggacactgggattaggtcatctgccttgattactcccagtcccattagactagatgcctgtagaaggcagggtcctggcaaaatatcaatgtattcaatttcttttatttttttgagacagacttgccctgtcccccaagctggagtgcagtggtgagatcatagctcaccgcagcctcaaagtcctgagttcaagcaatcctcttgcctcagcctcccaacgtgctagcatctcaggcgtgagccactgcacctggcccgaaaccaagctttctcatcccaagcgccaacctttatcaagtctagcctagtcctctatcgtctcctaagtgtccctcatgagtgatcacttcacattcctcccacatggagagctcacccactggggcctatttttcccattggaaaagtgtggttattggaagtttcctctttttagaaagaacaggattggaggtgctctctggggtgtcctcctaccaagcagcctgttgaaggcctcgtggtgctcagggagcacgagcgacactcgccgtcgcttcagcttcatcttgaggccacacagcatctccgccacccagatctcctcaggctcaggggcgagcaccttccgtggctcctcctccaacgactcctcagattcgtcccaccactccatcttccttttccagcaaaaggacctatgcggggggctgggatctaccccaggggctgagtaaagaaaccaggccaccgtgtaatgcttctgcatctgatcaccttagaccccgacccaaaaccccaaaccactctccatcctccccagcctcgcagactgctggcttctccaagccatctttccttctgtctgtctcctctgctgagctccatgtgccgctccttctcctccccattctcccgtttctctgtcctcagaacacttcctcatatccttccctggtcctgcctgagatgggatcctcagaacaccatca

SEQ ID NO: 493772 - DNA, 1501 bp, Homo sapiens
  misc_feature (59)..(59): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (69)..(71): n is a, c, g, or t
  misc_feature (75)..(75): n is a, c, g, or t
  misc_feature (86)..(86): n is a, c, g, or t
  misc_feature (326)..(326): n is a, c, g, or t
  misc_feature (1485)..(1485): n is a, c, g, or t
  misc_feature (1491)..(1491): n is a, c, g, or t
  misc_feature (1497)..(1499): n is a, c, g, or t
tttttcgggtgccctttccacatcaaccacaaacgccatcgacctcctctgggttcccntnacanangnnncagntcgtccccctngcatcactcgaatcactgtcaaatgctccctgctggggtttcctggagtctctccccaagccagggggcttcctagtgcagcctgaacatctttccaaagcacgacaacctcactgcccacctgaacaacttccttagctgatgcctttctctatcgaggccagggtccacagtgtcaattctaccctctctacaatctctacaagcacactggctcgccatcttggtatttcctggctnggcttcactgctccttccaaatgccctccactcgactttgtgtttgtgttttctgtctgggtgtcccgcacacatgtggctctgaagggaaggacccattccttgaagtcagttcaccccacagcctctgtgatgccttccctcatcttccaacttctgcatgcccgtagctctctagttacatcctggacactgggattaggtcatctgccttgattactcccagtcccattagactagatgcctgtagaaggcagggtcctggcaaaatatcaatgtattcaatttcttttatttttttgagacagacttgccctgtcccccaagctggagtgcagtggtgagatcatagctcaccgcagcctcaaagtcctgagttcaagcaatcctcttgcctcagcctcccaacgtgctagcatctcaggcgtgagccactgcacctggcccgaaaccaagctttctcatcccaagcgccaacctttatcaagtctagcctagtcctctatcgtctcctaagtgtccctcatgagtgatcacttcacattcctcccacatggagagctcacccactggggcctatttttcccattggaaaagtgtggttattggaagtttcctctttttagaaagaacaggattggaggtgctctctggggtgtcctcctaccaagcagcctgttgaaggcctcgtggtgctcagggagcacgagcgacactcgccgtcgcttcagcttcatcttgaggccacacagcatctacccaggtctcctcaggctcaggggcgagctccttctccggctcctcctcagattcatctgaccactccctcttccttttccagccaagggacctacatggggggctgggatctaccccaggggctgagtaaagaaaccaggccaccgtgtaatgcttctgcatctgatcaccttagaccccgacccaaaaccccaaaccactctccatcctccccagcctcgcagactgctggcttctccaagccatctttctgattttctcctctgctcaaccccatgtgccactccttcccctccccattcttccctctctctgtcctcagaacactgcctcatatccttccctggtccctggctctctgagtccctccttttttgttttgttttgttttgacagagcnagaccntgcttnnnca

SEQ ID NO: 493773 - DNA, 1342 bp, Homo sapiens
  misc_feature (59)..(59): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (69)..(71): n is a, c, g, or t
  misc_feature (75)..(75): n is a, c, g, or t
  misc_feature (86)..(86): n is a, c, g, or t
  misc_feature (326)..(326): n is a, c, g, or t
  misc_feature (1099)..(1099): n is a, c, g, or t
tttttcgggtgccctttccacatcaaccacaaacgccatcgacctcctctgggttcccntnacanangnnncagntcgtccccctngcatcactcgaatcactgtcaaatgctccctgctggggtttcctggagtctctccccaagccagggggcttcctagtgcagcctgaacatctttccaaagcacgacaacctcactgcccacctgaacaacttccttagctgatgcctttctctatcgaggccagggtccacagtgtcaattctaccctctctacaatctctacaagcacactggctcgccatcttggtatttcctggctnggcttcactgctccttccaaatgccctccactcgactttgtgtttgtgttttctgtctgggtgtcccgcacacatgtggctctgaagggaaggacccattccttgaagtcagttcaccccacagcctctgtgatgccttccctcatcttccaacttctgcatgcccgtagctctctagttacatcctggacactgggattaggtcatctgccttgattactcccagtcccattagactagatgcctgtagaaggcagggtcctggcaaaatatcaatgtattcaatttcttttatttttttgagacagacttgccctgtcccccaagctggagtgcagtggtgagatcatagctcaccgcagcctcaaagtcctgagttcaagcaatcctcttgcctcagcctcccaacgtgctagcatctcaggcgtgagccactgcacctggcccgaaaccaagctttctcatcccaagcgccaacctttatcaagtctagcctagtcctctatcgtctcctaagtgtccctcatgagtgatcacttctgagtcctcctgcgtggagagctcagccactgggggcgtatctttcccattggaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggagncggtggttgtagtgagctaggatcatgccattgcagtccagcctggacagcaaagctagactccatctcaaaaaaaaaagaaaagaaaaagtaaaaaatttaaaaattagatgggcatggtgacatgtgcctgtaatcccaggtactaaggaagctgaggtaggaggatgacttgagcctaggagttcgaggctgcagtgagctctgatcgcaccactgcactccagcctgagtgacacagca

SEQ ID NO: 493774 - DNA, 439 bp, Homo sapiens
  misc_feature (423)..(423): n is a, c, g, or t
  misc_feature (429)..(429): n is a, c, g, or t
  misc_feature (435)..(437): n is a, c, g, or t
ggtgtggtgatctagaggatccatctcaggcaggacgagcacttccgtggctcctcctccaacgactcctcagattcgtcccaccactccatcttccttttccagcaaaaggacctatgcggggggctgggatctaccccaggggctgagtaaagaaaccaggccaccgtgtaatgcttctgcatctgatcaccttagaccccgacccaaaaccccaaaccactctccatcctccccagcctcgcagactgctggcttctccaagccatctttctgattttctcctctgctcaaccccatgtgccactccttcccctccccattcttccctctctctgtcctcagaacactgcctcatatccttccctggtccctggctctctgagtccctccttttttgttttgttttgttttgacagagcnagaccntgcttnnnca

SEQ ID NO: 493775 - DNA, 107 bp, Homo sapiens
tatgaaagagaaaattttttgccccacgtggtttttatgatttttttttgtatgggagtatcacaccggttggtttgtatacaaattccttttttgccctttatttt

SEQ ID NO: 493776 - DNA, 243 bp, Homo sapiens
ggggggtgcccccccccccccccccgggggtttttttgggggggggggggtttttttttgggggccccccggccccccccccgccctttgggaaggggggcctcccccggttttttgccccccggggggttttttcccccccccccccgaaggggaattggggggcttttttttttttttgggggccccggggggtttttttttccgggggggtttttttgggggaaaaaattttttttttta

SEQ ID NO: 493777 - DNA, 874 bp, Homo sapiens
  misc_feature (20)..(20): n is a, c, g, or t
  misc_feature (22)..(22): n is a, c, g, or t
  misc_feature (27)..(27): n is a, c, g, or t
  misc_feature (177)..(177): n is a, c, g, or t
  misc_feature (226)..(226): n is a, c, g, or t
  misc_feature (337)..(337): n is a, c, g, or t
  misc_feature (349)..(349): n is a, c, g, or t
tttgtttcttggattggggngngggtnctggccaagaactcagtcatttttctgtgtaccaggttgcctaaatcatgtgcagatggttctaaaaaaaaaaaaaaaaaaaaaaaagaggaaaaaaaaaaaaaaaaaaaaacggtgtgcttttggtttaaggggccagaaaccttggtncgtggtgacagttttagcaccgtgccctcagttaaaggggtttaatttngtggtttaacccttagaacgttgccaaccaaagagtttttacccacagttctgccacttggcagaaagaagagaaaaaatttcaaaccccacatgtgttttattttttttntgggcctacccncattgggtctctaaaagtgccatctgtggaagagaggggtgacatttctaacgcatctagaaatatgtgttttttgtggggggaaagaaaacacccctttttaaggtgtctttctacctgtttataaacctcttatagatttccccgaaacaaagcgaccaccagatatttgtgacaacgtcttgggcaacattttcctatattgtggcgcgcccagaagtttcgacgccggggggccccaaaagaaaaatgcttgtgcccccctgtgatagagacaggttggggcaaaatattagcgccttataaaaggggcggtagtaagtcgccaggttgtaacactctttaccagaggtttttaagagaaccccaaaagaatgtcgtcctcttggctttttttcacccaagaaatttctcccccccattttaagaggggtgtggagagtgggcgcaccaactggtggaggcccccgtttgaaccccagaggacgtcccctgtggggctcccagagttgtaaaagggggtta

SEQ ID NO: 493778 - DNA, 1005 bp, Homo sapiens
  misc_feature (787)..(788): n is a, c, g, or t
gaaatcgttgcctatgacattgatgagccaaggatctgactactcactcggtgaactgctgtgtgtctgtgccaacctctgtactgatgtccaattgcaatgtagtgatggtcactatagagtgatctaatgcgtcgtgcatcgaaatgatagactatagtcacctcgatggtcattgtacatgtgctcaatagctcggccgagaccgaaggaccatagaagcccgtgagtctccgacgatacgaggcatcttccgttgaccttgagtgcaccctgaaggaaacctgtgagggctttgatcgagtagtccgttgttctagcacgatgagtactcgatcaagcactatgcacgacgtgagtgatgcgacctcagggcttccacttttgagagaatccatgcaaagcttagaaagaccttgttgcgagaacaggttcgcagccaacggagatcccaggatatcgatgcagctcacgcagagttagacacgcttgagagcttcaatcacacatgactactacgtgactctcttgtgggcactttactaacttctgtgtccagaacggctctacaagcactccttccaattaaaacgtctctatcgtggaaagcgaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttggtgatccaggtttgatgctcatgggtttcnncatgccgattggtgactcgtaaaagaagagcaccattaaccttgaaggccctcccctgatacgatgtaccccagaatggaagttcggtgggttaatatgcggaagcttcaagcccttgttacagttgcgtctggttcattccatgtgttctcggaaaacggacagttacagcaattgtagcaagatacaacacccccgtaggaagcattccttcata

SEQ ID NO: 493779 - DNA, 862 bp, Homo sapiens
atcagtttatttatattatttttaataaacatgattttatgttatagtgctgtataatatagacaagtctcattataatatagaataaagggattcaatttctgctaagaatattaaaaatactttctaaattaagtgcacccaatacctagtgcatcccagtagattagaaagcaaaagattctaataggaatatagatagatttctaaatacctagtaattagcgtggggactttcaacacccccatctctcagcactggaccagatcatctagacagaaattcatcacagataacattggatctaactacactttagcaccgtatagacctaatagacatttacagaacttttcatctaatagctgcagaacatacattcttctcatcagcacaggaaagattctcccaggatagatcatatcttaggccacaaaacaaattttaagaaatggaaatcatatcaagtatcttctcagacccacaatggaataaaactagaaatcaataacaagtgaaatttggaaattgtacaaatacatggaaattaaacaatatactcctgaatgaccactgggtcaatgaagaaattaagaaggaaataaaaaaattcttgaaacaaatgaaaaggggaacacaacataccaaaacctgtgggatacagcaaaagcagtgctaagagggatgtttataacagtaaacacttacatcaaaaaagtaggaagatttcaaataaacagccaaatgatatatctcaaggaattagaaaagtcaagaacaaatcaaagccaaaattagtagaaggaaataaatatcagtgcagaattaaaggaataaagataaccacaggacaagaccatg

SEQ ID NO: 493780 - DNA, 153 bp, Homo sapiens
ctacggaccctacatggctggctgcacatggcctcgcttttagcctatttgttttcaacatgcttttttcactaagcttaatcctttctagcttttaatttaaggtgaaagatgtgtgactcttccttctacttcaacactgtggaaactatt

SEQ ID NO: 493781 - DNA, 314 bp, Homo sapiens
cattaggctcacctgtgggaatcaaaagtgttagcttgcttcacggaacacttgcagcacttgtccaactggtccccaccgaacctctcattcttgattcagaggcactgctcccagcatccaaagcagcagtccagcatttggccattttgtttgggctgtgcatccagtgtcacacgcatcttttccactcattgcagtcccatgtgtccccagcaccagccagtgtgccccacccaaagtccaattgtagcaaagtcttgtcatcagctcatctctgccaccactccattgcagtgccagtccacttcttg

SEQ ID NO: 493782 - DNA, 808 bp, Homo sapiens
  misc_feature (100)..(100): n is a, c, g, or t
  misc_feature (325)..(325): n is a, c, g, or t
  misc_feature (590)..(591): n is a, c, g, or t
aaagactaggctaggtacgaggcgggtggaatcggccgaggcgagatacagggcatctttccctttgaaactttggaattgccacccttggaaaggaaanaccctgggggctttgacatatccttgttctacagagatatcatcagcatagcagaggatgaggactcaggttcactttgaggaatccagcagctagaagacctgttgcggaaggttcgcgcaaggagaccaggaagcgagcactcagcaggttaaagctgaagctcaacaaagatatagtgatctctgtgggcatttataatctggtccagaaggctctcaaggncccttccccttccccccaaaaaatttaaaaaaaaaggggcccttttcccttaaaatttcccgggggggcgggaaaaaaaaaccccaaaaaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttggtgatccaggtttgatgctcatgggtttcnncatgccgattggtgactcgtaaaagaagagcaccattaaccttgaaggccctcccctgatacgatgtaccccagaatggaagttcggtgggttaatatgcggaagcttcaagcccttgttacagttgcgtctggttcattccatgtgttctcggaaaacggacagttacagcaattgtagcaagatacaacacccccgtaggaagcattccttcata

SEQ ID NO: 493783 - DNA, 301 bp, Homo sapiens
tgctaacaaagacttttttttatactttttaatattatgctacagaagatttttctagacccagagcagtggctcacacctgtaatcccagcacttgggaggccgaggcaggcagatcacttgaggtcggcagttcgagaccagcctggctaatgtggtgaaaccccaactctactaaaagcacaaaaaattagccgggtgtgttggtgcatgcctgtaatcccagctactcaggaggctgaggcagaagaattgtttgaacccagaaggcagaggttacagtgagctgagatcacaccac

SEQ ID NO: 493784 - DNA, 253 bp, Homo sapiens
cgagcttggttctttccgtatggtagcttggttctttccgtatgacaaaaactagcccccatctcaatcatataccaaatctctccatcactaagcgcatgctactatctcactctctagcaacggaaccaagctaccggctacgcgagctcgaacacggacttaggggcatagcggtgtcctgaggcagaacgagggcctgtgactaggctgactgccgcctactgagcttcaacggctacatagttccctg

SEQ ID NO: 493785 - DNA, 999 bp, Homo sapiens
  misc_feature (425)..(425): n is a, c, g, or t
gccctcctggtcccctgcctctactgcctggcgcctgcggttcctcctggccccaatggcacctgctgcatggcgcctgctggtccctcgctgaccgctgtggcacctgctgcctgaccccttgctggcctgtgggccatgccctgtgtcactagtggccatgccctggtatgggcatcctacatgacagctgcagcctggcccctgtggtcgctgctagcccatgtgccagctggtaccatgcccccgcgtgcactcctcaccctccgagcactgccgactggcccgccatgcttcctcccatgtgacatgtgcttgcctgccccctggtgggccttcctatgcccctgtgtcatgtactgtgccatgcccctgaatggtccctgctagggccagggcccatgcctgccccctgtgcggtcgcntgcattgctgccccatggcatgccccagcgggttacgtcgcgaatgccccatgatgcagccctggcccacgtcactgccttcacctcctgtggccctgggacgtgctgaggcagccagaatggcagctgctcatgggccctggagcagcccttgaccaacccaatggcggctgctcataggtgcccatgatgcatgccctgcccagccccttgcatggctgatcatgggccccaacaatgcccgtgaaaaaccccagacctggttgatccccattcccgaatcgcccttcaatcctggggcatgcagggcccgacctgtctggactctcctgggcgccgttgcagccaaactgctggtgagccctattgatctggtgcgcgcccgtcagccccggtctcgtcctggcctgggcaatcctgcaggccccttgcgcgtccggtggacctgatctgtgccctgggatggccgtcagggcccatctgttgcgccttggatcttatgcttgcaggcactccccatatgggtttcacgccctccagtgtgattgacctgaaggcccagggcaggcggttc

SEQ ID NO: 493786 - DNA, 383 bp, Homo sapiens
cttttgacaactcagtgtgagtttagctttattggggagggggtgatctaaaacactctttacgccggcacacagaccccaacatcgacacccatcaccaccatcactactgtgaccccaaccccaacacccaccggcacacagaccccaaccacgacacccatcatcaccaccagcatggtgaccccaatcccaagcacccactggcacatcaggccctaacctcaatagtcatcatcaacaccagtatggtgacctcaagccccaacacccatcggcacacagaccccaacaacgacactcatcatcaccaacagcatggtgaccgcagccccaacacgccactcggcacacggaccccgagacctcgaccctttgcatcc

SEQ ID NO: 493787 - DNA, 1124 bp, Homo sapiens
ccgaaaggttagtctcatttagaaaaatcgaaagtgcacagccacttcaacagggcaatcatcatgcaggtttttatttctttccaacacacacacacacactttgcatttcattcattcggtcagtcatcattggtctagcacacatggtagtcagcgccagatttgtttcttcattttcaatggtgtccccaatctttgcaacatcattaaaagtgttatcaccatcttgggtggctaagtggttatgtgggaacacgaacatcgtgattgtgcactttcattatcagattatactataatgtgcaaatttatatttgtggcccgtggcatgggtattagagggtgcatcagagtccttcaagcgcaggccataataatcttcataattatcatggtcatcgtgaggcgtcatacataacgcacgcatcatcatagtcgtggtagtccgtccatagtcaatcaatggtcaacccatactatcacaatcataatcatcgcagtggttatacatctctacacattgtcatcacaaacaacgatccatataatcgaacagtggtctccatcaacatttgtgcacctcatctccatgagggcccacaggctatctcaccatcttccagtcacaatcacaacagccggttaacacatatatacagagagtgacactttacacctgtgggaacccctttaatttccggtgggtcgaacaaacaacgaaactacacatttcacataagtgctccacacaacgcgcaccttatcaaacaggttgtggacatattatattactcagcgacacacatgcgcagacatcacctctatttcgggctgacaacccctaagagaacatgtgggaacacaaaaagtcgcagggaatactacgggacgcaacaaccacacagcgcgtttagagccgcatcccgaacaagacacaaaaaacacacatcggaggctcgataaaacgataacacaaaacaacccatagggcaaactatcaccgcaaaactgggtccccaacggcgagcactaacgcagtagagctacaccaagagcttatgaaaccagtgtacgccgaaggaccacagcaccaaccggacccctaaaaacaagcgcgaaat

SEQ ID NO: 493788 - DNA, 125 bp, Homo sapiens
gctcggtccttctacagcaagacgaacagtctggggttcttctgtgcccccagtggttatgcatggcaccctctctgggccagcacagccttgtgctgggggcatgactagaggaggggattccg

SEQ ID NO: 493789 - DNA, 222 bp, Homo sapiens
ctgaagcactgggctctgtggtttattggcgtctgattcctatggcaccaggagaggctggaaaagtaaagagggtgttgatggagacgatgggtgatagggaagaggcataggcctgacagttcacccaagagcagcagcttggagcacttgcacatggcacacacattgacatacacaaagttgcctagttttcccaagtgcttcaagagtcctcccatg

SEQ ID NO: 493790 - DNA, 958 bp, Homo sapiens
  misc_feature (72)..(72): n is a, c, g, or t
  misc_feature (102)..(102): n is a, c, g, or t
  misc_feature (105)..(105): n is a, c, g, or t
  misc_feature (284)..(284): n is a, c, g, or t
  misc_feature (598)..(598): n is a, c, g, or t
  misc_feature (926)..(926): n is a, c, g, or t
aggtaaaggccgaggggcaaagaaaaggaaagcatctggctctgaaaatgaaggcgatcataaccctggcangaaaacagccagagagcgggcaagaaaccnaanaaaacatcttttgatcaggattcagatgtggacatcttcccctcagacttccctactgagccaccttctctgccacgaaccggtcgggctaggaaagaagtagaatattttgcaaagtctgatgaagaagagggtgaggttgattttgcgatggttaattaagtgcccaaagagcacanacatttttcaacaaatatcttggggtggccttttggcttctctggctcagacttttggacatctggcttattttaatgtgatgatggaattgacgggtttttattattgtggtaggccttttacattgtggtcttacacatacagttgtatggctcttttttactcattgaaatgggacgtactgggctgatggggttcgacaatttgttatgggactgggcggcattagcacagattgttagtggtcatggggacaaactacggaccctggttttgtggatggaagttgaaccatgagagagggggaaaaaanaaacaatggcctcgtttgccctcaacggggggagctttggcggccggttccctttaaggggggggaaatgcaggagccccggttccttgagtccctcggctcggtcgttcgtgtgggggggacggggtccactccatggaagggcgggatccggctgtccgcagatatacgggggtggcgccgagaaggaggtgtgagccaaggggcggcagggggcgggaacgggaaagggcgggtgtgctggggttttcatgagcggcgggccgcgggggaggtcaaaatgtacgctgtaatgcctgggcgcgaggccgcgcggctagaggaaacnggccgcgtccctcggagcgagaggaggtcttg

SEQ ID NO: 493791 - DNA, 1095 bp, Homo sapiens
taaggtaaaatcttttttttccaaaaaaaaaaacaccccaaaaaaccaaagtgtttcccaacccaccacagggagagggagatatggggataggggggagggtgtctggtccatccagcctgtgccccacagcccatgttggtgtttgggcagcaaataaggggtgtatggggtgtattggcgcccaaaaatataaatggggttggtggtgtcgtcatgggcgagaggagaacgcggggtgggacaacagctgtgtgggagagaccccggttagaaggggagacaggggccacagccagagggtccacgaccggggggacaccgccagaagggtgggcgagcgccattcacaaacactattcctcggtggagatcaaaaccacacgcgggtggaaaccccctattctttgtgggggcccaaatcagcagcggaggacactaatgagcggctctgtgtggcaagagctactctggggtgcgacacagagtgtgccacattttgtgagagagggtgggggggggcgcccccccaacacgcggggtgtgacctcctgtagtgtggaatcaccagaaagatactccgcggtgcgtcacaaaatagttctccccccgaaatatgcgtcgtggcgacaagaagagtagttgagagtactcccggcgggaataatacaccgcgcggagagaacagtatatgtgtcgtgggggcccccccccccaagtagttgtgttttcgagcgcaccacataatatcacgcgggggttacaaacagactcgtgtgtgaaagcggcggggatatcattgtgtggggccacaaacacacgggggaggagaccaccccacaagccgctcgtcaaaaggcaggtggggcggcgagcatagatcgctgttttgagcgacacagaaaccaggggtgtattaccccccccgggggaggagaaccagctgggggtgtggcccccccaaaaaaacgcggagagcggtgggcaagaaacatccccctgtgttgatgatacgcccccccacaacgaagaaatgttggcgccacgcgggaggccatccactatgaagcacagaagggtgagcctcccccaggg

SEQ ID NO: 493792 - DNA, 270 bp, Homo sapiens
atttgtagacggggtcatcactctggcacccaggctagagtacagtggcacaataatggctcactataacctacacctcccacattcaagtgatcctccagcctcagcctcccgagttgctgggaccacaagctattcacctatgtttaggttgactcttctgctctctcccttctgctgataagcccgttcagtgaattttttatttctgttcttgtgtttttcagttctagaatttccatttgattgttcttttatgatttgtttctt

SEQ ID NO: 493793 - DNA, 310 bp, Homo sapiens
acagatcatactggagagctgccacaaccagaacattctggagtaccatccatcatccaaatggaaacatcacagagctcctcctgaaggaaggtaacgcacgctgtgtggactggtcgattgcagtatacacccggggcgcagaaaagctgagggcggcagagaggtaagccaaagagcgcagactgagaatatggagagactatatggctcccacagctaatatggaccaaaaggacaaacagtaagacgccaaggtgatgcaggatcagaatgctgatgccatagttgtgaagcagaactcaggcga

SEQ ID NO: 493794 - DNA, 1243 bp, Homo sapiens
gcgtaatctactctaccatctattgcaggcacactcatcacagcgctaagctcgcactgatttattacctgagataggcctagtaaataaacatgctagactttatattacagtgtctacgcgcgaaagagaaataagaccctacgttccacagtaagctgccagtcaagctatttcctcgacacacagcgaagccgcagtccataagtcctgtctaagtagcgtatccgtcttcaacaagtatagctctccggcacaatgaagccataacgcaatactacctaatctaatacgtcatcgagttaataatcataatggcgtatagcaataaaactaggaatagccgccctattcacttctgagtcccagaaggcttaccgcaaggtcaccccgtctgacgatccggacctgcgttcttcatcacatgacaaagaactaggacaccgcatctcgaagtcatatagcacaaatactctcccgtacgactaaagagtcaggccgttctcgcgtcacaaatcgtctagcaagtcgttaatcctagtccatagcaagggcagatatgaggatggaagttgaggacgacgaaaaccctaactacggcacaaagtcgttagcatactcgctcacattacccaacagtcaggatcgccgtcatacggcagggactaaccagtagcaaccccctaagacatagagcccgatgctggaagtgtaaccgtatggataataatgccttaagttaactacccggtattgcagtaacttgactccagctttaaaactcccagaaacccacgaagccggaactacttatcatcggcagccagacaaacaaggctaccatgacgtaaaaccccattaagttcacgtgcacgcatcaaatatgcaataagagggccatgccccgggacaagcgggctgattagcccataaggtgacccgatcggaggaagtacaccaacaacagaaaaggctgaaagtctgcagtaaaatgcatagacacagagacggtcctgtaagtctaatctaccgtgtcctaatgtaagaatgtaagataagattagtccgatgttaaccgttaaacgaaacggaggctgcgaggaaagacagccaagactcccacagatgtacgatccggcgtgcacattccccgttagaactgtgacccaatcgttgtcacacaacaagcggcaatagatgtattgtgggtaagggaaagggataaggacggatgagcgacgtg

SEQ ID NO: 493795 - DNA, 89 bp, Homo sapiens
tttgctggtgcagtacaactaggcttaatagggacatgcaatacactcgtgtaaaaacctggacacgcaccacttgaatctaaaaaaaa

SEQ ID NO: 493796 - DNA, 956 bp, Homo sapiens
cagggggccttcagagttcccgggaacacccttcccagtgcccctccgagcagatgctgacagactcccatgccccctgcatatcactccgctaggcctgctgcttcctcattcgtgtactgcctcactctcaggctggatcgtcagggtacacagaagctggtcactgaaagcagacaagcggcatgcccctggcgactatcagaaccgtcgtatcctctaacacattgtgtggtgtgcttctgacatctaggtctgcatgctgtgcggcggctctggcccaggcctcctggaaggttatctcagagatgtggacagcactcgttggtgcatgagtccaggcactaaatgtgactgctcatgtctgctgtcatgaagcatggcaggagcatcacacaggcctcatatcgatggtgatcctgctcgacatgagttgggtcaaacagccgttgctcatcaagcagatcctagcataccgagggtggcaagcgtcactaagacggccctatcttaccatgggccacaattgcatcactagggaccatgggcccaatgacgccatggttaacataactggggacacgcacggcgtaagttcaccatggaacaaggattaccaaagcacctgggaaagtacccagagcaacacccgtgggaagcatacggggcgagcaaacccaaaaccagaattccacccaattcccaaaggggccgatacactaccccatcgtgcccaaaccaagcgcagcccccgtggacacaccaagggtggccctaggtcggaagaacaccaaggctggcgaccacaggatgccagaggacacgacccgacgggcgaaaaggaccagcgtggaacgggaccgggaagggaactaggcacgcgggggtaacccccccgtcgaggacagacaggccagcaacagcggaacgcgacagatgagcaatagccgcgacaa

SEQ ID NO: 493797 - DNA, 144 bp, Homo sapiens
gttgttggtctggcgtaacacgaactttattgttggagccacttgaaccatttccagaacgcgttctagaatttattgctgttgttttcatcaaatgtgtcaacaatcatatcgtaatggaagcgaccatcataagctggcttt

SEQ ID NO: 493798 - DNA, 326 bp, Homo sapiens
ctgagcgctgtggctcatgcctgtaatcccagcactttgggaggccgatgcaggtggatcataaggtcaagagatcgagaccatcctggataacatggtgaaaccccgtgtctactatacaaacaattagccaggcgtggtgttggcaggtgcctgtagtcccagctaccggggaggctgaggcaggagaatggtgtaaacccgggaggcagagcttgcagtgagctgagattgtgccactgcactccagcctgagtgacagcacgagactccctctcacgactcgagcgcttatgcatgcgcccgcatttcgagctcctggcccc

SEQ ID NO: 493799 - DNA, 462 bp, Homo sapiens
tgtggcgacgggggtctcaaaaaggagagggattagatattacgggacaccatatccgagttataagcaagatatttataactggaactactcaaaaagggaatgggtatatagcatgcagggacgagctttctgccacgggaaatatggcagcagatgggatgacaaccggtctggagttttctgatgagcagccttacagcaggacagaagctggactggctaactctaaagaccttacctgtattaaagtatccatggtcctggccttcaagagctgtaccgttcacttagaggaaaatatccctacacataaaacagagaacaccatagggtggtgagactgcatggaaagaactacaggagatctggacccagggcagtggctcacgcctgtaatcccagcagtgtgggaggccaagctgggcagatcacaaggtcaggagttccagaccaggctga

SEQ ID NO: 493800 - DNA, 890 bp, Homo sapiens
tgtcgcgggcggtttgtggggcattgtgcgtcccgggggtgtggccccgtcgtgtgggggtctctcgcattgcgcgtgtggcgggacaatctcggggttagagggtcacaccccacgggtttgaagtttatcttgggtcgaagggaaagtggtcaacgcgggtgggttggtagcccccttcccgcggggcgaaattgccctccggcgcctgggggtctctccaagtgttaggagagggtgttaccccggggtgcaggttggggaagtctcgggcattccagcacgtccaagtgcacgactggggacccacggtcattcctgggggacgccccagtttttggctctgctgatgcggaacagagacccccgggggggggacggtgcccgccgtatccccccggattcgttgaacagggtggccgcctaagcttcggcccaatgatagaagtcttgtgcccagatctcacttttaactaatgcggctcacacaggtcccaaaaggtattttttccccccggagttctcaccaaaggacactccattccacacgcgtcagcactctctacccgaagtatcttcatccaaacatcttgggtatgtcttgcttaaggctccctaaacaataaagtggtttctcccttaactagccccgcataatcatagacgtctcttgcgccccaattctctagtccgggtgaggcaattctaaacccaatttctggttaacttcaataaacaatatccttctcatagcaaaacatagctttcatggaagtagatgaatatcccagcaaatgtgtcccaatttcaataacagtcttattatacaaaaagaacgcatgggtacgactcaccccaatatgtataaatcaccagcgccttttaatcca

SEQ ID NO: 493801 - DNA, 318 bp, Homo sapiens
  misc_feature (9)..(9): n is a, c, g, or t
tcactgccncgacggctctctttgtggactcagtccacttgcacccagtgaaataaacaaccttgtggctcacacaaagcctgttggtggactctcctcacatggacatacgtaacagttgggagttcaagaccagcctgaccaacatggcgaaaccccgtctactaaaaatacaaaaattagccggacgaggtggcatatacctataatcccatctactcaggagggtgaggcaggagaatcacttgaacccttgaacctgcagccaagatcgtgccactgcactccagcctgggtgaaagagcaagactctgtctc

SEQ ID NO: 493802 - DNA, 330 bp, Homo sapiens
cgagttctgaaatgtgtatgattcggtttcagaactgtatctttggccggggtgcggtggcacacgcctgtaatcccagcgactttgggaggctcgaggcgggcggatcagctgaggtcaggaatttgagaccagcctggccaacatggtgaaacctcatctctactaaaaatacgaaaattagtcgggcgtggtagcaggcgcctgtaattccagctacttgggaggcagaggcaggagaattgcttgaacctgggaggtggagattgcagtgagctgagattgtgccattgcacttcagcctggggaacaagagcaagactttgtctc

SEQ ID NO: 493803 - DNA, 132 bp, Homo sapiens
gtgcctatagtcccaactacttagaggaggatcgcttgatctcaggaggttgaggctgcagtgaattatgattgtggcattgcactccagcctgggtggtagatcaaggctttgtttcatttgaaaaaaaag

SEQ ID NO: 493804 - DNA, 154 bp, Homo sapiens
tgtacttctggtccacgtaaaagcaggaagctagtgcagccaggcaagctcatgctgggtcggaagagctggtcaaagggacttgggtattcactacttacccactgaggtctaaccctggaaatacttaagagttggttgaataccacctttg

SEQ ID NO: 493805 - DNA, 649 bp, Homo sapiens
  misc_feature (49)..(49): n is a, c, g, or t
accctgaggatccccatgccaataacctccctttactcacacatttttntttagtaggtttagcccctttactgagggagattggtgcatcacctctcacactgctggctccctggatctctgtatattttcctcttccatctttcttcctctcaatctactcacccttcctacccaggaagaggcacaaattcctcatcctcagcagagagatttggtggtcctcttttgggaattccccttacacctcaagtatgtcattacgatgaacattgtatttcccggcgggccattctaaccctgtgctgtgaccaaggagccagcttgctccctctgtccctcagccaccctcggcacggtatcagtgccccgcctgctggcttctttgctacaggatagcaatagcacttctcacatcacatgcagacacaacaataattagaggaagagacatctggctttttcttgttttttgcttttttttttgagaaggaaaaaatattttccgagaaatttctcaactcacacctttcaaaggacattggctaatgctgtgtcacatgcctgtgcttaaaccagtcacctgccaggggacaggaccgtgaggattggtttactcagactaaacttggttctttgggcctaaaat

SEQ ID NO: 493806 - DNA, 141 bp, Homo sapiens
ctatcggtgtatcgtgcagggcacccgcagtttgcaggtactgtcactactcagactggtgacagcctctgggacaggccttcgggaaggccctgaggccttgaaaacatctcctgggtcccaggacttgaacggctctgg

SEQ ID NO: 493807 - DNA, 282 bp, Homo sapiens
gtaaatccctacacatttgggaggcccaagagggtggatcacaccgaggtccagaggtccagacccgcctggccaacaacgggaaaccgtggtctctactaaaatacacgcacttaccccgcgtcgtggtggttgggcaccctataatcctagctactcaaggaggctcgatggcacggacgagagctgcttgaaaccccgggggccgaggctgccgtgacccccaaatcataccccttcactccaaccaaccccccctgggtgaaaaaagaaaatctgttc

SEQ ID NO: 493808 - DNA, 344 bp, Homo sapiens
cctctgaattccacacgcatatagaatcctccacgtcctctatggccaccacctctgtaggagggttctagcaaatcttatgttatagcttttcttggagccagtgttctgttacttttctggtggaagagcctttttgctttcttccttatatggctccaagagtttttgggcttcttccttccgaagttcaacataggttattggatcaaagcactcagctacctctgggagggtcacgtttcctttcattttgaggaccgcagtgtactggtaggtctttcccctctacttctgcttatcttcgtgtgtgcttcgcttatagtcttcatcttttgggcaaa

SEQ ID NO: 493809 - DNA, 345 bp, Homo sapiens
ggccctgcttactgggcgtatgcctcccaaagtgctgagattacaggtatgagccactgcacctggcctgtctcttcactttcctgatggtgtcctttgaaggacaccaaatgtttccagttttgatccagtcctgttgatcatgtctcctgttgcttgtgcttctgagtcatgctgtcctcatcctgttgcttttattccttgtgaggcgacataacaagggaacttccacatgtcctctcgcattgtaaatacataaaccatgccttccctgcagcctctgcttcttctctaacgcagaacatctctctagaaacaaagtattccagatttcccatacgccca

SEQ ID NO: 493810 - DNA, 217 bp, Homo sapiens
  misc_feature (83)..(83): n is a, c, g, or t
cgccgtcgagcgctctcccgatcgatgcgaatggcgcgcagctcagtgcgtacgcacgatcgaagcggcgacccggaatctcntcttgtaggcgcgcctgatggtcgccgaaagggcgtgcctgaaagcgcagatagaggcgtcgtagctgacctaggggggccggtgagcgcgaggtcaatctgtgtagtagaatatcaagagacctgctgggacg

SEQ ID NO: 493811 - DNA, 233 bp, Homo sapiens
cccaagggggggggggggggggggtttcccccccggggggggtttttttttttgggggggggccccccccccgggtttttgggggttttttttttggggggggcccccccccgggggggggcccccccttctccgggggggtttttttttggggtttttttttcccccccccccggcgccccccccccccccccgggggggggggggttttttaggggtttttctttttttta

SEQ ID NO: 493812 - DNA, 234 bp, Homo sapiens
acccccgggaacccgggggcctggggggaattttaccccttcccttttttcccccccatttggcccgtaaatggggggtgggggggccccggggcccctttaaatcccttttttttttttttccccccccgttcccccggggggggaaatttttcgggggggcggtttttttcccccgggccctttttgggggggcccccccctgggggcaaattaaaaccccccaaaccccca

SEQ ID NO: 493813 - DNA, 791 bp, Homo sapiens
agcgggtggtcttgacgtgagctatctggcatggcggcctggcattgcagcggggcactggagctgcaagtgggcctaggcctggagtttccaagaccgacaggacgtctgctccctccacgcctggtcgtctgatctgccactgctaaggggtccactgcgggtggccttgatccggcagctagaagcaactgaggccttcctgagtcccggtgctgttccaagccgccggcgaaaccaggtcatcgtggacgaagcaccgacccgttggaaccggaacgcaggttcttgaagtcctgaagttcgagttcctcgaagggggaagaacagatcctctgtaatatttcaaatagaagagaagaagatatgttagaaaggagacaagtactccacattccagagttctatgttggaagtattcattcagtgttactacagctgacccatatgccagtggaaaagatcagccagtttctggggatttgcattcagagatcaggaagaggacttggagctactttcatccttaggaatgttatcgaaggacaaggtgtcgagatttgctttgaactttataatcctcgggtccaggagattcagtttctcctgcttggaacttaggttgaattactggcttgtcagcgcgttatgttctatttagatcaaatgagatacatgatattgaaagaatagagcagcattgtagtttagactatcttaggctttattgctttgaaaagaagattggcctattgtatctcacaattctggtctagattcagttatgaatg

SEQ ID NO: 493814 - DNA, 728 bp, Homo sapiens
taacgtgggtagatatggggagtaggtgcgtgcatggagggtggagtagaattgaggcgtaggtagaaagtcagaaggttaagggaggggtgcagtgggtggctatgaaggggtggggcatgatgaggctatggtttttgggtgaattcttcgaataagggcccaattggggcaaaaagccggatataggtgggggcaggccctcctagggagcaggaggggtggagtggaatataaggggtgtcagctcagtggtaagcctgggttacagggtgcgaaactagtaggtagggctcgggggtgccggaaacaaccaccttgggcccggccggaaagggccgcgccacatgtgggcactcaggctaacgcgcgaaggcgtaccagcccaagtgcccggaagtgcgcagaagaagagggtcaacaagtggcgatgcacggcaacacagtgcagcgactatgcgggcggccggcgaggtggctccagcagagaaatcgcgggcgcacactcctcagcgcacagactgggagcgggacaccggtggtcatcccaccgccgtggatacccgtgacaagggcagcacacgggggacacagggtgtcacaaacacaccagcgaagggcgagaaaccacatacgacgacggaaacaccaaccactcccaacaaaaacacctcgaaagcgccagcaacagagggccccgcacaacgaacagcactcacgtggaccgt

SEQ ID NO: 493815 - DNA, 454 bp, Homo sapiens
  misc_feature (454)..(454): n is a, c, g, or t
gcgggcgctctagagatcccaggtgcttagacctccccaggctttatgtaagaacttgcagaagtactgaggtggcaagagactggactcccgtgtaccagtgctgttttttgtcatgcgagcctgtgattcatagcttcctggggtgttggggagaatcacctttgggtaagccaggttagcactgacagtttgtctttagaatcaagcagatgtggaatcaaaatctggctgtatccatgaccagctctgaagccatgagtgggtaacatagctttagaagcctcagcatactcatctggaaagtggaagtgatcatgtctattttgcagagttgttgccacttttcctctctggaccccactttccccatctgtcagatgaaagagtgggatgagatggcctgtctatttatctctcaatcacaatggctctatttgaaaaaagtttgaan

SEQ ID NO: 493816 - DNA, 200 bp, Homo sapiens
caggatcctcacacgcgaggcacataccaaagtcgcgatcttcacgagcccggtgtcgccgatcttcagggtatacgccgataggtccaaattgtacacgccgagaggtccgtaatcgccgatcttgacgaacgcattatcgccgatcttcacgagcgcattgtcgccgatcttcacgactttggtctggttactcggcg

SEQ ID NO: 493817 - DNA, 866 bp, Homo sapiens
ggaggaggagctttgcctagcttgcagggcagcgcaggcagaccggcggcgggagaacgcaagatgaatgcaggctcagatcctgtgtcatcgtctcggcggcgcgaccatcataggttccttcaatggtgccttagctgctgtcctgtccaggacctggctccacttgtcatcaaagaagtcttgaagagggccactgttggtccggaaagatgtgtctgagggtcatctcttggacatgtcttggcagcagggttgtgggccagaatccctgtttagaaccaaagcccagttgtgcggttccaggaattcccttaactcttgttcccaaggcaattgggagctgccagaatggaatcttgtggggtacagggccataaaaaaaggctgttgtgcctttgccaagtaccagctccaattagggcaataagggaggacttccaggcattagtgtgttcccacggacgccttgcacaaattattgagcaagggttcttcactttgtggttacttgagaacccaggaggtacacggcatagcgggagaattgccacttgacttgacgaggtaattacttcctggtgaaatggtcttaacgcggattgctattcaagcaaagtggtccataattgggtattacacggttgaaacaattgtatggcaataaatatgggccaggtgacggtcgcagaagatcagggacaaggttgcacgttctggttcccagaaagaggcacagcagaattgccacggacaggctggcgcattttgacacaacgacgatttgtaccagttttggctgttcccctacaaagacggcttcattggcagttaaacagatgagttcctcgcctgggagaattgag

SEQ ID NO: 493818 - DNA, 300 bp, Homo sapiens
  misc_feature (42)..(42): n is a, c, g, or t
agagaagttctctggacgagcttatagagtgtgcaggttctngtatcctttggtcaagggtattcatatgaaacctatgtaaacctagtgcaattacggtccttcggtcagacccaggatggggtcagaacggacaggggccgtgccgatgccgatgctggtggtgttagcgctcagtcaaggcattttaaattgttgtttggtctacaatgttggtcttttagaagtaaaaatattttttggttctttaagtgaacagtttggttatgcagtgcagcagtttataaattcaaaaggcaa

SEQ ID NO: 493819 - DNA, 329 bp, Homo sapiens
  misc_feature (12)..(12): n is a, c, g, or t
  misc_feature (123)..(123): n is a, c, g, or t
  misc_feature (243)..(243): n is a, c, g, or t
  misc_feature (313)..(313): n is a, c, g, or t
attccgacccangcctccaatacatcgtggtattgggggtttttcaggttttttgctaactgcccccttgctttgcagggatgcgttttggcgttcatcaggccgcaggaggccatacaatcnattcggattgactgcgactggcctacttgcggacgacacgcacgcgttttattgaaaaccacaatctaagtcgccgagcaaccgcagcgcgtcgcgttcgtgcaggcagatggcacaacnatcatagggctagatattactacgaaaacgatggggcaaccgcgtttctttcctggccaaaatccattangtttttgaaagataaa

SEQ ID NO: 493820 - DNA, 274 bp, Homo sapiens
acctcgcctcccggatcaatgccatctctgcctcagcctcccaagtgctgacaccaggcggatcacatgagccagagttcaagaccaacccggccatcatgttgaaacaccatctctacctctaatcttaaattagccggcctggtgacgcatgcctgtgatcccagctactcgggaggtcgagtgctgaggcacgagaattgcttgaacctgggagtcggaagttgcagtgagctgagaatgtgccactacactccagcctgggcaacagagc

SEQ ID NO: 493821 - DNA, 457 bp, Homo sapiens
taggtgaggtatcatacagcgctatcctacaaggcagagtttccacaggatctacgataccccagagaggcatcctgataggcatccagcaatcattccggtcaagattccttggagtggctgagcaattacacaatgaaggtttcaagctgtatgccacggaagccagcatcacgatctggttcaatgctcaacaagtgtacctgacatcccagctggcatgggcgtctcaatatggacagagatcccagaccgtcgtcttccattcagaaactagcatgagagcatggcaggattgagcctagggcttaagcttcccaaacaacaaccactaaattctgtccatgcataattcatgtgattccggaggacagcagttgcatagtggactccctctcctcactaattttcaggtgaccaaactttttgctgaagctgtgcagaaatctctccaagg

SEQ ID NO: 493822 - DNA, 267 bp, Homo sapiens
ccggcatgctggctgctgcggtcgacgtctcgcggatccgcggcacatgtgctggcatcgggtggcgcggaccactcccctcacattccacaggcccatggactcactatggtaccaaactcctaccaacactgaccaatacagaccaccggtgggtttttttttttttttttttttttttgttttttttttttttttttgttttttttttatttttttcgttttgttctacaccgtcacaaaacacaactatagtatagtgggggg

SEQ ID NO: 493823 - DNA, 934 bp, Homo sapiens
gtctctcgccaggcgctcctcgtgtcaagttgatatgtcgttctttaaatcgctctgcgatggaaactccacttgcacgcacctgctcgttgatgccctacgcggaaagacagtggccgatcctggtaatgctgcatacgtacttctcttaagaatcatctcaatcctagttgagactgacttgatccgagaaagtggtttgcattgtggcggagcagacgaatgttggcgctctcctatcatctgagcatgccagcacagatccagcttgttcccattccgctggagacagtgcatgctggctcgctagatgggacagagaacgctcatgatgccgtcgaaggcctattcgctaaggtgcaccgtggtcaaatacaaacctaagcttcctgtcaatgaaatttgcttgtcctcagatactcgcgggggagatagttgttcgtgcgctgtgtaaggtgtgtctgccgacacaggattggattcctcgaccgtagatgaagtcccgggagcaagtagttctgctagtgcgcgattcaagagggtggccaattccttgcatgacctcggtggcttgcgttgccgttttggcgcgcccagtgctgtcatcgttctccatggatggacccataggccacgagaagaacacaagttggggtccttcagtgggagctcgggaagataaagaaaccttccttgttatggccccaatgggaatatcatagcgttatggaccccctgtgaaggatacttccgcagggaggccacccgattcgtataatcgctagccagttcgaattgtcgctggggtgattcgccgcagtggggggaacccccgtttggtttatggctggacgtacctcggcggcttgcttgtttccttggttctgaacgatctttccaccgtttcttcccttggagcgcttggttcgtccca

SEQ ID NO: 493824 - DNA, 820 bp, Homo sapiens
gattcgtttccgcttgcgctgtgagcggaggcgagtgtatgtgcgagaataacagtgtcaagccccgctgcccgccatcgtgccgccgcccggaaggccaccgctgcggatgattttcctgcatggattgggagatactgggcacggatgggcagaagcctttgcaggtatcagaaagttcacatatcaaatatatctgcccgcatgcgcctgttaggccctgttacagttacatatgaacgtggctatgccttcatggttggatattatcgggctttcaccagattcacaggaggatgaatcttgggattaaacagaaaggaggaaaaattataaaaagcttttgagtgtgatcaagaaggtgaacgaattgggcatttccttctaacaagaacttactacgggagggttatctcagggcaaggaagactataatcttgcatattacgtggcccttacgcaaacaggcagaaacgttggcaggtgtcaacctggcaacattcaagctttgcatgtgctttccaactatcgaggactatacttttatcacacaagaggtccctaatcagagatgggtgcttaaatagaggattatattcatatttcctccccaagtgccaccggaggaatggtagaccccattagggatacaccctggaactgagtagggaaccacctttaacagggtgggaaaaaaacgtagagaacaatttgggatagaacatcccaagcccaaaggatagaccctgataaaaaaacctgatggacaggggcactgaatggcaccaagatccgggggtcaacacagggaacacaggcc

SEQ ID NO: 493825 - DNA, 210 bp, Homo sapiens
  misc_feature (76)..(76): n is a, c, g, or t
ggacctgcaagcgtagaccaaagtactgggactacaggcatgcacctctccacgccctgtatttttatatttttangtagggatggctttcaccatgctggccttaagtgatccgtccgccttggcctccaaagtgctgggatttcaggcaagcgtcaccacacccgacccctcactagtatttcagcatttgggtactacgctttggca

SEQ ID NO: 493826 - DNA, 116 bp, Homo sapiens
atcttcctgttctgccctctgaaagcagtgacccaagatgtacctttgtatctatctagccatgcgttgtgagctggagctatcaggtatgcagcctgcacatttcctgagagatg

SEQ ID NO: 493827 - DNA, 755 bp, Homo sapiens
ggaagatgggacgaggcctcagcgcgatgacatatgccgtcagtcgagcgcaggaggcgtcctcttcagcgtatctctccacctctacccggaagcacaccctctcacagacgtaccaatgttaattgtgttataatttcatggatttagttatacataccttaaatagtttctactaaagattcgttgacgattatcatggcaaatttgggccaagtattatcattgaattttctgtgtcggatttcctctaggatttcgccagttcctacaacgtgcagtagggcggcggtagctcttgctgtctgtggactctgctcagctgtgtcctgtaggagtcgagatgtgtctgtgctttattatggccttgtttatatatcactgaggtatactatgccatgtacatagactattttttataatctttacatgctggtttaaattcagacaggaaatagatcaaggaaagtatatatattttcttctaaaatttattatattcgtgtgacaaataatcattttcatcttggtcagctaaaatgttctcagtgaccgtatatgagtaggtgtttctttctctgaagagatgaaagagctgataatatttcttaattgctcagtatgtttctgcccattatgaaagatgaccataaggtattcatgattttcaccttctccttgcaggagaaggcctccgttaacccctggggcctttttgtggggcgggaaaagggttttacctggacgggccaagg

SEQ ID NO: 493828 - DNA, 118 bp, Homo sapiens
  misc_feature (88)..(89): n is a, c, g, or t
gcatcccccagcaccattctttcatttcccaacaccattcagttcagccaacagtcctggtgggcattctcacaacagttcttcattnngctgtcctttcaacaggggtcacgcagct

SEQ ID NO: 493829 - DNA, 882 bp, Homo sapiens
  misc_feature (882)..(882): n is a, c, g, or t
ctgacggtggcctgctgtgagctcagtgctggcgtggccgcggctgggatggcgaagagcaacggaggagaatgggcctgctgcgcgccctgcgtgcctggggaaagcctgtccgggaacccgggagagcctggcccagtggcccctgactgcctgcaaccaccgatgaactcagctctctcgggtctgactcggagtgccaactggcttcgccgagcgccgcatcgacaagttcggcttcatcgtggtgctcgcagggcgccgagggcgcgctggaggaagtacccctggagggttgcttgaggcagagggagtccaagtggctggacattgctcaaacaactgggacaaatggatggccaagaagcacaaaacgattcgtcttgcggatgccaaaaggggcatcccgcacttctctgcaggggccagttgccttggcaggtaccctgtcatgtgaggcacaggtgaacgttacagcagaaccctgtgaacagtttgacgaggctgggacatgtcccctgggggaccccaaagtggcctggacgtgacttgcaggcgtgaccatgcaccggcagtaccacaattccaatgagatgtatgtgtcccatgggtgggggtgccaacgcgccaagcactggacacctaattccagtagtgcctgaaggcgcttacacggctcgacaccggtgcgcggacgtaatgcggcatagttggcacagagcccaagtgcacgcccgaattgccgggcgtggtagttgcgtccaattggcatactgaccctggcttagagacaagaggacctatctgggatgacctggataccacgcatctggttgaagaacgaaccctgaccctgtacttactaccaagggcaagaacgcn

SEQ ID NO: 493830 - DNA, 305 bp, Homo sapiens
gttgaggggaggcgagctcctttcttgcagccccgtctgggctgtgaggttcagaaccaggagggcccgagcacgaggccgcaccctgaggacagtggacggctcggagctgccaccccgacgcacatgtgacactgctcccatcgcaggagaagaaaccagatctttctcagtcactctccctagagctttatgcttgatgcatctcacctaaccttacctgataccacctaattttggggccattttcttttttgttttggagacggagtctcgctctgtcgcccatgcgtggattgccagga

SEQ ID NO: 493831 - DNA, 1244 bp, Homo sapiens
  misc_feature (217)..(217): n is a, c, g, or t
aatcaaaccacacactacatacacacacaacaaaaaaacaaccaaaaaaaacaaaaagaaacaaatacgagaaaaaacaaaaaaaacaagacgaaaatacagacaagaagaacgaaaaaaacgagcgtacactggaacaaacacatggagatagaattggtttggaacccccccccccccccccccccccccccctggtgaagctgcgggagggtcnttttttttgtttaaaaaaagagccggtgctaaggaagtggataggaagtattcagcacgaccagggtgggacccccaccgttggccccagtagttttttttaaaaaacgcgtggcacacaagtcaagtggtcaaggcatgccgacaacgacttcatggacgtacaccatcacggccgccactaggagccatacaagaacagtactcgagaagcaaagagagagagagataggccccccccaggcacggacaggcacgcagaaagtttgactaccagggggactagaactaagcagcaagggacacagcaagagacactagcgcagaggagcgaaaaccggaggagcacgaagaacgagagcgcagacgagacagcgaggggagcaagggtgaagcacagcagcaggcggagcgaccgaggacgcgaaagcaggcggcgggacaagacggagcgcaggagaggcgaagccgaatggacgacgagagcgcacgagcggcacgagcagagcgcgatagaagagacgcagcagaagcgagagcgaaccaagcgaagcgccgcgagggaaacgacgaccacaaggaggagacgggcacgacccgcggcggccgccggggcgcgacgaagcaccgacgcgaggaagggacaggaggcaggagaggcagcgcgagacaaccgaagacagactagagcatgcgagagcgcgagaaggcggaggacgcaagcggcccagagcccgcgaacggcccggacgctccaagcggagacgagagcgagcaggcacggagggcgccgggaggggcacagtgaaggagaacaggaagagagaggaggcgcgagcacacagaggcaaggaggccacgaggaggtggaggacgagtgagagaaggggaagaacgaggacggggaggaggcaagtgcgagacgagggggagaacgacgggcggccggacaacggaggcggagcgcaacagcggagcgcgaccgccgtcggcgacacagcgcgcgcgcacgggccgcggaggcgggc

SEQ ID NO: 493832 - DNA, 650 bp, Homo sapiens
  misc_feature (26)..(26): n is a, c, g, or t
atacccacgtttgtggtgggaggacngctgcgggtctagcactcatacttcgggttggcgtactacaccttatttgtctaccatgcctccttcggggagtacctcatctaagtagtgcatcactaccctgtcactgccttgtctcataaaggtaaggcagctgtgccagtagagacctctgcctaagtccaaaactgtcttgccggccacggcttactacacacaggttgagtgcggaagtcccaccaggcaccccatttaacagataactttgtaggttccccaccttaagtagccctatcttggttaaagcaacggttcctctattaatttgtcctcccaccacaaacgtgggatccgtgcacgttaacgattactaggactatgcagaaaccttgcctttcccaaagcagcgtcctcccaccacaaacgtgggatccgtgcacgttaacgattactaggactatgcagaaaactttccaagattactttccctttttgccttgttcaccatctgtattcaactaggctgcttaccttttgtcactgctccgagacgatttcatacagcgagctctctagcaccttatgttccgaaccctcattcgttcttgcgactctttcactcctactcatagaccctgacatac

SEQ ID NO: 493833 - DNA, 2380 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493834 - DNA, 419 bp, Homo sapiens
  misc_feature (402)..(403): n is a, c, g, or t
aaatttgaaccatgtaaatatttctttttcaaaatataaggttaaaaaatatacctaccttaaaaaacgttcatataaatgaccagaagcaactgaaaaaatgtttaggacatctttttcctttttgttttctttatgcaagcttactgtgaaacttggaataaaaaagtaattgacatttcttaaacatacatatggaaacattgtatgcctaaatagtaaatataagcaatcaatatagaaatgtatttcaaaatagttaagctataaacactctataatatttacaaactaatattaaaatatttgacaatatcatttgaagctttatgagtttttttttaaatttgtaatgtggaatataactatattgtctttaggtgaatgggctggtatttttgnntttttgtgattttgca

SEQ ID NO: 493835 - DNA, 1761 bp, Homo sapiens
gacctcgactcttagtcttgtcgcgggcacggctaaccggcgacccggctgtctgctcctgctcgccttcgcctcctaatccctagccacctatgcgctgagtgcatctccatccacgcttggccaggctggctgctccagcacttggcaactgcctgctggcgagcctctactgccatggcaacacgcgcatccacgcccgactgcgccacgactgccacagctgcacaacgacccactcgcgcgcgcgcacgcgcacgactgacctcccttcaaccacccctctcctctcacgctgacgaccgcggccgccctgcgccacacgccaccgtgccacccccgggcgcccttgcctgcctccctgcctagcaccctctgcggcacacccacaccaggcctcactctgcacctgcacactcctctccggcccacccctggtgccaaccgccctacctccgccccacgaccgatcctctcccacccccattgacgagaaccaacgccctccgagcttcccacgcaagcgtgcccccacagtgaccacacccgcacgtgggcgttggacgcccaaaaccttaacacccctgatcttgcgcccccctgcacagcgcgcgcccaacccgtgaaacacatcaccaaactgcggcgccccaaccaacgcgcgcacgccgagctccgcacgtctgtaaacccccttctgacgctcggcctcaccgcagacccgccgcaaccaccttctccggccccgctacgtgccccgtgcgcgcgcctctgggcaccccccgagtgtgccctggccccaacctcccggcgtcgtcttcccttcttctacgcagtgcgccccctctcccttctgtccgccctctctcctcccccaacccaaggctcctttctcacgggcgccctgcgctgcgcccgcaatacctcttggtcccttctcacttggcggcgccttttccacccgcgctcccccccccctgcgcgctttcccatcggcgcgcagaccgcggcgttccctcccgtcccacgcgcttctggaagctttctccttggcggccctcgacgcacatcgcgcctccctaccgcgcccctgggcgcacgcttctcctttcccccgcgttctatttacccccccaaggctcccatccccccccaggcagcctcttcctccctacgcatgcgcctccctgcctctgcgtctatctgcacggcccgcctgtaactcgacagatcccctcccccacttcccgctttcacagccccaccactcccgacccaactcacaagcccccatggcggaacgccaaactctcatctggaactcatcggatgcctcacttctaccacttaggtgctgagtcaacacacatctagaacagcgcacccactcctcctaacttccaaaccactccccttgcgccaccgccacaaccaccaacaccccctcagcgcaccatcatctcgcgcacgggccgtccctccccaccgccgataccaccgttatacacccccattctaatgcgcggagcgtttccagtctacaagcgcccagaccaacttcgccggcgtccccggtctccgcacttccaccgtgggccttcgccgcgtcctgcgcacttctgtgaattgcgacgccccctgtagatttcgttgcgcatcttgagacagggaaatcttccacgcaacacaaccccccgtcgtctcgccccctaccccccctcgtcgcttcgcctctgtccgcgctatcgtgctcgagcagca

SEQ ID NO: 493836 - DNA, 122 bp, Homo sapiens
  misc_feature (20)..(20): n is a, c, g, or t
cgttgtgtcctctggcattngtgtggctttttcgcgttccttcgggtcctttctcggtcttcacgcagggccgcccctccttgtccttcctcagcctggccgcctggcactctgcacgctgg

SEQ ID NO: 493837 - DNA, 3078 bp, Homo sapiens
  misc_feature (1351)..(1351): n is a, c, g, or t
  misc_feature (1431)..(1431): n is a, c, g, or t
  misc_feature (1474)..(1474): n is a, c, g, or t
  misc_feature (1617)..(1617): n is a, c, g, or t
  misc_feature (1619)..(1621): n is a, c, g, or t
  misc_feature (1623)..(1626): n is a, c, g, or t
  misc_feature (1628)..(1628): n is a, c, g, or t
  misc_feature (1630)..(1630): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtgtaaatatcgttagtttttttaaaaaccnaaacgtttatatctgtataagtcaattataagttaagttaatctatttatttaataagtttagcataagaaacttaggcnaagcagtttcttgatatttgagttttgtatctggcttacttanatccttgtgagttatgaagttccttaggatagataattcaaattaggtttaagtagtcttgggggaggggcctacggagtgaaactcttaatttttctaagtataaagtttaaatcaatagcaaaacaggattaagataaatntnnncnnnntnanggtattgacatgcctttgatgtatcaaactgagggggaacccactaaatccagtcaagcagtttcataagatcttcacaaaatgcctctacttacggaatcatgttgattttagtcctgctgatgtgtgtaccgttagcactttggtttatcaatatttgactggctcaaatgatggatagaagggtggcctggttatagacagtaggcagaaggaggcagagggttacagtaatgtaagatcaagactggaaaatgatagctatagaattacaagcccggtaccaccaggtaccacatcacataagaaaaaaggttctaatgttttcttaacttaacagcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493838 - DNA, 220 bp, Homo sapiens
atcccctctccctactgatcctagtgaaaatatgctcaagggacaaaaactaagttcatcaattttatctttaagattcagtttaagtggggatcctttaggcctacttggacttggaccacaccttggactattctttccctaatcagcacacaatattcaaagaagcaacaagtggaagactttcttatctctcttttgttaggatacagtagggaga

SEQ ID NO: 493839 - DNA, 2599 bp, Homo sapiens
  misc_feature (51)..(51): n is a, c, g, or t
gcttgcggccgccgccatttcctttcctctacgctggctctcggcccgggnccccacggttcggggcgccgacagctgttgctcaggacagctttgggggtccggtcgccggacgaggaggtgttggagtcgccggggtgggtgcatccgcccggtttttgctccgtgggggggcggtgcgggcccgggcgcgcctcggaggcgaaggacagcttaattggcgctctcagttctggtcctccccgctttgcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493840 - DNA, 3170 bp, Homo sapiens
  misc_feature (1443)..(1443): n is a, c, g, or t
  misc_feature (1523)..(1523): n is a, c, g, or t
  misc_feature (1566)..(1566): n is a, c, g, or t
  misc_feature (1709)..(1709): n is a, c, g, or t
  misc_feature (1711)..(1713): n is a, c, g, or t
  misc_feature (1715)..(1718): n is a, c, g, or t
  misc_feature (1720)..(1720): n is a, c, g, or t
  misc_feature (1722)..(1722): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacggtagccaaatgctaggaggcatgggtttgtgtaaatatcactttagtgtcttttttttaagctaaccttgtatgccttttctctcatttcagaacacagatatgtagaactcttcttgaattctacagcaggagcaagcggtggtgcttatggtagccaaatgatgggaggcatgggcttgtgtaaatatcgttagtttttttaaaaaccnaaacgtttatatctgtataagtcaattataagttaagttaatctatttatttaataagtttagcataagaaacttaggcnaagcagtttcttgatatttgagttttgtatctggcttacttanatccttgtgagttatgaagttccttaggatagataattcaaattaggtttaagtagtcttgggggaggggcctacggagtgaaactcttaatttttctaagtataaagtttaaatcaatagcaaaacaggattaagataaatntnnncnnnntnanggtattgacatgcctttgatgtatcaaactgagggggaacccactaaatccagtcaagcagtttcataagatcttcacaaaatgcctctacttacggaatcatgttgattttagtcctgctgatgtgtgtaccgttagcactttggtttatcaatatttgactggctcaaatgatggatagaagggtggcctggttatagacagtaggcagaaggaggcagagggttacagtaatgtaagatcaagactggaaaatgatagctatagaattacaagcccggtaccaccaggtaccacatcacataagaaaaaaggttctaatgttttcttaacttaacagcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493841 - DNA, 3019 bp, Homo sapiens
  misc_feature (1292)..(1292): n is a, c, g, or t
  misc_feature (1372)..(1372): n is a, c, g, or t
  misc_feature (1415)..(1415): n is a, c, g, or t
  misc_feature (1558)..(1558): n is a, c, g, or t
  misc_feature (1560)..(1562): n is a, c, g, or t
  misc_feature (1564)..(1567): n is a, c, g, or t
  misc_feature (1569)..(1569): n is a, c, g, or t
  misc_feature (1571)..(1571): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgggtagccaaatgatgggaggcatgggcttgtgtaaatatcgttagtttttttaaaaaccnaaacgtttatatctgtataagtcaattataagttaagttaatctatttatttaataagtttagcataagaaacttaggcnaagcagtttcttgatatttgagttttgtatctggcttacttanatccttgtgagttatgaagttccttaggatagataattcaaattaggtttaagtagtcttgggggaggggcctacggagtgaaactcttaatttttctaagtataaagtttaaatcaatagcaaaacaggattaagataaatntnnncnnnntnanggtattgacatgcctttgatgtatcaaactgagggggaacccactaaatccagtcaagcagtttcataagatcttcacaaaatgcctctacttacggaatcatgttgattttagtcctgctgatgtgtgtaccgttagcactttggtttatcaatatttgactggctcaaatgatggatagaagggtggcctggttatagacagtaggcagaaggaggcagagggttacagtaatgtaagatcaagactggaaaatgatagctatagaattacaagcccggtaccaccaggtaccacatcacataagaaaaaaggttctaatgttttcttaacttaacagcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493842 - DNA, 140 bp, Homo sapiens
cattacaacagaagacatgaccatatcccgactccaacagcatctgcaaggaatggaaatcttctgaaaatgacatgcgcagtaacagaataattcaagcggaactgaagatctatccaaaacatgttactgctctgaaa

SEQ ID NO: 493843 - DNA, 871 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaatataataataatttattttaatatattatgatatactattttactattttacaaaataaaaaaaccttgggggggggccccggttccccaaattcgccctattgggaatgcgtttaacatataa

SEQ ID NO: 493844 - DNA, 2522 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacggtagccaaatgctaggaggcatgggtttgtgtaaatatcactttagtgtcttttttttaagctaaccttgtatgccttttctctcatttcagaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493845 - DNA, 183 bp, Homo sapiens
ttaaactcctgactgtgaaaaagagttaatcacagactcttttgcctgctcttggtactcttctcctcctactgaactgtatccaacttccatattaaatttttgctttatcttattatgttttattttgtattatttggttgttatctcttagaagccttttttttctaatagagacagaaa

SEQ ID NO: 493846 - DNA, 1297 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaaaaaaaaaaaaaaaaaaaaaaaaaaaaaaaaaaaaaaaaaaagaggaaaaaaaaaaaaaaaaaaaaaaaaaaagagaaaaaaaaaaaaaaaaaaaaaacaaaaaaaaaaaaccaagggcgacacaaaaacgagagacaacaaaaagagacaagaacacaggacaccaagcacaaacacaaagagaaagggaaaaaaagagacaaaggggcatttatgtcgagaaaagaagaaaaaaacaaaagaggagagaaaaaaaaaaagcaaaaaaatacgtataaaatataaaaagacataaaaaagaggaaaaaataaaaaagagaaaagggagaaagaagagagaaaaaaagacagaagaaagagagcgcgaggaaaaataaaggaaaaaacgaaacaccacaccaccagaaaagatgacaaaacaggacacacagaggacaggcaggagaggaccgtggcgagaacacaacgacaagaaagaacgaaagaaacaaacgaaggagagacaaagaaaggaggagaggaaagagagagaaacaacgacacggagaag

SEQ ID NO: 493847 - DNA, 2371 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493848 - DNA, 712 bp, Homo sapiens
agcgggggggagtcacctcagctggcagtgtaccagcgtgttagaaagcagcctcaggaacgggcatctccatcactggcgtcaccatgggagactgtgctgggtgtcttctccctcgccagctgggttccatgcctctgcagcggtgcctgatgtgggctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtcgaagggcggcatttaacaatccatgaggctgatatacaatgcacgataaagcattgtgatgtgctcggttggttcataaagctgtgtatccggatccagctttgcccatggcccatcttttcctttgtctttctctctgctcatgttcacaagtcaaaaacaagtaaagatctccgagcggcagtacacaatgggttctcggttcttcaacaatttgctgcccttattcggaatccatggtttggctcctttctacattccctgggggctatttcacgctcagtctggtttgtcgttggcatgactaaggggccgccctcttcatccctcattcagctgcgtgctgcttggtacgattttgctcattccttggaatgaatcctggggtaaatcgaatggaagaaggca

SEQ ID NO: 493849 - DNA, 1060 bp, Homo sapiens
aggtggggaggaagaggaggaggaagaagaaggtgatggtgaggaagaggatggagatgaagagacgcccctgctcaacgggcaatgctcaatgcaggcaaaatggggcagcaggaggctggacaatgcaggtcagcacgacagcaagaggcaagcaaggtgggtgcaggcaagcaggcaggcaggcaagcaagcaaggtgcatggtgcaggcaagcaggatggagcatgaagatgacggaagctgagatcagactacggagcaagacgggcagactgacagatgactgagtgatgcacgatgtcagataccaagcaagcacgacagaccgaccgaggactgagctcagacagacacaaacaaggaccaacgttaacactaagaagaaacacaagtgccgccgatgaccatattcaacccatccacattcccgataatcagaaatctaaaccatggatcacgcttcgagatagcacgaggcccgacccgaaccaccagtgggcaaatgccaaccgacagatgacaacgcgcatcatccagcaaaccaaggccaaaacatgagaactggcaacagggcgcaggaaacaaaagaaccaacaacatccaaaggacccatgcaaacacaactacacaagctacacaacaacaaggcacactaggcgaagccaataacacatcaaccatcacacaacaagcacggaaaaacacatggcacacgggcccagaccacacaaaacgcaacccgagaatgacaaacaacaaaacctaagaaagcaaacaaaagaaccaaaccaaagacataaaaacgagcagacgacccagtgtccactcactaacccacacaacggagaaaaccaccaacgctggacaaaacacaaaggacagaaaatgaaacacacagaaacaccgaacctaagcaccaaaagacagctccaggaaaagtcaaacaggacgaatgcaccggagacggaacccaacaaggagacagagacaacgaacgcagaacgggcaacagggcgccacaaacacagagatagaaccagaaacacaagggaacaaa

SEQ ID NO: 493850 - DNA, 681 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 493851 - DNA, 2399 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493852 - DNA, 878 bp, Homo sapiens
  misc_feature (766)..(766): n is a, c, g, or t
cagacacactcaggctaggtatgaggactgggtggtttactttggccgaggcttggcactcttggctctttggagaaaacgtgtaacaaaagatgcagaagggctagctgacagagatgtccagaagattataggggatatacttcagatgaccaacgacccacgtgtcatgaacagcagctataaaagccatgtttgcagctccatgaacagaggactgaaattacaccaaacaatttataatacaggcctgtaaattactactctgatgactatgaacaagtgcgcagaagctgcagtccagctatatctgggtcgtacagtacagctctatacctgaaagcattgtacccaattccttcttctaaatgacatgaacatacgctatagttgatgatgcgttatggcaaaattttgtcacatggtcaatgtgatgtgctctatgggtggtatcgtgttcaggcagcaaaacttgttgggctctatgtgagcaagtcagttctcatttcttgtgagcagacccttgacaagaagctgatgtcagatctgaggaggacaacgtactgcacatgagcgtgccaagtgaactttacagtatcggagggagtatcaccagtggcagaaagtggggagatgattgctcccaatgaagacagtagataccgggggcgttgacccttgatttgagtcaggatgcttgtatgagcttcagtacaatgcggtgggacgatgagatgtatacggtacggacttgctgctgtggatngccctctgcgatgttgggccagtcttcccacatattgctgaacattgcttgattcctagttaatgtcacgatgaaaagagcaaaccttgcggctaataacaggaaatttaaa

SEQ ID NO: 493853 - DNA, 529 bp, Homo sapiens
  misc_feature (9)..(9): n is a, c, g, or t
  misc_feature (11)..(11): n is a, c, g, or t
  misc_feature (19)..(19): n is a, c, g, or t
gcggggttncngtggggcncgcgttgaggctgcggtcatggagggagcaggagctggatccggcttccggaaggagctggtgagcaggctgctgcacctgcacttcaaggatgacaagaccaaagtgagcggggacgcgctgcagctcatggtggagttgctgaaggtcttcgttgtggaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctcctccctgggacaatagtgtgcactgccacccgacatcaaagctggcgtgtgacctttccagccatgcgatattccccttggaagatgcttccccaggctataaatttgttctcacaaagcaacatcaataaatcaaaactgtctctcccaaaaaaaaaaaaaaaaa

SEQ ID NO: 493854 - DNA, 2370 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacggtagccaaatgctaggaggcatgggtttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493855 - DNA, 561 bp, Homo sapiens
tttttttctaagtctaaaaaggttttatttaatcaacataaccatatccaataaaatgcatcttcagaaaaaattaattgcttgcttattagtggaaaatcatatctttaaaaaaaaacaataaatccgactgactattgtagtgtttgatgcaaatttccatccaggcctcttcctttggctcatgccctttcataaactcttgtggaagtcacgcctttcataacacattccaccaccagcttgtcaccatctcgttttctctttattgtggtcgactttccatcccacttctgcacctgcaccaggccccgccatctagggttatgatgctcttcaccttcctgtcgtctgcggtgatttcatcgaattccacgcccagtttgaaggaaatctcggtgtttttaaaagtactctctgaccggatggtgaccaaatccccatttacgctgatgatcatgttgggcttggccatgcctgccactttccttgtgcaaagcccactcccacttctttcatgtaatcatcgaagttttcactggagacaagcttccaggttcc

SEQ ID NO: 493856 - DNA, 240 bp, Homo sapiens
ttgtgaattgtcctagactttaaatatctgtcttctgcaagtgggacaagagaaaaatgaagaagaaaataaaagcaaaaaaaaaaaaaaaaaaaaaagaaaaaaaattaattggcccttaaattcccttccaattggctccaccctaagggaagggtttggaacctgtgctaaaagggttgcaccaagtgctgcctgccaagtgtgttggtttctccaagattcaaacacagcacccat

SEQ ID NO: 493857 - DNA, 1510 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacggtaaagcctgtttgttactgtacttagagtaagttatggtaaagcctgttcgttactgtacttagagtaagttatggtaaagcctcttactcgta

SEQ ID NO: 493858 - DNA, 126 bp, Homo sapiens
  misc_feature (76)..(76): n is a, c, g, or t
cgttggtcagtggtcatctccatcttcatttgaaaacgtgaaagaaaagtgggtgccgtgagataactcaccactngtccaacagactccgttgcttgcattgtcggggactcaagattgatctca

SEQ ID NO: 493859 - DNA, 719 bp, Homo sapiens
  misc_feature (227)..(227): n is a, c, g, or t
  misc_feature (702)..(702): n is a, c, g, or t
  misc_feature (707)..(707): n is a, c, g, or t
  misc_feature (710)..(710): n is a, c, g, or t
tgttttctccctataagaacacccctcttctccaggaaaaaaaaatttttttttttcccccgcgggcggccctttttttaaaaagaagaatttcctcccccccacaaaagggccccccggaggaattttttttggtgcctcccccccgcgtgggaagaagggcctttaaaacaaagaaggaaccgcgcgtggttggggggtgtttttaaaaagaaagaatttttttngcaccaacacaaaacccacccaaaaggagttttccttccctccccccccccccccaccaccttttttgggccccctcctcaccccccctggttgtcctccccccccccccagattttccccccccccttgtgtttttccccgggggaaattttttttgtggcggggcccccggcgccttttttttttttaggggggggggacaaccccccggggggggcttcggtttttttccccccccccccaaaaggcccctttttttggaaaaaaatttaaaaaaagccccccaaaccccccccgggttttttttggggccaacaaacataggaaaaaggggggggggaatatttttatagccccttcccccaaaaatttttcccccaaaattctttggaataaaacccccttttaaccatttttttgaaaagttttccccttcccttaccaagtgggaaattgggggggttatgccccccnggaanaangcctgcagc

SEQ ID NO: 493860 - DNA, 393 bp, Homo sapiens
cttttggggtctttgctaaagtgactaataggtttgcgatcaggttaccaatgtttctgattcgcctgcatctgggaggtgtcccccaggacactatactttgagtgctaaaactgccagggtcccaggcaaactggaacagatgaatcacattaaaagcaataatcactgcggaacacatcctattcacaactgtaatcaaagctatagatacctgcggacaaagtttactactaactagaggcatgagggaattaatacaaagtattctccaaccagattggccagtattacagaagctgctaagacctaacgctggagaaggtgtttgggaagataacagctgcacagagaactacttagtagattgagcaaagaccccgggtaccgagc

SEQ ID NO: 493861 - DNA, 353 bp, Homo sapiens
gctgaccaatggtgcgaggacacagactcatatgtttatgtacatgacaagcgtgattttgggcagtaatattcccctatgtgtgggatcagggaagttcatgagtgcagagccgttgtgggcaagtgtgaccgtgggctgacaacagctgttgcggatcatatgcaagctgagccaactacctatgatgcgtgatagaattcaggctttctggaaagctatctgactgactacactggctctgcgtctctaggaggaccatatgacctaatatatgtattggataaagcttgcatgaagaggtgagtggatgctagacgacatgagaggccctgtgtatgatgcgtcgcttt

SEQ ID NO: 493862 - DNA, 243 bp, Homo sapiens
gccaccgccgactgaaactgcaccgaccccccctcgaggacctgctcttaggttcagaagcaaacctcacgtgcacactgaccgacctaagagacgcctcaggcgccaccttcacctggacaccctcaagcgggaagagcactgttcaaggaccacctaagcatgacctctacggctgctacagcgtgtccagtgccctgccgggctgcgccgagccatggaaccatgggaagaccttcactt

SEQ ID NO: 493863 - DNA, 106 bp, Homo sapiens
gggccatctgcggtgggagcccgccaccaaaatgcagatttttcgtgaaaacccttcacgggggaaggactgttcactctccgagggttgaacccttcgggttacg

SEQ ID NO: 493864 - DNA, 810 bp, Homo sapiens
agcgggggatagtatggcggactggtgatggagtgaggagaatgaaaagaacgtgagaatagaggagcggcgggttgagaaaatggctgtagatggtgggtgtgtgagacaatgtatgagtgaggtaagggtcagcatgggatagcccatgatactatgcacatgcttgcctacgatgcgagtcgtggtaccctatctaaaccatcgctgtatttcagaaccgaggctactcgtacactcttcatccagtatacgtgggtagaagacttacgatggtaatagtctcatagatccactatgtgatactggctggtgctatagcgagtgtagagtgctcctgaataagagtcgtggaccattggtctggctatgtggagaaccacgagttcatgtgcataggaatatggacacgtaataagatagtttccatatcgaaatataggcacgtttggtattgtagggcactagaagagtattgggacagatctcagaggctcgaatgttatgctagccaggaatattagtaaagatgtaccatgagtataccgtaagattgagtgtatgtagtcgcacagcgattttcatcgggatgattgcgaagatcgttaacagagggacatttgctaatcgcgtaagaattcagtaattattgtagtgttgagcactggcactcataatcgatcggtcatgaagaatagtgataaatggggtattgttgaataatatcattctaaaatttagtgaaaatgatgggtgatctgtaagtaatcatagacatgaaattgtacccttttgaatagatgaggtagg

SEQ ID NO: 493865 - DNA, 456 bp, Homo sapiens
tgacttaaagcaacacaaatttattatcttacagttcttgaggttctttatcatcacatctcctctgactctgacccttctacctctctctttcccttataagggtcttcattattatattgggcatcctcagataacccaggacaatcatttcatcttaaaatcatgaatttaatcaaattggaaacgtaccttttgccatgtaatatgacatagtcatatgcttcagggatgaggcagtagacatctttctagagaacattatttagcttactgcaactggcaattagccaattcaaacaaactgtctattgaatgcgttgaagactagagcaagaattgtcagccaggagccagatgggaatggaagagaaaagaacagggaagttgaaaacttttgctgaagggcctgtgcaatccatggtgcatgataaaaggtgcagagggtttgtgcaa

SEQ ID NO: 493866 - DNA, 833 bp, Homo sapiens
acaaacaagtcaagccacctctcgcgaatcactatagcacaatgtcctgccatggtagctcgtaccagagagagagtcttcaggctgagtcgctgaacttcaagaaaacgcttcaggaagaaaaggctgagttgctcagaacaacattgatggagtcggaagaaaatgagaggagcaatgaagaacatgcataagtgttcgagcatctttgattgggaacaacagaccaattttaacactgttgtaagcaagagagaaaatgagaccagaaaatgtaataagatgatcttagttgatgaagttgaaacgtacaatgcagcaacaggaacgggataaagattggatgaagagtcactttctggaagatcgagctcgttggcttgaggaaaagaaaaagctgtgaagaagaatgtcagtaagtcagcgtagtagcagttgggttccttcaccatatgtagctacagcccagaactttatggagcttgtgcactgaatcccaggtgaatcagatagatccgtgtggaaacggagcagatgacaggaagagtggattcagcaattggagacaaagcatgatgtgtgtcacaagaaagatatgcataatgtggtcgtgaagaaagaactgcggataggggcgtggagaagcaacctttgtatttgaaaaggaccgaaggacaaataagcggtaactcaaagactggttgtctccagaaagcatgtattgagcattttcaagggcttctgaaaggataggtactcggagatgtcaggggggagattttggacatcaactggagaaacgcagaaattaggtttttactggtggcgaatgg

SEQ ID NO: 493867 - DNA, 88 bp, Homo sapiens
gatacagggtgtattatctcatatactttcagcactcagatttgataaagaagttgctcttttcactcaaggtcttggatggttttat

SEQ ID NO: 493868 - DNA, 1165 bp, Homo sapiens
gatccagataggcgacacgccggcgggcggctgaggtcgggaatggctgctgtactgcagcgcgtcagagcggctgtccaactcgagtcgtgcgtgtgtagggctgtaacccgggtcccatgtaccctcacaaggcaccaacacctacctagtggggaccgggccccaggagcactcctcattgacactggagacaccagcacttccagaatacatcaggctgtttaaagcaggctctcacactgcaattaacacacagcaatcccaggcaccattgtagtgactcactggcacccgagatcatctggaggcatagcgcagatattccgtcacagcatcacactactgaccactacctattgcatcacaaacctcccacggactcctcagagacgcacgaccctcactacgcgacactggagacgcaacactactgtacatctgacaccactggcgactcgtgactcaccgacctgacgggagccactctaccagagctcctctataccccttggccacaccgtgcttgctcaccatggctcctacttcttagacacgacgggcacaagtgctcactcttacctgcgcgatttgcatacctagcgggcacacggcacaaccgggactctggcacagaacctctatgcatatactgacacctccttacaacacgcacgtatcattgcacacactccaagcttgactatactctcatcccaggaccttggcccaaggttactccaacttgccgacagctcaaccttccacacaacttcactcgcctaccggcacatttcgcgaaagagcaactacctaccatcaacttcgctgaacaccattcacgcactcactcacggcaaaggtgcacgctgtgtcagaccccctcgcacagcaactctccgtccaacctacacttcaactctcgcacaacaaacaacatcatccactctgccacaccacccacctgcaccgccacccacttcccacacagcactaagcaccacagtgacacccaatcctcacaacccccaaccctgtaatagccatacaaacacctcaacaacatacaccacaccatacgatcaaacaacacccacatcaacgtactcgcaacgcctcacccactgctaccatccaaccatacccaccatatgtccgcctacat

SEQ ID NO: 493869 - DNA, 816 bp, Homo sapiens
  misc_feature (11)..(11): n is a, c, g, or t
  misc_feature (74)..(74): n is a, c, g, or t
  misc_feature (157)..(157): n is a, c, g, or t
  misc_feature (175)..(175): n is a, c, g, or t
  misc_feature (190)..(190): n is a, c, g, or t
  misc_feature (197)..(197): n is a, c, g, or t
  misc_feature (212)..(212): n is a, c, g, or t
  misc_feature (218)..(218): n is a, c, g, or t
  misc_feature (227)..(227): n is a, c, g, or t
  misc_feature (236)..(236): n is a, c, g, or t
  misc_feature (244)..(245): n is a, c, g, or t
  misc_feature (248)..(248): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (278)..(278): n is a, c, g, or t
  misc_feature (280)..(280): n is a, c, g, or t
  misc_feature (311)..(311): n is a, c, g, or t
  misc_feature (335)..(336): n is a, c, g, or t
  misc_feature (347)..(348): n is a, c, g, or t
  misc_feature (369)..(369): n is a, c, g, or t
  misc_feature (385)..(385): n is a, c, g, or t
  misc_feature (410)..(410): n is a, c, g, or t
  misc_feature (464)..(464): n is a, c, g, or t
  misc_feature (471)..(471): n is a, c, g, or t
  misc_feature (479)..(479): n is a, c, g, or t
  misc_feature (520)..(520): n is a, c, g, or t
  misc_feature (524)..(524): n is a, c, g, or t
  misc_feature (552)..(552): n is a, c, g, or t
  misc_feature (556)..(556): n is a, c, g, or t
  misc_feature (567)..(567): n is a, c, g, or t
  misc_feature (572)..(572): n is a, c, g, or t
  misc_feature (584)..(584): n is a, c, g, or t
  misc_feature (589)..(589): n is a, c, g, or t
  misc_feature (591)..(591): n is a, c, g, or t
  misc_feature (597)..(597): n is a, c, g, or t
  misc_feature (599)..(599): n is a, c, g, or t
  misc_feature (643)..(643): n is a, c, g, or t
  misc_feature (740)..(740): n is a, c, g, or t
  misc_feature (792)..(792): n is a, c, g, or t
ctttagggganttgtagccctatcgaatcaaattattacaatatcatctgaaagctttatataaacgtatttcngttcttaattgcactaatgcatacagtttgatatataagcttttttcttgtgttttttctactttgggaggttatatactttntatgagatacatagaaantctactggtttaagngtacttngttttacttttactntagacnttttttccnaccagtttngatgtggnnganccancctttngtatanataacttacttccncnaaaatatttaaagggtatttttagtgtttantgtaagttttgtagtctttttttnngggggtgtgtnntagtctctttactctcagtangtgctctgggctgatngataaacacactaaatttaacaccnttgttgttttgctttttttgtacaatatcattattatgcagtgattgtgatagncttttanggtgtctnccgtcccaaaaattgttaatgagcggctattaatttttgantttntcactagtcttaaggtatgctctgaagnctgntctggtacttnttttntttgtttttttnttttngngggccncnctctctccccaggtcctcccaaggtatctaaaatagactgaaantccttgacagcagattcacaagcaaacaactccttgtccttcataaaggcctccagctgaggtagaacctgctctttcctctcttgctctgcttgtnctgtgagcactttctctttgaaaataaagtggcagcctccatagctgagggnagaaacatatgtgattaaagtagt

SEQ ID NO: 493870 - DNA, 225 bp, Homo sapiens
acggaggcttgctctgttgcccaggctggagtccagtggcatgatctccgctcactacaacctctgcctcccgggttaaggcatttctccctgcctaatcccgagaggtggaggtgcagtaggctgagactgcgctactaactccagcctggacgacggagcagattcagtttaaaggaccaaaaaaaaaggtaaagggcggtaaccattcttaaaattggtaaa

SEQ ID NO: 493871 - DNA, 1014 bp, Homo sapiens
gattagatggcgtgactgtctcacagaaagtgctccgctcccaaaaatgggtccctcgagcttgcctgcctcgtaagcgcagcaagtatgcatcgtgcgaaggtgaacagcttgccgtaaagtgatgacgcacgtgcgcataacccgagtctcaagcctcaccactccttccctgtggatactaggtctggccatgagctcacatcttgcgggatgtcaactaggccgggatcctaggtgaacaactaaggagtgtggttgctaagtgcatagatgcaccattgttagaaacgaactcacccatggaggtgtgttggcgccatttgtggcgcgtctacggtgataacagcccttcgaggactccggacccttcagtggactgtcttgtgtctgagtcaccactcagtgatgaagtgccaagaggcgtaccctactaaaagacattgctactgagagacctaaaagagtcaatgcggctcttaccggaagtaactagcaaacgatacattgcccagtgattgaggactgtggcccgaactcatgttggacaatatggcttaacagtctgtctcatcgaaagtgactagcccctgtcttacgcgtctatttgcccatactccagatgctccttgcctgtctgcatctcaaggatggccaactgactggtagatacctgcgtgaaccggcaggcggggtgggcgctgaacgccgaaactggcgggccccagaacagcgcttgatacagggacgtaccgctacccttggtcggcgccggctgacatacaatgtgcggagacgaccaggataggcgtccgacgggagcaacacttggaaccgcaagcatcccaagacaccaggcgcgccagggccgtatgggcgagaccgtcgcgagactgcgtgcaccggggcacgaaaccgcggacaaagaaataaagcgcgcaaaacgggaaacagaacccgacaacagaccaaccagcacgaaccaagaaggcacaacacacgaggaccaccaca

SEQ ID NO: 493872 - DNA, 207 bp, Homo sapiens
gactacaggcacatgcaccacgcgtggctagtttttgtatttttaatagagacagtgtttcaccatgttggtcaggctggtctcgaactcctgagcctcaggtgatccgccctccccagcctcccaaagtgctaggattacaggcgtgagccacggcgcccggccaaataatatctatcttaaaccagcagtcttcctcaaacttta

SEQ ID NO: 493873 - DNA, 896 bp, Homo sapiens
tcgcgggagcggatggcggcggcgtagcggctccactcgaccgccgggggtgaggaggcggcagccacgacctccgttgcccgggtctccaggtctgccggggagacgcagtgcgagacgcgggccctagtaggaggccgtggccaccgggacccctgaacctgtctaaccggcgcttggagcacttcccccggggtcgcgggtcgtaggtacgacctgtaagacatcacccaggctgaactgtcgcggaaccggtttcccgacggtagcccagtagtgcggcgtgccagcaatggtgtcccctggagggcctgagcctctaccataattggcctgagatgcctgataccagtcttggggaatctctagagccaacaactactctacaaactctaggtcgcgagaaccagtctgtcgcttgctttgtcacccatatccatcttggcactaggcattgcccgctgagggtgcctcatctgttcaggaacaatcgaacaaatgctggggagctctgctcacctgacatcatggcgagcccgtgggaagccctagcgataagcttagaacggtgaacaagaaacaatagctcggaattcctgggcctcggagatattgtgtagggcttccttcttccctagcgggaactctagatttccggatggaagcacgctcaagtatcgcatgacgcggaagatgctggggggaccttcccctctgggtccggccctggtatatactcttgtaaaacagcgttcccagaaaatcccaagtctcccttcttgacgcctgagggcaacctgaacagtcaatctagagtggacaagcaaaccctcatgacggaagacacctgccagagtctgcctgaaggggaaaattaacaactacaatataggcaa

SEQ ID NO: 493874 - DNA, 153 bp, Homo sapiens
  misc_feature (104)..(104): n is a, c, g, or t
ctacttgaaaagtatatgttttatttgtatttgttagttgtagcattttgtatatgacaagaggtgtcattactgattatatgattattgtctagggtatttcnagatactgtagagtcatgttatgaatttcccactaattgttgatttgtc

SEQ ID NO: 493875 - DNA, 351 bp, Homo sapiens
ggctcggggcggctgggcgggcgcacaccatccccgcgggcggcgcaggagccggcgacagcgcgcgagagggaccggggcggtggcggcggcgtggaccgggatggaaggttaagtcctgagcagcagcagcagctgcagccgcctgtgagccaggtcctgcgctgccccgtgccccctgcctcggccgctgggtgcgcccgcagcccggtgattcgctctctctctttgtgcgtttgaagggatgcgcggtgactgtccttgagcgcggaggggcgagctctccggcgggagctgccggagcaatgcggaggcgcatggagcgtgcggccggactggcggcggcggctg

SEQ ID NO: 493876 - DNA, 894 bp, Homo sapiens
ggggtgaaatcggattaaaatggccagcatgaagaggcttcagaatgggcaagatgcagtcttgggttgtcacccaggctgagtgcagcggcacaatctccagtcactacaattccgcctcccgggttcaagcgattctcctgcctcagttcctgaatagtttgggattacaggtgccggtgaccacacccagctaatttgtattttggagtagagcacgggatttcaccatgtttggtcaagctggtctcaatctcctggcctcatgatccgcccccctcggctaccaaagtgctgggattataggcatgagcctctgcaccggtagctctttcttatgacagaagtttctcaccagagtactttcttctgagaaggcagtatcatttttccatatgtaatctccacaagaaccactttcaaacaaataacagtacacctggcactttaaaagaacttcacacattcacaagggagtaaaacaaaccaagatttattatttagaaaaatctagcttagttcttacatgagtagcttttgagatggcacaccacacccttaaaatcaaggattcggggggtaacacgtccaggcatactcgttgggaaattcaggtcttgttcaattactttacgaagattgtccacctagatggcgcaaggagtagattggaaataacgtcgataaggtaaacaactaatttaattacgaagttggtgccgttcaccacggtccctgctgtttcgagacagcgtgtggccaattacgcggcaaatgccactgtcaagaggaagccacataaacacatatgagccgtgacacactgcgctggaaacggctgaagtggagcacaccatacaatcgttgtgtctgtgtttctcgattttgcgctgg

SEQ ID NO: 493877 - DNA, 160 bp, Homo sapiens
aacgggtgatgcggttggagaggtacaccaggagataccctcagataaagcccaggcccatgcatcttttctgcttgcttgaaattgatattatggaaggatgggtgtgcgatcactctcttgatgtatgtggtccgctgctgcaaccgcatcacccgtt

SEQ ID NO: 493878 - DNA, 321 bp, Homo sapiens
aacctttaatatcagggtgcaacatcggtgatgtacttgatccaactatcgaggtcgtagacacctattgttgatatggactctagaacaagattgtgctgttatccctatggtaacttgttccgttgagtcacgttattggatcaagtatgatctatagtagttcgccttgactggtgatgtcttagctatgtctgctcggaggttggtttctgttccgatgtcgctcccgagcgcaatttcttatgcatgtttgtgtactttaggacctgtgggatttgtttttctcctatatgctttagtagtttagcgctccatagg

SEQ ID NO: 493879 - DNA, 4853 bp, Homo sapiens
  misc_feature (567)..(567): n is a, c, g, or t
  misc_feature (601)..(601): n is a, c, g, or t
  misc_feature (620)..(620): n is a, c, g, or t
  misc_feature (623)..(623): n is a, c, g, or t
  misc_feature (721)..(721): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatgtagtcatgtttgttgctgagcagtgagttttggctagcttatggcaaggngatttaatagacgttaaagttgagtagcttaggnatttcagtagttgtaaatngcnaatgaattaatgttttcttcctagagaccttcaaataatttaagcccatcttaaaggtggaaatgaagtacttccaaaatgttaactttgcctatatntagtattatagttcagagtagatctttcattgaggattgccctcaacagcttaactactttcctcacattggtgtccagctaagtacctcaagttaaaggtaagatccctttaccagcagatcatcagtgcgatgaattaggttgttgtaaattatggcaagtgtctgtgttgcaagagacacgtatttgggtcatgtgaccagaagcatctaatggtctaattctctttaatgcaaaagtcggtttatgaaagacttggtttaacctgtgtggtataaacttactgaaaatcagatgtagtgagagtagtttgaatgcttgtagtctcagtatctgaaataagtgttttgaaattgttcctgggcctaaagtatttgaatgtttttatgctgaagagctgataagattgcatgtttaacaatgttagataagatatcgtatattttaagtattaatatttatgatgtgatacactggaagcaagaaatcctttcatggtttagtgtagtatgttaaaaattgatatatgtatcgagtcctaatgtcagaatttttaaaatcaagtctgtttgtttgacactaaattggtgagaattgaatgctgtcaacgttaaatatgaacataatttcatatcttctaggaaagtgctttaagtcctttttgtaagcttgggaatgtatccacggaaaggatttttcatagacggaatttccagaagtgaatcataactactgttagagcataagcatgcatgattgtgctgtgtagatcagttttgttgaaagtttagattgttgtgtttgtcaattataatttaatgtttcagtttttatatgaaatgttgtaaatgtatacctttttaaaaacttgaagttccaataacttaaagcattgaaatataaaatgaggtaaaaggtgttttgaatttagtaaaactgttatttaatgcttaaaacttaattgaattgtataattctcaacattaagttgcatagatatgtgttcttaagttgttgaattcttaatgcatcctgtgttcagcaagttttttttaatatatactgtaccatgggtgtgttaagaatagttatactttataataatggaacttcatattattgcaatgcatatttaaagagtacttgttgaaagcataccattcacctaaagttaaaaattctggtttatttaaagctataagaagaatcatttctgggcttgtgatgttaatattgcccccctactggggttatttgtccttgggttgaagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtggggatggatggttggttggatatgtcacttttcttatggtaaacaattaaatccatattctctctgcttaaaagaagaaattaatgttttgtagtcctaggtaattgatgttttgccatgatttccaaacttgtgtcagtcccacgttacacgcaaactaaattttaggtttgaaatttgtccctagttaattggtctgcttgacaattttgtgagtcttattaaccccaatcaatagagttgagagactatggctttaaaaaattaatgcaaacctggctttagctgtaataacacccacctagaataaattaatattaccataagaaaatgtgatactttctgatcttgtttttaaagttgaaatgcaacaaactttttcttgctgtatataaatattctgcatagtattaataagcatagctttcaagaaattgtcacaaaaggttttattctctttgcttgtgactatttttcattgaagcatgcgcttacctatgctgattcttactaaaagcataggctggggtatttattggcgaaaggaaatgtgtagtgtgggctggactgttggtggaggctggctttttagcccacttgctatacatgctgccaatggatttaagacttgaaatgttgaaagttgagtggaattatttccctcctaaaacatttatttacagtactcctctctacccctaaggttgggctctgcctcagaggagtgagttttttttttttttctataaagtttacattgtcttactatttattgagtgaatttctggtcattgcctatgcaaatataagaaatctggctttaaatattagtcagtttcatggctatgactagattgttttcttgtataactaaatacctgtataaaatgaactaatgttttctctcccctccctaccccttccttatgaacaatgctttaatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493880 - DNA, 105 bp, Homo sapiens
gctgaggacactgccatttattactgtgcgagggagggcgagtggtttggaaattcacacgaaagggactacttctacttcggtgtggacgtctggggccaaggg

SEQ ID NO: 493881 - DNA, 4807 bp, Homo sapiens
  misc_feature (567)..(567): n is a, c, g, or t
  misc_feature (601)..(601): n is a, c, g, or t
  misc_feature (620)..(620): n is a, c, g, or t
  misc_feature (623)..(623): n is a, c, g, or t
  misc_feature (721)..(721): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatgtagtcatgtttgttgctgagcagtgagttttggctagcttatggcaaggngatttaatagacgttaaagttgagtagcttaggnatttcagtagttgtaaatngcnaatgaattaatgttttcttcctagagaccttcaaataatttaagcccatcttaaaggtggaaatgaagtacttccaaaatgttaactttgcctatatntagtattatagttcagagtagatctttcattgaggattgccctcaacagcttaactactttcctcacattggtgtccagctaagtacctcaagttaaaggtaagatccctttaccagcagatcatcagtgcgatgaattaggttgttgtaaattatggcaagtgtctgtgttgcaagagacacgtatttgggtcatgtgaccagaagcatctaatggtctaattctctttaatgcaaaagtcggtttatgaaagacttggtttaacctgtgtggtataaacttactgaaaatcagatgtagtgagagtagtttgaatgcttgtagtctcagtatctgaaataagtgttttgaaattgttcctgggcctaaagtatttgaatgtttttatgctgaagagctgataagattgcatgtttaacaatgttagataagatatcgtatattttaagtattaatatttatgatgtgatacactggaagcaagaaatcctttcatggtttagtgtagtatgttaaaaattgatatatgtatcgagtcctaatgtcagaatttttaaaatcaagtctgtttgtttgacactaaattggtgagaattgaatgctgtcaacgttaaatatgaacataatttcatatcttctaggaaagtgctttaagtcctttttgtaagcttgggaatgtatccacggaaaggatttttcatagacggaatttccagaagtgaatcataactactgttagagcataagcatgcatgattgtgctgtgtagatcagttttgttgaaagtttagattgttgtgtttgtcaattataatttaatgtttcagtttttatatgaaatgttgtaaatgtatacctttttaaaaacttgaagttccaataacttaaagcattgaaatataaaatgaggtaaaaggtgttttgaatttagtaaaactgttatttaatgcttaaaacttaattgaattgtataattctcaacattaagttgcatagatatgtgttcttaagttgttgaattcttaatgcatcctgtgttcagcaagttttttttaatatatactgtaccatgggtgtgttaagaatagttatactttataataatggaacttcatattattgcaatgcatatttaaagagtacttgttgaaagcataccattcacctaaagttaaaaattctggtttatttaaagctataagaagaatcatttctgggcttgtgatgttaatattgcccccctactggggttatttgtccttgggttgaagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtggggatggatggttggttggatatgtcacttttcttatggtaaacaattaaatccatattctctctgcttaaaagaagaaattaatgttttgtagtcctaggtaattgatgttttgccatgatttccaaacttgtgtcagtcccacgttacacgcaaactaaattttaggtttgaaatttgtccctagttaattggtctgcttgacaattttgtgagtcttattaaccccaatcaatagagttgagagactatggctttaaaaaattaatgcaaacctggctttagctgtaataacacccacctagaataaattaatattaccataagaaaatgtgatactttctgatcttgtttttaaagttgaaatgcaacaaactttttcttgctgtatataaatattctgcatagtattaataagcatagctttcaagaaattgtcacaaaaggttttattctctttgcttgtgactatttttcattgaagcatgcgcttacctatgctgattcttactaaaagcataggctggggtatttattggcgaaaggaaatgtgtagtgtgggctggactgttggtggaggctggctttttagcccacttgctatacatgctgccaatggatttaagacttgaaatgttgaaagttgagtggaattatttccctcctaaaacattaggagtgagttttttttttttttctataaagtttacattgtcttactatttattgagtgaatttctggtcattgcctatgcaaatataagaaatctggctttaaatattagtcagtttcatggctatgactagattgttttcttgtataactaaatacctgtataaaatgaactaatgttttctctcccctccctaccccttccttatgaacaatgctttaatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493882 - DNA, 137 bp, Homo sapiens
tttttttaaagttgcgtacaggctgggtgcattggctcatgcctgtaatcccaacgctttgggagaccgatgtgggtggatcacctgaggttggaaagtcccctatgtatttgcatccgaataaaagccagtttttc

SEQ ID NO: 493883 - DNA, 1307 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgggaagcaagtgatgtggaaagcagttcaggcataggaaagagtaagttcaaaggccctgtggcagaagcaggaag

SEQ ID NO: 493884 - DNA, 104 bp, Homo sapiens
tgtatctgtagtcccagctactccagaagctgaggtgggagcatcacctgagcccaggagttcgagggtgtagtaagccatgatgacgccactgcactccagcc

SEQ ID NO: 493885 - DNA, 4850 bp, Homo sapiens
  misc_feature (567)..(567): n is a, c, g, or t
  misc_feature (601)..(601): n is a, c, g, or t
  misc_feature (620)..(620): n is a, c, g, or t
  misc_feature (623)..(623): n is a, c, g, or t
  misc_feature (721)..(721): n is a, c, g, or t
  misc_feature (2767)..(2767): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatgtagtcatgtttgttgctgagcagtgagttttggctagcttatggcaaggngatttaatagacgttaaagttgagtagcttaggnatttcagtagttgtaaatngcnaatgaattaatgttttcttcctagagaccttcaaataatttaagcccatcttaaaggtggaaatgaagtacttccaaaatgttaactttgcctatatntagtattatagttcagagtagatctttcattgaggattgccctcaacagcttaactactttcctcacattggtgtccagctaagtacctcaagttaaaggtaagatccctttaccagcagatcatcagtgcgatgaattaggttgttgtaaattatggcaagtgtctgtgttgcaagagacacgtatttgggtcatgtgaccagaagcatctaatggtctaattctctttaatgcaaaagtcggtttatgaaagacttggtttaacctgtgtggtataaacttactgaaaatcagatgtagtgagagtagtttgaatgcttgtagtctcagtatctgaaataagtgttttgaaattgttcctgggcctaaagtatttgaatgtttttatgctgaagagctgataagattgcatgtttaacaatgttagataagatatcgtatattttaagtattaatatttatgatgtgatacactggaagcaagaaatcctttcatggtttagtgtagtatgttaaaaattgatatatgtatcgagtcctaatgtcagaatttttaaaatcaagtctgtttgtttgacactaaattggtgagaattgaatgctgtcaacgttaaatatgaacataatttcatatcttctaggaaagtgctttaagtcctttttgtaagcttgggaatgtatccacggaaaggatttttcatagacggaatttccagaagtgaatcataactactgttagagcataagcatgcatgattgtgctgtgtagatcagttttgttgaaagtttagattgttgtgtttgtcaattataatttaatgtttcagtttttatatgaaatgttgtaaatgtatacctttttaaaaacttgaagttccaataacttaaagcattgaaatataaaatgaggtaaaaggtgttttgaatttagtaaaactgttatttaatgcttaaaacttaattgaattgtataattctcaacattaagttgcatagatatgtgttcttaagttgttgaattcttaatgcatcctgtgttcagcaagttttttttaatatatactgtaccatgggtgtgttaagaatagttatactttataataatggaacttcatattattgcaatgcatatttaaagagtacttgttgaaagcataccattcacctaaagttaaaaattctggtttatttaaagctataagaagaatcatttctgggcttgtgatgttaatattgcccccctactggggttatttgtccttgggttgaagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtggggatggatggttggttggatatgtcacttttcttatggtaaacaattaaatccatattctctctgcttaaaagaagaaattaatgttttgtagtcctaggtaattgatgttttgccatgatttccaaacttgtgtcagtcccacgttacacgcaaactaaattttaggtttgaaatttgtccctagttaattggtctgcttgacaattttgtgagtcttattaaccccaatcaatagagttgagagactatggctttaaaaaattaatgcaaacctggctttagctgtaataacacccacctagaataaattaatattaccataagaaaatgtgatactttctgatcttgtttttaaagttgaaatgcaacaaactttttcttgctgtatataaatattctgcatagtattaataagcatagctttcaagaaattgtcacaaaaggttttattctctttgcttgtgactatttttcattgaagcatgcgcttacctatgctgattcttactaaaagcataggctggggtatttattggcgaaaggaaatgtgtagtgtgggctggactgttggtggaggctggctttttagcccacttgctatacatgctgccaatggatttaagacttgnttgctccccccccccccccccctcccctcccaaaacatatatttacagtactcctctctacccctaaggttgggctctgcctcagaggagtgagttttttttttttttctataaagtttacattgtcttactatttattgagtgaatttctggtcattgcctatgcaaatataagaaatctggctttaaatattagtcagtttcatggctatgactagattgttttcttgtataactaaatacctgtataaaatgaactaatgttttctctcccctccctaccccttccttatgaacaatgctttaatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493886 - DNA, 1257 bp, Homo sapiens
  misc_feature (1228)..(1228): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttggtaaggtaagaattgaatttctcagttgaaggatgcttacactcttgtccatctagacctcaattactgtttttcaggaatgtctgatcacagatacggggatggtggctctactttccagagcacaacaggacactgtgtacacatgcggggattaccttacagagctactgagaatgacatttataatgtaagtgtgagatgaactcacaagtcaatatttcagtatggcagtaagtcagccttattctataaatgtgagcactatgttagaaattttaggtttttttagtaacgttagaaagtnggttgaattctttgaaatgccaggtaaag

SEQ ID NO: 493887 - DNA, 4928 bp, Homo sapiens
  misc_feature (567)..(567): n is a, c, g, or t
  misc_feature (601)..(601): n is a, c, g, or t
  misc_feature (620)..(620): n is a, c, g, or t
  misc_feature (623)..(623): n is a, c, g, or t
  misc_feature (721)..(721): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatgtagtcatgtttgttgctgagcagtgagttttggctagcttatggcaaggngatttaatagacgttaaagttgagtagcttaggnatttcagtagttgtaaatngcnaatgaattaatgttttcttcctagagaccttcaaataatttaagcccatcttaaaggtggaaatgaagtacttccaaaatgttaactttgcctatatntagtattatagttcagagtagatctttcattgaggattgccctcaacagcttaactactttcctcacattggtgtccagctaagtacctcaagttaaaggtaagatccctttaccagcagatcatcagtgcgatgaattaggttgttgtaaattatggcaagtgtctgtgttgcaagagacacgtatttgggtcatgtgaccagaagcatctaatggtctaattctctttaatgcaaaagtcggtttatgaaagacttggtttaacctgtgtggtataaacttactgaaaatcagatgtagtgagagtagtttgaatgcttgtagtctcagtatctgaaataagtgttttgaaattgttcctgggcctaaagtatttgaatgtttttatgctgaagagctgataagattgcatgtttaacaatgttagataagatatcgtatattttaagtattaatatttatgatgtgatacactggaagcaagaaatcctttcatggtttagtgtagtatgttaaaaattgatatatgtatcgagtcctaatgtcagaatttttaaaatcaagtctgtttgtttgacactaaattggtgagaattgaatgctgtcaacgttaaatatgaacataatttcatatcttctaggaaagtgctttaagtcctttttgtaagcttgggaatgtatccacggaaaggatttttcatagacggaatttccagaagtgaatcataactactgttagagcataagcatgcatgattgtgctgtgtagatcagttttgttgaaagtttagattgttgtgtttgtcaattataatttaatgtttcagtttttatatgaaatgttgtaaatgtatacctttttaaaaacttgaagttccaataacttaaagcattgaaatataaaatgaggtaaaaggtgttttgaatttagtaaaactgttatttaatgcttaaaacttaattgaattgtataattctcaacattaagttgcatagatatgtgttcttaagttgttgaattcttaatgcatcctgtgttcagcaagttttttttaatatatactgtaccatgggtgtgttaagaatagttatactttataataatggaacttcatattattgcaatgcatatttaaagagtacttgttgaaagcataccattcacctaaagttaaaaattctggtttatttaaagctataagaagaatcatttctgggcttgtgatgttaatattgcccccctactggggttatttgtccttgggttgaagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtggggatggatggttggttggatatgtcacttttcttatggtaaacaattaaatccatattctctctgcttaaaagaagaaattaatgttttgtagtcctaggtaattgatgttttgccatgatttccaaacttgtgtcagtcccacgttacacgcaaactaaattttaggtttgaaatttgtccctagttaattggtctgcttgacaattttgtgagtcttattaaccccaatcaatagagttgagagactatggctttaaaaaattaatgcaaacctggctttagctgtaataacacccacctagaataaattaatattaccataagaaaatgtgatactttctgatcttgtttttaaagttgaaatgcaacaaactttttcttgctgtatataaatattctgcatagtattaataagcatagctttcaagaaattgtcacaaaaggttttattctctttgcttgtgactatttttcattgaagcatgcgcttacctatgctgattcttactaaaagcataggctggggtatttattggcgaaaggaaatgtgtagtgtgggctggactgttggtggaggctggctttttagcccacttgctatacatgctgccaatggatttaagacttgaaatgttgaaagttgagtggaattatttccctcctaaaacatttatttacagtactcctctctacccctaaggttgggctctgcctcagaggagtgagttttttttttttttctataaagtttacattgtcttactatttattgagtgaatttctggtcattgcctatgcaaatataagaaatctggctttaaatattagtcagtttcatggctatgactagattgttttcttgtataactaaatacctgtataaaatgaactaatgttttctctcccctccctaccccttccttatgaacaatgctttaatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttggtaaggtaagaattgaatttctcagttgaaggatgcttacactcttgtccatctagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493888 - DNA, 301 bp, Homo sapiens
  misc_feature (45)..(45): n is a, c, g, or t
  misc_feature (58)..(58): n is a, c, g, or t
  misc_feature (66)..(66): n is a, c, g, or t
  misc_feature (75)..(75): n is a, c, g, or t
  misc_feature (78)..(78): n is a, c, g, or t
  misc_feature (85)..(86): n is a, c, g, or t
  misc_feature (163)..(163): n is a, c, g, or t
  misc_feature (188)..(188): n is a, c, g, or t
cgggtccccggtcccccgggtaatttgcgggcggggtcccctttncctccccggtttngtgtcccnggggccttnccnccccccnntttgtggccgtgtccgtgccccgggggtagggggggcaaaatggggcttccccttttcctttgggtccggggtttgnatgggaaaatcctttttccccaatnccgttgggggacgtggggtgggggcagggggacggtgggggagcccttgcccccgattttgggtgggcctccccgccccaggggtcactcagtgatcaggggtaaaaagggct

SEQ ID NO: 493889 - DNA, 267 bp, Homo sapiens
tgttgtagatggggcagaggaatctagaacaatgggacagccagcttgacttgtaaggtacagctataaaaacaaggtaggaatgaggctagacctttaactatccctaaggcatacttggctagctaccttctgtccctgtgatctggcagcatagatcggttgatgactgtgcatcttacccagttcgtggaatttgtgttgtttgttgtttgtaaagtaaatacaggaagagcgatcgttgaaaaaaaataataaaagagaggg

SEQ ID NO: 493890 - DNA, 909 bp, Homo sapiens
  misc_feature (859)..(859): n is a, c, g, or t
  misc_feature (864)..(864): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattcccagggntaagnaggcgataggttgggggcacaaattggggaaacccctatggtgtg

SEQ ID NO: 493891 - DNA, 2288 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493892 - DNA, 2021 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcacaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 493893 - DNA, 313 bp, Homo sapiens
gggggtttttaaaaaaaccccccccatctggggttttattttaaaggataaaaaaggaatttttttaagggagccacttttttcccaattaaaataaatgaaaaataaatccccatttggctaaattgaaagctttttgttttaaatttgcaaagcccttgaaaaattttttagggcctaggaggtttggggattcctcttttggggggggccccacccctcctttaagcaaaaaaaatcccttggcaaagcaaaatgggttaaaactttataaagctttgggtttgaaaaaaaaagggttttttaaaattta

SEQ ID NO: 493894 - DNA, 2898 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaaggtttgatttacattgccctagttacagtaaataaagcattaaacaatagaggtctcacccctcctgtaaatatagtttattgtcttttgttatagcatccataagttctttctgtagaggtgggtctccatttatccagagtccactggttgggttattaccacttaaaccattagtactatgctgttttttatacaaaagcacataagctgtgtcctttggaaacctgctcgtaattttctggactgactgaaatgaagtaaatgtcactctactgtcattaaataaaaaccattcttttgacatttccttattttccaaatcctgttcaaaaactgcactgggactatctctccctagtaaatgactctgggaggatgctaatgccagagcctcagactggtggtacatctgatatgaagagtctgtacttgtgatatttctggcataagaatagtaatgcccactttcagaggatataccagagtgaaccacaacggaacttaatagatagggcaccaattttgtgcaggaagcttcatcagtccctgaaggctttaattttttagcaaggttctcactaagatcagtgaagtcaacatctacagaccaactttctgacaatgaagagaaagaagtaattcttttaactggcaactccaaaaccagtggcagtgatacattgtctaaaattttccttctcacatgatacttctgatcatatgaaaatctcaggagagtaagaataaggtattcaggttcctccgtgatttgcatagttttctcagcattttgcagagaggcacagttttcacaataatattggttatcaccagtaagaatctctggagccaaaaaataatttagtaagtcagttactgaaggtgtggtttcacctcctggtttctgaggtacatctttattaacaagaatcttgttagattcgttagggacagaagtgttttcagaacagtaaaactcattaggaggactgcctatggttttttcattcacaagtgagtcacagatgaaggcagctgttgttggattataaactactggttcttctgaaggaccgggtacagaggcttgcattagaccaccatcttgtatactgggtgatgatgctggatcttggacagacatgttttccaaagaagaggaaggacaaaaggcaagcgaaagatctgtaaaggcttccactttttgtgaggtactcctgcagttcaaacaacgtatgtgagttcgtagttttcctccaaacattttttctattaaagtcttctcaccgtcacttgtacgaggggtctctgttagtactgctgctttactagctacttcctgtaaagaagtttcactgcattccagaatttcagaaggcttgtgtgaggcctgaactttcaagatcttttcttcttcatggagcctgtcaaggagaaatctgaggtattcagaacagtcttgctgtgatctgggagtaaaccatggaggtctggaagcctcaaagaatatccgaggtgcgtatgcttccctctgtgtatgggccagaaaggcaaaaagatgctgtaattttttcattaatgaattgcacccatttagatttaaagataatacttgtctcctgaaatctgtggccataaacaaggcttgtataacactgttcatataacatgtatttcctaggttaataagaccagttttcccagtttcagattttccagaaagtctagacaagcaagacgccaaagaattggattgagaagtccaggcactttgattgagaattaacttaatcttctcttcactgggcttaggaaaatcctttattgcctccagaataggttcatagagatctggaaatccagaataatgatacatcatacagtgtatcaattctgttaattgtactaagaaggctgtacttgaaggcagaccatcatttttgaaagaatgaaccaaattaaccacatgaggaacaatcaaatggaacgcctctggagaatgctgaaagctaagcagcatgtgagaaagaactgcaagagcaccaggtctcacaagaggaaaccaaagtcgattaaaaaccagttctattttcagcaaagtaacatctatcaaaatagtaaacttctggacagctgccagtcctttcaggagtgcaattacccatgtatccacatgctgagccaatggccaggatagccagtcaatcattctgcaaagggcttgggtcatacttgcatcttttacatttggatccgtagtaaggctcctgatgagaactgtaatcatctgaagaggaatatgctgcacaaggcttgccaatgctacagaaggttcaaatgatgcatctgtggaagagatgcttgcaaaaacttcttgcagggaaggcagtagtgtggcaggctcggccttccagatgttctgcagcaagttactcacttttgtcacctgggagacatattcccgcagctctctttcctgggtggacacgcactggaattggcctatcgttcgaaccagctgtgtcgac

SEQ ID NO: 493895 - DNA, 363 bp, Homo sapiens
  misc_feature (31)..(31): n is a, c, g, or t
  misc_feature (69)..(69): n is a, c, g, or t
  misc_feature (181)..(181): n is a, c, g, or t
  misc_feature (226)..(226): n is a, c, g, or t
ctgtcccgcgttggccaaatctcccggaacnacgtgggcggccagcgcagcctggtcaacaagtggacnacgttcctaaaggcgcggctggtgtgctcggtgcccggcgttaagggcgacacccactttgatcagctccaggatgtgtttttgttgtcctcgcgggaccaccggaccccgntgctttatgccgttttttccacgtccagcattttccagggctttncggtgggggtgtacagcattaacaacgtgccccgggcctttttgggaccctttgcacccaaggaggggcccatgccccagtgggtgttataccagggttgggtcccctacccccggccaggcatgtgccccagcaga

SEQ ID NO: 493896 - DNA, 1159 bp, Homo sapiens
  misc_feature (135)..(135): n is a, c, g, or t
  misc_feature (665)..(665): n is a, c, g, or t
  misc_feature (748)..(748): n is a, c, g, or t
gaccgagagggacggacggcccaaactggatgaatgctgactgcatgactgactgtatgccgactgaccggctcgtactgctattgctgattaggctctacgtgtggcggctgagaaggtgatggattccgtatngcgacaccatcaggccaatccatgagacaagacggtgaataataagacaaaggcaggtcaagcccctagttgattgttggagtatctggaagtgcatagctatccagatatcgtgtcgacaaggagacgtcggaatgcataggattaggcccgttcgtacataccgcatgcacctttataactaaccagcgtatatgcataccagagggttacatacaagacgactaggaggcctctgctcatgaggtggctacggccgaaattggtaagggtagggagcccataatctcaaattggaggtcagccgaggcagcaaggattaaagaaatcgtctcagaaggaccattgcggttgaacttacgcaatggggacttacgagggacaaaccgaacgctaagcacacattcgtggccagcggcaaccacctgtggctttgggacatccggaagacactttacacaaagaaaagccacatacaatgaaacattcccaattctttacaagcacaacacggggaacaaccagaaacngggtgattcgacgaaaagggacaaaacaagaggggggcggcaaaagccaatccaacacggcgcggccgagaaagaaaaggccnccccggaaagagggacccaacagttccgcacattggaggcgatagaggacacccccagtttcccaaagaagcaacgatgggcccccaaacaagtgacacaagggaaagcgccctttcaggaaggtggagaaagcccccaaaagaaatgagcgttgtccaggcacagtgaaacccccatttttaccacgggaaaacatcaagggcaaaggacacgattgggagccacattttttccccaaagagggaacatcgtgaccgacaaggagttcaccacaccacacggagtggctcatataattattcccacataaacacacgcgcgcatcgtctggtgcacacaccacacgggtgaaagcggaacgcggtcctactcgtgtgacgaccacgtctctcgtcgacagcggaccacaa

SEQ ID NO: 493897 - DNA, 161 bp, Homo sapiens
gaaaggtctccgtcccaggaagcgggacgatggcagttcaattcttagagcaaccgtcgaatccacacctcctggaactcctaccccaattgaaacaaggataaaatccactgaacatggagggcccattgctggcctgaactattttggtcgtctttttt

SEQ ID NO: 493898 - DNA, 318 bp, Homo sapiens
gatggtgttgtctagagcactggcattggcgtgacgagggaacagcacaaaggtgatgtcaccaatgttgtcacccacagcggagtctgtgtcttttagctacagaggaggttccttgttgctaaagatgacctgtggggctgtgtggttgggtgtgcgttcttctttgaactcctgcatgaacacctttccaatgaccacataagcgttattcttaaacactgtgctgaagactactgtgactatgtcctttttaaactcaacatacatggtctcatcatccgtataatggataactgccctgttctatacttcctt

SEQ ID NO: 493899 - DNA, 368 bp, Homo sapiens
acatgttgatgggcatccatacggaaagtcatccaagaacagatcacaagatcctgggcagggtggatggtaaataggccacatcctgggggtcttcttattaccttcatggagctgataaaaaccccagcgttaagttcgggaaccatgaattggtacagggtgccccaaaaatcgaaaagtaatcccagtcggtcgcacagtgctgctggggacagaagcaggcccagcaagtaagggaggggacgggtgccagttagacaaaacggcttctctgtggtaggtgtcagtctagaggtctcacggcaccggagtcataacgggacggaagaatcctttcaactcttcctggattcccgtagggttcc

SEQ ID NO: 493900 - DNA, 209 bp, Homo sapiens
gcgaaaccactagttaatatcttgctgagagaaaccccgactcattttctaatgtcggagcccattccagatgtatcctagaaacacctgcgtccatcagcaaactatatgacactcaagattttgtcacgtacaaaccacagatgttccacagatagaaagtcagcttattatataaccacaagcacagcactagcattgtagctttt

SEQ ID NO: 493901 - DNA, 393 bp, Homo sapiens
  misc_feature (319)..(319): n is a, c, g, or t
gaaagtaataatggtcgaagtaggtctcatcattcacatacacagtaaagcacgtaaacactgttgtagtcgtataaacttattatctatcacaacgccaatattaacttgcgagaataatagagccactggtttaatgtttcctcaagataggtttatgtgtaagctagtatcctgtgtgtacgtagaaatgattcaatacctgcagctggcgaattaggaattgtatttgttgccttttttatattagatgaggtgcaaaaattttaatgctagtcagtatgcaccaccacaggaaagttagatcccattagcactngaaactacagttttggaaacttaggctaagttaatttgatttgttacttgactcacctactgaccttttctttt

SEQ ID NO: 493902 - DNA, 308 bp, Homo sapiens
  misc_feature (131)..(131): n is a, c, g, or t
  misc_feature (286)..(286): n is a, c, g, or t
  misc_feature (299)..(299): n is a, c, g, or t
ctcgatctccgcaaccttccgcgccgtcaacaagacagcactcaacaactccggatccgcctccgccaactccccgacgttccgatacctcttccgaggcaccacgagcacatgcacccgcgcctgcgatntgatgtcccgaaacgcaaacgtggcgtcgtcctgatacacgacgtccgccggaatctccccagcaataatccgctcgaacaacgtctccgccgcatcgctcatacgcgacaccctacaaacccccactggccaaggcgacgaacacacgccacgnaaccaccccactngccaaggcg

SEQ ID NO: 493903 - DNA, 197 bp, Homo sapiens
taaaagggagtcgggctcggtcgcccaaaggggagtgcgtggcgcaatctgggctcacggaaagctcggcctccggggttcaggccattctccggcctcagcctcccaaatagcggaaattacgggggtgcccaccacgctcgagctaatttagggtaatgctaagagatcagggggaatcctctaaaagtcgcacc

SEQ ID NO: 493904 - DNA, 165 bp, Homo sapiens
cggagacgagaactgggccttgctactatactgaaactgactgaaaaaccaacgaaagagagctgggtgtggtggcacgtgctgtggtccccgctccccgggaggcttgaaaggaatcgctgaggctaagagtatgaggctcccgtgtgctatcatcacatctgt

SEQ ID NO: 493905 - DNA, 844 bp, Homo sapiens
  misc_feature (155)..(155): n is a, c, g, or t
gcgtgcagtgttgtaactaccccgtccgcgtgggctctaggaacagctcagctacagccctcgggtgccatccgtttaaatctgtggcattttcagagcctcatcgtgtcaggccttaagtgtcagctggcaggatacgtcataatctcacacgnctaaaaattacgatgaggtaacatgttccctgcattcttaatcgtgtaattgtcctgcacctaatgtggtacagtacaccaagtatagacttagtacattctgtgcactatacacataaaaacatagaacaaacaaaacagaaagaaaaaaaaagggggggcggaagccatatactatatgtcccacaggggagcctcgcggatgcagagagaaccgcacagaggatgtggtaaccagggtggtggtcccctatgtaggtgtgagcatcggtttaacatggtctatgctgtggcggcaggcgcaggtcatttaggacacgcctggtggtccatagggcgcgcaaaacatactgtgggggtactctgtggggggtatgttgtaggaggattgggtgaccccacgtaatttctacgtagtggtgtgtgcctacgcgatatattgggccaaaatatattgatgctccatataaggagtggtatagaagcctcgctgaggggggggtaaagatgaggataagaatgtgtgaagggggatgtcaatgggggtgggtctgtaacaatgaaggacaggggcatatcagggcggtttagccttggaaaaaacctctttcggggcaaaccaggggtgaaatattagcttatgtcatagcagttcttctgtgtctgcgcgaggggcattcggataataa

SEQ ID NO: 493906 - DNA, 172 bp, Homo sapiens
cctccaggtaccctcctccccccctctcgaaaaccctagcttcgattcctggctggaacgctccctctaccggccccctgacgcgcgtagaatttgattacagtcatgatttcaagaaaagcagcttaggacagtaagaatcaggagaggcctcttcactctctgcccagga

SEQ ID NO: 493907 - DNA, 147 bp, Homo sapiens
ttttttttgttcaaaaaagggaaagggccaatttttccccaaaagtctttttaaaacaaaaacaacccgttttctgtgaaatccccaaaaatgttggaaaagtttgtttccattttaaaaaaaatccataaaaaccccccaggggga

SEQ ID NO: 493908 - DNA, 470 bp, Homo sapiens
tgttgtatgccacagaaataaccagatttccttgacaattgtatatttaatgtgtctttgactagaatgtcttaaaaattttatcatctacaattattgttttattggattcttctcaaaaagcggcttacagtcaactacagtccaaaatttgctccttggaagactcctgaatgcaggtttctgatgatgtcagaaagactgtgctgttggattagacagaaaacttctaggactctaattaaaaggctgatgtggtcataaagattgctaacccagtatgaagcaaaacaagagttaattgcatggactgagctaatagaggactgaactgattcttttgtggcttttttggtttgaaacattgctgattctttttgttgttcagtgtcaaattttttttctcttgagctatttgtagcccttaacaattgagtatactcttgtaaataaaatttaaagcagaaaaa

SEQ ID NO: 493909 - DNA, 242 bp, Homo sapiens
aataccccagaatagtagacatttgttatccctatgttcatgtggacagccggagcctagaaatgttaagagattttattccaggtcttataattgctggttgctttgctagacatggcgtgggttagcctggctgagtgaactgtttggccatttacttttcctgagtgacagcagtttattttggtctgatctcttgaataatgcattctgaactgttgccaggttatactttattgctt

SEQ ID NO: 493910 - DNA, 186 bp, Homo sapiens
tagtcctccgggggtcagcttgcggccggcaggtgcggttactcaaggtccgaggtttctggcaaggtacaccttttcttctaggctttcagagccctttatcatggtctgctgaatagtttccaaggtacttagttgtatgtagaggagcagagcagggaaaaaggagtttaaccattttattca

SEQ ID NO: 493911 - DNA, 991 bp, Homo sapiens
cggatggtgccataggttcgaggccggcggttaagttgagcggaggcttcctcttccttaataaccacccacagacatctgttgccaacgcatcgttgcacttcagccttcgctccgtctgttttcgccttagcaacccatctctttccaccacaaacctgagcggcccgtgctcggcgtcggcagcctcccgtcagtccctctcacgcttatctcctggccctgaagcacatcaaggtttcagcagacagctgtcttcaaccagcccactggcccgcatatcctaacgtcccagatggtgtcctcgaagaccgaagccaactttcctttcgtgcccgacagaagctcaagcccaggtgtcgccgtctacccccttaccctgcaccccaggagctcacccagcccctcctggagcagcccagggccccgtgaggcccctgttcgagatgccccaaggcagcctcctcactggcacagtcagactttcagcttctcccggcccagggctcatctgtgaccaagttcttcccagatgtgggctattagaccacgctagttcccatgaggccaaggcgcctgtaatataccctcaacaggttgcctctggtgcaatgaggttcccgagaactgcaaggacctctattgcatttgagcacgcagcccgtattccaactgcggggagtctccccgaaggagccatccctgccaagaatccaggacaccaagcctgttccaagagagcttcaacagtgcgcgggaagggcgtggcctgaggtcagcctggagacgtgaacactcccatttccactgggaagcagcgcgcttgggggattgaaccccaggacgcctggagggggtcaacactgttaacgtgactccagccagggcttgggggaccccataggggaagacacagtacacaggcggcaccccgtgaaacgacggggggcgccacagaaggtcacggcaagcccagagaagcgcagataag

SEQ ID NO: 493912 - DNA, 299 bp, Homo sapiens
tgacgaattactccctcaacatacacttagaatggtataaacttcttataactgaaggtatgagaaaaactaaatttgtcatctgctcttcaggtacgaactcaaaagaaaccccctttttctccatgaaacttacagttctggagagatttctgaggcgatcctgatgtagttgttttcggagatgctgaatttatggaagagcacccactccggcatcttcttggtgacagagtaacaagacagggggtgcagctgtgctacctgcttgtgtgtcagcatcaggtagttccccgagc

SEQ ID NO: 493913 - DNA, 428 bp, Homo sapiens
  misc_feature (69)..(69): n is a, c, g, or t
  misc_feature (89)..(89): n is a, c, g, or t
agccacttggggacctggttgccttttctatcttctgtctggtttctgtctggtgtctgtctcttctcntgcctctgtcatgtcccccnatccttctttgttgtacccaccttccttcagtgctagaacagaacagcgtaacttatgttcccattgttaagacttcaggcctaaccaacaagtgtctttcctttctcctggggagggcggcctcttttgcctcctgccctgaaaatgccatcatactttgggtctccatagtgggttccctttgctcagaagagcaggctgctaatgccaccaagggcctggccgcagtagcctctggtgcctgtggggagccgaccctgccatgatctttcttgttctctttttgatattttaagactcttaaaattttagatactctaaactttaaaaaaaaaaaa

SEQ ID NO: 493914 - DNA, 544 bp, Homo sapiens
cggcacgagggttggtggaataacaataaaaagactgcaaagatggctataattttcagagttaaaaaatgcaaaccatactgtggcaaaaccttaattctgagcccactaaatcaaaacttgtatacaaacagcagctacccctatgctcctctgccagccagataaaatgtcagggtatgaaggctcagctgatgaaggagcacaaacgggttctcagtcatcttggcagggcctgttctgcaggctttatcaagcccagatggtctttatccacccgtgaacctccttgtgcagagtgaggcctgatggccttggccctaaaatcaccagacctggcttcaaaccccagctggcacattttccagaggtgcaaccttgcacctccatttccttctgtgtaaaacagagataaccacagctcctacctgcccaggctgctgagaggaggtgagatggatacaatgcaggaacacagcggtagcacttactgtatttttttattgttattatcttacctttttttctgatgttggagcgcccg

SEQ ID NO: 493915 - DNA, 145 bp, Homo sapiens
aaatcgaaggacaccacatcctattgctgagaccgtaggatgttaactgtagtggacaagaagtcattgacatgttaataccagaataaattatctttagtggaaggaataggatactaccaatgctgactcacagttattctta

SEQ ID NO: 493916 - DNA, 1068 bp, Homo sapiens
  misc_feature (1068)..(1068): n is a, c, g, or t
gtgggaacactgtgtgcggctgctgcaacggcaggacttgggccttagatattcctaggtagagtgttcgtcgtggagtagccgcctgggacaggacttgtaaacagaggttaacacgagaaatctgcctcctgggccatggccgttttcatagagcgcctgtgttcttgcatctatgagcccacgagtacgaagacaggatgggccagttccgtcacagaggatagcttggcctgcctgagcaagaagagtgggatacgtgatcttgggatctcgtccatcaccagactctgagccttcaatgacaggcaggctgcaatggacacgggaggtacactggacccctgcatgaggggcactcgaagatcttgcatgctggggagcgggggaggggatgccgtggtaatgccacctgtaacacgtccagcatgaccaacctgcgagcagaggcatcatgtccttcagaacgaggggaagaatcgtgacctctgatcaagaaagcacagaaggaggagacgctgtgggaccctaagtgcagaggctcaatcgtaacacagcggatgccttgcggcggttggttgcaacacactcggatagggtgcagagagagatgtcgaggagcacagccaaggacgcgaccgttaccgtgtatccatggccactcggggcatggatgagccaggggaaccctggaagcagacacgcaagggagaaaccccggttaaccctttttctgagaagaactggccagtgttgacagttgagaatggaccaatttggggaacctagacctgtggccaacttgtgggacaaacgttggaggaactcttgcgatcgaaaggggaaaggacagtccgttggggagaccacccccgcaaccaaaagggccgacgagcagacgagttcctggaccacaaattgggagagcgcatggggaacttaggggagagtagggatgaaattccaataccagcccgaaacaccggccactccgggagaggacagcgggccaaacgcaagcgggttgccgtggacagccaaaaaagacccaaacgaggcccacagggn

SEQ ID NO: 493917 - DNA, 175 bp, Homo sapiens
aaaaaaaaaaaaaaaaattctggtagagacagaatctcgctattgtggcccaggttggtttcaaactcctggcctcaagcaatcctcccacctcggccccccaaaggtgataagataaggggcgtgagtcaccttgggttggaaactttggattgagaattaaaattataaatta

SEQ ID NO: 493918 - DNA, 387 bp, Homo sapiens
aagagatgtacgaatgttttcaaaaccaagtatcacagtttaatgtacatggccgcaccataatgagatgtgagccattgtgattgtggggacagagggagagagatgtaattttacaatcatgtacccccataaacatggctgtaaacccactgcatgcagaaacttgaatgtcactgccagacattcatttccagagagaacctatcccaaatgtggaattaactgcctatgccaagtccctgaaaacacagcttcagtatagtggggctcattcacacatgaatcaagcaatccagcctcatgggaagtcatggcacagataactgtcaagcccttgcacagctggagaaatggcatcattatcagctataatgacttgtatct

SEQ ID NO: 493919 - DNA, 106 bp, Homo sapiens
tggggacgagggggacgaagactggagggacctccctcctacaagctaccgatcccaaaagcgacgctggaggcgacagtgagatgccctcccagctcttcactcg

SEQ ID NO: 493920 - DNA, 415 bp, Homo sapiens
gaaatgaaatcaacccgagtgcaggggaatggaatggaatggaatgcaatggaatggaatcatccggaatggaatggaatggaatggaatgcaaagcaatggaatcaactcgattgcaatggaatggaatggaatggaaaggaatacattggaatcaacccgagtggaatggaatggaaaggactggaatggagtggaatggaatggaatcaacccgactgcaggggaatggaatggaatggaatgcaatggaatggattcaacttgaatggaatggaaagaatggaatcaacacgagtggaatggcatggattggaatggaatggaatggaatcaacccgagtacaggggaatggaatggaatggaatgcaatggaagttgatccggccgcgaatttagtagtagtagtcgacc

SEQ ID NO: 493921 - DNA, 2187 bp, Homo sapiens
  misc_feature (567)..(567): n is a, c, g, or t
  misc_feature (601)..(601): n is a, c, g, or t
  misc_feature (620)..(620): n is a, c, g, or t
  misc_feature (623)..(623): n is a, c, g, or t
  misc_feature (721)..(721): n is a, c, g, or t
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatgtagtcatgtttgttgctgagcagtgagttttggctagcttatggcaaggngatttaatagacgttaaagttgagtagcttaggnatttcagtagttgtaaatngcnaatgaattaatgttttcttcctagagaccttcaaataatttaagcccatcttaaaggtggaaatgaagtacttccaaaatgttaactttgcctatatntagtattatagttcagagtagatctttcattgaggattgccctcaacagcttaactactttcctcacattggtgtccagctaagtacctcaagttaaaggtaagatccctttaccagcagatcatcagtgcgatgaattaggttgttgtaaattatggcaagtgtctgtgttgcaagagacacgtatttgggtcatgtgaccagaagcatctaatggtctaattctctttaatgcaaaagtcggtttatgaaagacttggtttaacctgtgtggtataaacttactgaaaatcagatgtagtgagagtagtttgaatgcttgtagtctcagtatctgaaataagtgttttgaaattgttcctgggcctaaagtatttgaatgtttttatgctgaagagctgataagattgcatgtttaacaatgttagataagatatcgtatattttaagtattaatatttatgatgtgatacactggaagcaagaaatcctttcatggtttagtgtagtatgttaaaaattgatatatgtatcgagtcctaatgtcagaatttttaaaatcaagtctgtttgtttgacactaaattggtgagaattgaatgctgtcaacgttaaatatgaacataatttcatatcttctaggaaagtgctttaagtcctttttgtaagcttgggaatgtatccacggaaaggatttttcatagacggaatttccagaagtgaatcataactactgttagagcataagcatgcatgattgtgctgtgtagatcagttttgttgaaagtttagattgttgtgtttgtcaattataatttaatgtttcagtttttatatgaaatgttgtaaatgtatacctttttaaaaacttgaagttccaataacttaaagcattgaaatataaaatgaggtaaaaggtgttttgaatttagtaaaactgttatttaatgcttaaaacttaattgaattgtataattctcaacattaagttgcatagatatgtgttcttaagttgttgaattcttaatgcatcctgtgttcagcaagttttttttaatatatactgtaccatgggtgtgttaagaatagttatactttataataatggaacttcatattattgcaatgcatatttaaagagtacttgttgaaagcataccattcacctaaagttaaaaattctggtttatttaaagctataagaagaatcatttctgggcttgtgatgttaatattgcccccctactggggttatttgtccttgggttgaagggttggaaatcgtgccaaatgggataacattgccggtggacttccaggggaggagtcaggtcacccgagcctttaacaaaaatacggggatttagttaaaacgttaaaatactggccgtgcatagtaaatcacgcctgtaatcccggcactttgggaggccgaagggcgtggatcacactgtgagcagcgttgg

SEQ ID NO: 493922 - DNA, 2007 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaaggtttgatttacattgccctagttacagtaaataaagcattaaacaatagaggtctcacccctcctgtaaatatagtttattgtcttttgttatagcatccataagttctttctgtagaggtgggtctccatttatccagagtccactggttgggttattaccacttaaaccattagtactatgctgttttttatacaaaagcacataagctgtgtcctttggaaacctgctcgtaattttctggactgactgaaatgaagtaaatgtcactctactgtcattaaataaaaaccattcttttgacatttccttattttccaaatcctgttcaaaaactgcactgggactatctctccctagtaaatgactctgggaggatgctaatgccagagcctcagactggtggtacatctgatatgaagagtctgtacttgtgatatttctggcataagaatagtaatgcccactttcagaggatataccagagtgaaccacaacggaacttaatagatagggcaccaattttgtgcaggaagcttcatcagtccctgaaggctttaattttttagcaaggttctcactaagatcagtgaagtcaacatctacagaccaactttctgacaatgaagagaaagaagtaattcttttaactggcaactccaaaaccagtggcagtgatacattgtctaaaattttccttctcacatgatacttctgatcatatgaaaatctcaggagagtaagaataaggtattcaggttcctccgtgatttgcatagttttctcagcattttgcagagaggcacagttttcacaataatattggttatcaccagtaagaatctctggagccaaaaaataatttagtaagtcagttactgaaggtgtggtttcacctcctggtttctgaggtacatctttattaacaagaatcttgttagattcgttagggacagaagtgttttcagaacagtaaaactcattaggaggactgcctatggttttttcattcacaagtgagtcacagatgaaggcagctgttgttggattataaactactggttcttctgaaggaccgggtacagaggcttgcattagaccaccatcttgtatactgggtgatgatgctggatcttggacagacatgttttccaaagaagaggaaggacaaaaggcaagcgaaagatctgtaaaggcttccactttttgtgaggtactcctgcagttcaaacaacgtatgtgagttcgtagttttcctccaaacattttttctattaaagtcttctcaccgtcacttgtacgaggggtctctgttagtactgctgctttactagctacttcctgtaaagaagtttcactgcattccagaatttcagaaggcttgtgtgaggcctgaactttcaagatcttttcttcttcatggagcctgcagcagaggatatcattatatagctacttaaattaacttcaaatgtcatttctatttaaaaatattagtggcttctataaactattctaatcaaatttaatgtaaacaaatcaggtttttcctgttttaattaaaagaaaattgaacagttttgagatgcagaaaaaaagctgggtggctattactactctatattctcatacactttct

SEQ ID NO: 493923 - DNA, 2871 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaaggtttgatttacattgccctagttacagtaaataaagcattaaacaatagaggtctcacccctcctgtaaatatagtttattgtcttttgttatagcatccataagttctttctgtagaggtgggtctccatttatccagagtccactggttgggttattaccacttaaaccattagtactatgctgttttttatacaaaagcacataagctgtgtcctttggaaacctgctcgtaattttctggactgactgaaatgaagtaaatgtcactctactgtcattaaataaaaaccattcttttgacatttccttattttccaaatcctgttcaaaaactgcactgggactatctctccctagtaaatgactctgggaggatgctaatgccagagcctcagactggtggtacatctgatatgaagagtctgtacttgtgatatttctggcataagaatagtaatgcccactttcagaggatataccagagtgaaccacaacggaacttaatagatagggcaccaattttgtgcaggaagcttcatcagtccctgaaggctttaattttttagcaaggttctcactaagatcagtgaagtcaacatctacagaccaactttctgacaatgaagagaaagaagtaattcttttaactggcaactccaaaaccagtggcagtgatacattgtctaaaattttccttctcacatgatacttctgatcatatgaaaatctcaggagagtaagaataaggtattcaggttcctccgtgatttgcatagttttctcagcattttgcagagaggcacagttttcacaataatattggttatcaccagtaagaatctctggagccaaaaaataatttagtaagtcagttactgaaggtgtggtttcacctcctggtttctgaggtacatctttattaacaagaatcttgttagattcgttagggacagaagtgttttcagaacagtaaaactcattcacaagtgagtcacagatgaaggcagctgttgttggattataaactactggttcttctgaaggaccgggtacagaggcttgcattagaccaccatcttgtatactgggtgatgatgctggatcttggacagacatgttttccaaagaagaggaaggacaaaaggcaagcgaaagatctgtaaaggcttccactttttgtgaggtactcctgcagttcaaacaacgtatgtgagttcgtagttttcctccaaacattttttctattaaagtcttctcaccgtcacttgtacgaggggtctctgttagtactgctgctttactagctacttcctgtaaagaagtttcactgcattccagaatttcagaaggcttgtgtgaggcctgaactttcaagatcttttcttcttcatggagcctgtcaaggagaaatctgaggtattcagaacagtcttgctgtgatctgggagtaaaccatggaggtctggaagcctcaaagaatatccgaggtgcgtatgcttccctctgtgtatgggccagaaaggcaaaaagatgctgtaattttttcattaatgaattgcacccatttagatttaaagataatacttgtctcctgaaatctgtggccataaacaaggcttgtataacactgttcatataacatgtatttcctaggttaataagaccagttttcccagtttcagattttccagaaagtctagacaagcaagacgccaaagaattggattgagaagtccaggcactttgattgagaattaacttaatcttctcttcactgggcttaggaaaatcctttattgcctccagaataggttcatagagatctggaaatccagaataatgatacatcatacagtgtatcaattctgttaattgtactaagaaggctgtacttgaaggcagaccatcatttttgaaagaatgaaccaaattaaccacatgaggaacaatcaaatggaacgcctctggagaatgctgaaagctaagcagcatgtgagaaagaactgcaagagcaccaggtctcacaagaggaaaccaaagtcgattaaaaaccagttctattttcagcaaagtaacatctatcaaaatagtaaacttctggacagctgccagtcctttcaggagtgcaattacccatgtatccacatgctgagccaatggccaggatagccagtcaatcattctgcaaagggcttgggtcatacttgcatcttttacatttggatccgtagtaaggctcctgatgagaactgtaatcatctgaagaggaatatgctgcacaaggcttgccaatgctacagaaggttcaaatgatgcatctgtggaagagatgcttgcaaaaacttcttgcagggaaggcagtagtgtggcaggctcggccttccagatgttctgcagcaagttactcacttttgtcacctgggagacatattcccgcagctctctttcctgggtggacacgcactggaattggcctatcgttcgaaccagctgtgtcgac

SEQ ID NO: 493924 - DNA, 273 bp, Homo sapiens
tggcgaattcggcacgagggccacgcagaagtcgcgtgtctaggtgagtcgcggtgggtcctcgcttgcagttcagcgaccacggtgggtaccgtttttgcgaggattgtttgtccccatatctctgggagggccacggggaccttggcgagctgcaggctgccgtcgagagccgcgagtggttcgctgaatctcggcaccgccgctgaggcctgcaggccgcgccgactctattgtgtgagaagtcggaggaggcggagcggaagcggccgc

SEQ ID NO: 493925 - DNA, 110 bp, Homo sapiens
aatgtctctcactgagcagatatagcagaatcgtgagctgagtatagaatctaaacatagaacaaaccctattgataagaatctgcaatatgctgggatagtaaatgaaa

SEQ ID NO: 493926 - DNA, 872 bp, Homo sapiens
ggccctgacagattctcctatcggggtcgcgaggtacgctcagatgggtacctggacggtttcgttgaccatgctgtcccgggtggtactttccgccgcgccacagtgggcccctctctgaatgaatgcaggcgcattcctctaggtccaggggcgtatatgctaagggcatacaaggcacgcttttcattatcacgggcgtgtgcaactactcgtttgtgcctgtcacaccacgctctctcgctgagctacggatgggaggaagagcttcgttgatggacgtagagtccgctgagggaattcttccagatatgtctgtctagtcctaaaacactggtgtatagcaggaccctattggtactctgggaactggtgcttatcttgtacgccttatatctcgagacatgaaatattattgtgagttagtcgcatgacgaactttctactgctcctagtcatgaatatcgtaggtgtaggctgggtctgatggaatgatataaaatatggtcccttttttggttggcagaactctggtgatcaggcttcggatgacgcaagccaagctgtgcccaacctaagaagaggcgacggcaggcttgccatgcacaaacagcatccagaatgctaattcgatgactgggagcaatgtgcacagcgtgtgcactgggtattcgagatatgccgccatcaccttttaggagtgtgcagtggaataaacctgtgctgagggttgtgggaacgtgacttagccggagaactactgtttagagtggtgtccaggaggaaacgaatccgtcctggacaatgcataattatgctcgtgcgaaaacatgatgtggtcaaagtgaacaagaacccatgataaatcgggg

SEQ ID NO: 493927 - DNA, 224 bp, Homo sapiens
cagggtccaccacgtcgggatgtgcgcccagccctcttcgcgatcgccttcgctcagctcgatgacaccttcgatgacttcgtagagcatttgcccggccatcgccacggccatcagcacgccaagcggtggcaccgccatggccaccaggttgagaccgaacaggccaatgctcatgtaatgcgcggcgcgcagtgagcgcgaggcctcatcgacatctgcgg

SEQ ID NO: 493928 - DNA, 199 bp, Homo sapiens
ttacatgatacaatcgagctcggtaccgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaagcttgatg

SEQ ID NO: 493929 - DNA, 502 bp, Homo sapiens
tgaggacaatgaggaccgcactgaaggcagtggaaacaaacgcttccccaatgtcatacgtgatgcgttagatatactagacatgtatacatacgagatgcattctacatacagcgtagcggcatgccgcaagcatacgctgtgcttttcataaacaaaagcagtgaagtctcacaacggccccggaggggggtcagtcatatgatcctcaccccatgtcacagatgacgaggtgaggcacggaagggctgagggtggcaatgggacggaagccgcagtggcctggctctggccccctcccaatccatctgcactggccaggactggggtgctggacacagggcagtggggtgtgggcggcgtgtgagtcgcagggccggttccgcgggttcagggcccatcgggattcaccagcagcagcgccaggctctacggtcaggaccagatgggccttggtcaggcggcctgtggcagggcccttggcctggagcagccctccgag

SEQ ID NO: 493930 - DNA, 397 bp, Homo sapiens
  misc_feature (49)..(49): n is a, c, g, or t
ctccgaccactgcgccctgcctattttcatattgaacttttaaattagntttctttatggtggcgggatgattattgtaattatacttgggaacagaagtgatgaaaaaggtatgttacttgagatatgggaaacgctattttccatgtttagttatggggtattcaagtctaactagtggaaagtatggatacattttatttatttttttgagacggagtctcgctctgttactcaggctagagtgcagcgatgcgatctcagctcactgcaacttctgcctcctgggatcaagcaatttctggctaatttttgtatttttagaagagacggggtttgaccatgttggccaggctggactaaaacacctgacctcaagtgagctgcctgccttcac

SEQ ID NO: 493931 - DNA, 1567 bp, Homo sapiens
  misc_feature (438)..(438): n is a, c, g, or t
  misc_feature (452)..(452): n is a, c, g, or t
  misc_feature (454)..(454): n is a, c, g, or t
  misc_feature (468)..(468): n is a, c, g, or t
  misc_feature (471)..(472): n is a, c, g, or t
  misc_feature (474)..(474): n is a, c, g, or t
  misc_feature (481)..(481): n is a, c, g, or t
  misc_feature (511)..(511): n is a, c, g, or t
  misc_feature (534)..(534): n is a, c, g, or t
  misc_feature (546)..(546): n is a, c, g, or t
  misc_feature (574)..(574): n is a, c, g, or t
  misc_feature (591)..(591): n is a, c, g, or t
  misc_feature (593)..(593): n is a, c, g, or t
  misc_feature (612)..(612): n is a, c, g, or t
  misc_feature (615)..(615): n is a, c, g, or t
  misc_feature (620)..(621): n is a, c, g, or t
  misc_feature (625)..(625): n is a, c, g, or t
  misc_feature (627)..(627): n is a, c, g, or t
  misc_feature (639)..(639): n is a, c, g, or t
  misc_feature (646)..(646): n is a, c, g, or t
  misc_feature (1174)..(1174): n is a, c, g, or t
  misc_feature (1354)..(1354): n is a, c, g, or t
  misc_feature (1367)..(1367): n is a, c, g, or t
  misc_feature (1455)..(1455): n is a, c, g, or t
ttagacatccttccgtgatcgccttgactccagggggtctatatctcagggtgttctccctaatttatgcgtaggaagactgtgttctaatagtgcagaatcacagtgtggcgccgtctgtaaacatattgttcagaggtagcaggttatgcacgctggtatcaactgtaatgttgatgtccgaagctcctagggtaaccccccttggggcaacaaagattgggcacggaattttattaaaaaagtccggtgtatgtatcatcagaatttcttcggaatggatccagatttagcccatttgaggctactctaaagtcagattaaccggcattataactggaataactttaaatacctgttcctttttagatgttcttatccggctgctcccctatcagacctcatcttcggtaatgttattttttgtttacctccctncattcatcacatgntnattgaaaacttagntcnncnagtttgncaatactgcttttagaactgtaagtagtcnaagaacgttgcccaagatcaaanttttaaaaaaanaaatgagcatgtgatatgtggcaatgtnttcactctacttggtantnagactaaaccattcctcantgntctannatgntnaagaaatcattnagggggnagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatanactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatganactggcagccctngagttcatagatggacttttgggacccagcagttttgaaatgtgtttatggagtttaagaaatttattttccaggtgcagcccctgtntaactgaaatttctcttcaccttgtacacttgacagctgaaaaaaaacaacatgggagtaataatgggtcaaaatttgcaaattaaagtactgttttggtgtgggagttgtc

SEQ ID NO: 493932 - DNA, 1593 bp, Homo sapiens
  misc_feature (438)..(438): n is a, c, g, or t
  misc_feature (452)..(452): n is a, c, g, or t
  misc_feature (454)..(454): n is a, c, g, or t
  misc_feature (468)..(468): n is a, c, g, or t
  misc_feature (471)..(472): n is a, c, g, or t
  misc_feature (474)..(474): n is a, c, g, or t
  misc_feature (481)..(481): n is a, c, g, or t
  misc_feature (511)..(511): n is a, c, g, or t
  misc_feature (534)..(534): n is a, c, g, or t
  misc_feature (546)..(546): n is a, c, g, or t
  misc_feature (574)..(574): n is a, c, g, or t
  misc_feature (591)..(591): n is a, c, g, or t
  misc_feature (593)..(593): n is a, c, g, or t
  misc_feature (612)..(612): n is a, c, g, or t
  misc_feature (615)..(615): n is a, c, g, or t
  misc_feature (620)..(621): n is a, c, g, or t
  misc_feature (625)..(625): n is a, c, g, or t
  misc_feature (627)..(627): n is a, c, g, or t
  misc_feature (639)..(639): n is a, c, g, or t
  misc_feature (646)..(646): n is a, c, g, or t
  misc_feature (1200)..(1200): n is a, c, g, or t
  misc_feature (1380)..(1380): n is a, c, g, or t
  misc_feature (1393)..(1393): n is a, c, g, or t
  misc_feature (1481)..(1481): n is a, c, g, or t
ttagacatccttccgtgatcgccttgactccagggggtctatatctcagggtgttctccctaatttatgcgtaggaagactgtgttctaatagtgcagaatcacagtgtggcgccgtctgtaaacatattgttcagaggtagcaggttatgcacgctggtatcaactgtaatgttgatgtccgaagctcctagggtaaccccccttggggcaacaaagattgggcacggaattttattaaaaaagtccggtgtatgtatcatcagaatttcttcggaatggatccagatttagcccatttgaggctactctaaagtcagattaaccggcattataactggaataactttaaatacctgttcctttttagatgttcttatccggctgctcccctatcagacctcatcttcggtaatgttattttttgtttacctccctncattcatcacatgntnattgaaaacttagntcnncnagtttgncaatactgcttttagaactgtaagtagtcnaagaacgttgcccaagatcaaanttttaaaaaaanaaatgagcatgtgatatgtggcaatgtnttcactctacttggtantnagactaaaccattcctcantgntctannatgntnaagaaatcattnagggggnagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatgtttgagaccctattttggaatacaaagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatanactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatganactggcagccctngagttcatagatggacttttgggacccagcagttttgaaatgtgtttatggagtttaagaaatttattttccaggtgcagcccctgtntaactgaaatttctcttcaccttgtacacttgacagctgaaaaaaaacaacatgggagtaataatgggtcaaaatttgcaaattaaagtactgttttggtgtgggagttgtc

SEQ ID NO: 493933 - DNA, 1106 bp, Homo sapiens
  misc_feature (438)..(438): n is a, c, g, or t
  misc_feature (452)..(452): n is a, c, g, or t
  misc_feature (454)..(454): n is a, c, g, or t
  misc_feature (468)..(468): n is a, c, g, or t
  misc_feature (471)..(472): n is a, c, g, or t
  misc_feature (474)..(474): n is a, c, g, or t
  misc_feature (481)..(481): n is a, c, g, or t
  misc_feature (511)..(511): n is a, c, g, or t
  misc_feature (534)..(534): n is a, c, g, or t
  misc_feature (546)..(546): n is a, c, g, or t
  misc_feature (574)..(574): n is a, c, g, or t
  misc_feature (591)..(591): n is a, c, g, or t
  misc_feature (593)..(593): n is a, c, g, or t
  misc_feature (612)..(612): n is a, c, g, or t
  misc_feature (615)..(615): n is a, c, g, or t
  misc_feature (620)..(621): n is a, c, g, or t
  misc_feature (625)..(625): n is a, c, g, or t
  misc_feature (627)..(627): n is a, c, g, or t
  misc_feature (639)..(639): n is a, c, g, or t
  misc_feature (646)..(646): n is a, c, g, or t
ttagacatccttccgtgatcgccttgactccagggggtctatatctcagggtgttctccctaatttatgcgtaggaagactgtgttctaatagtgcagaatcacagtgtggcgccgtctgtaaacatattgttcagaggtagcaggttatgcacgctggtatcaactgtaatgttgatgtccgaagctcctagggtaaccccccttggggcaacaaagattgggcacggaattttattaaaaaagtccggtgtatgtatcatcagaatttcttcggaatggatccagatttagcccatttgaggctactctaaagtcagattaaccggcattataactggaataactttaaatacctgttcctttttagatgttcttatccggctgctcccctatcagacctcatcttcggtaatgttattttttgtttacctccctncattcatcacatgntnattgaaaacttagntcnncnagtttgncaatactgcttttagaactgtaagtagtcnaagaacgttgcccaagatcaaanttttaaaaaaanaaatgagcatgtgatatgtggcaatgtnttcactctacttggtantnagactaaaccattcctcantgntctannatgntnaagaaatcattnagggggnagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggagccccgtgccattagctcctccatcttccgatccgtcgttttatataccgctcaatatataatgcaagtcggcaagggttgagtcctcgtttcatactttagttagtttttgtttcattttttttcaattaaagtgcataaaccttaaa

SEQ ID NO: 493934 - DNA, 308 bp, Homo sapiens
gtgctcagaacaccggtttctattaggcagcaagacttcaactacagcttccatatttcaacatatacaaaatcagctcaaactggcttaaagatttaaatgtcagacctaaacctacaaaactactagcccaacacatggagaaaatactaaaggaccatggtctgggccaatatttctttgtttaagacatcaaaagccccggcaacaaaagcaaacataaactgggattatgtcacgctaaaaagccttcgcacggccaaggccacaatcaacaaggtagctggacatggtagctcacaacatat

SEQ ID NO: 493935 - DNA, 401 bp, Homo sapiens
tctactacttttcaagctaaaaacatcacttgtatacatactcatacttcagtcacggttttgaggactctggaaatttatcgtggagtcaatgaggaaatcttgtttctaattaaatttggaaagaagactacttgcaaaataaaaagtcgttatcagcctgttcatatttaatattaatttctctgtcctccaggcaggtactgttaaaacaatagttcctagagactaaaaacaaccgtttgttgtctcattcctacttctcactgactgtgtgtgacaccagtgttcacgggagaatcccctcccatggttttcctcctgaataaccgtctgtgatttttctgaactcaaatgcaacgtcccaccagatgctccagtcaagagcatttagctgactt

SEQ ID NO: 493936 - DNA, 767 bp, Homo sapiens
  misc_feature (405)..(405): n is a, c, g, or t
  misc_feature (417)..(417): n is a, c, g, or t
  misc_feature (457)..(457): n is a, c, g, or t
  misc_feature (493)..(493): n is a, c, g, or t
taacgcatagccaacaaacacaaatacacctaacatctgctgcattcagtgtgtgtgtgtgtctcgctgcttacaatacactgtatctactgctagtatgtaaatggtcctctttgacgctgatagcgtggtttcgtgactcagacctataggtccgattgtcacatgcttcctgctgtatacaacactcattggcacagtggtagttagaggtgaaaagtatagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactncagggtcctgangctgtcatgctcagtgagccattttacagttctccaaagnctagccctgtttcggacctgcacttcacctctaagntatgtacaactcaacctgcatccctctaaaagacctatatccatattcaccattgggtaatatgaggccctgagcgggccttgaatgctaaaaagaggcaggagacgcagggctacatgcagataccacaccacggctgccggctggtctgtcgtaagacagaaagaaagacgctgggcccaattttgacttggccagcggacacgcttgggcgtaagctatctttatctgtgcggaggctagctgacccatctccttgaggcattccctttgg

SEQ ID NO: 493937 - DNA, 775 bp, Homo sapiens
atggtcttgattgaaagattgctaatgcaagtaatgaaggcagcagatgaggtagatgaaggtaaattaaatgatcattttcgcgtctcgtggtactggcgagacgtggatcagggaagctcagacaaagtatgaatgtaagagtgaagtcgattagcagagtatgagcaattgatagagtgttcatggatggtgaacttggcagcaagatacctgtgcatcccaacgactcatgtgaataaaagccagagctcaaatgatacttttcccacagcaaggcagcattgcgtgcgtgcaagtagaagttcatgaagtacgtgttaccaggactacagaagttgacatgatggtcttgatgcatgaatccaagagagttggcacgagatcatcaagattggacgtagtcatagtcaggatgctgttgcattactcttgggcaggaatttagtggtgatgttcaagaagtaaaatatgcaatgacaagaataagagctgccatgccaatgaatctatgagctcgcagctggaggcactggtgtcggatacagggtttaaatactagaatggggttggctgaagaggttgctgcgaaagtgggtgggcttagaggctgtgcttgtttgtcactgctccgaagtaacatttgaagctcgtggctgctcatgacgctcgggttgagctcagtggagccatgaacactactgcctgcaggtctgatgaagatagcctgatgatatacgatttagggggttctggtcctcggtcaggtctggga

SEQ ID NO: 493938 - DNA, 849 bp, Homo sapiens
atgcccctcatttacgaataaatattatactagcatttatccatctctactttctaggaatactagtatatcgctcagctagcactcgatactctcccttactatgcctagaaggaataatagctattcggcgtgttcattgataggctagctctcgagtaacccgtcgaacagccacgtccactcttaggccaatattggtgcctatttgccactactaagtctttgccagccgtgcgacgctagcgtgtgtggcctagccgcttactagtcgtcatatcatcgcaatcacatgatggtcgtagacatactgtacgataacgcataaagcatacgtccaatgcgtaaaactgaatcgtcccaacatattatcattactacctagtgacatgacgtcttccacagagaacgacataggatttggcaattcaatcgacaaccatcctcacagaccgtgaagtaattagtcatcatctcctcttactatttggtaaaccaatgtcaactgacaaacctatttagcttgttccgcgcaagcattttccttacagatcctctcggtagacatagacccttccttccctaattactaagttaccctggattccttatgccttctagctgtcatgtggaagtcacaaggcccatctttgatccaggtgatgccactaattaggacaattaactgtgtcagggaaggtccgctcagattgttaaggccgttgttcggcctttaaaaggattgttgatcctggcattgaagggagaattctaagtgaccttcaaggttgttcaaggcagggtttaaaaggttcctggagaaaggctttggaaaaccaaacgagtggg

SEQ ID NO: 493939 - DNA, 308 bp, Homo sapiens
cactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctggggaggtggaagttgcagtgagccgagatcgcaccactgcacttccagcctggggtgacaagaggcggaacttccatctc

SEQ ID NO: 493940 - DNA, 426 bp, Homo sapiens
ctgagggcttgctgtgcggatggctgctatggtgtgctgcggttcatcctggagagtggggcacaggctgcgcggttgtggtgtctgggaaactccgaggaccgagggctcaatccatgacgtatgtggatggactgatgatccacagtggagaccctgttaactcctacgttgacactgctgtgcgccacgtgttgctcagacagggtgtgctgggcatccaggtgaagatcatgctgccctgggacccaaatggtaagattggccctcagaagcccctgcctgaccacgtgcgcatagtggaacccaaagatgagatactgaccaccacccacatctcaagaacagcagggtgggaaggccagacgcgcctgccatgccccagacagtccccacagaataacagggtctccttggacgctgtat

SEQ ID NO: 493941 - DNA, 751 bp, Homo sapiens
agcgggagtgagcctgtagctgactggtggcttccggagaggctcgcagaagtgggaggtgccgggacgtggcgagagctgagcatctgccagggcgggcggaagggcgcggcctctccgaccgggtgtaccatctgtcgcgtgcgcgagagctctggtgaaagaaaagatgttgtcccggttaagagtagtttccaccacttgtactttggcatgtcgacatttgcacatacaagcaataaggcaagccatcttatgctgaacccaagaacaaacaagggaatggcatttactttaccacgaacgacaaatgcttggtcttcaaggacttctatctcccaaaatagagacacaagatattcaagccttacgatttcatagacacttgacgacacatgactagccctttggaaccacatctctctacactaatgggacatacaagacacgacacattgagcaaatctgttctcatagaatacctgcaagatgacatctgagagtctaatgcccaattgtatatacaccgacggttggtcttgccctgctcccagtatggacacatctttagaagaacctaaggggattattaatttcgatctcagacagaggtcatgttagatcaattgtggataactggccagaaaatcatggttaaggctgtagaagtgactgatggagagagaattctgggtctggaaatctgggtgtctatggaatgtgaattccaggtagaaaactttgtctgtat

SEQ ID NO: 493942 - DNA, 1496 bp, Homo sapiens
tctccccttctctctttggccctcacaacagggggagaggaagccaattcacatttttctcagtttattataacctgtggtgtggcagcccaactcacactgtgcagaagtgtgaaaaaggctttcgtggcagcccagcttctgtgcccagctctcacgtggtgcctttgagagggcggggggaggggtggtgtggccgcgctcgcccccgtgatgtgtgcaagaggcgccacggtgtgtgaacagaagaagaagtatccgtggatcgtggtcctcctcagcagacaagaggcgtgtggagtggtgtgagccgagatgacagagcgcgtgagactatacagagtgtgtgcgcaagagagatctcacctcgcgcgacaagaatcacgcgagcgggcggggagcaaagagagacacacacaggcatacacacggtgcgtgagcgcgtgcggagagaccaccacagaaaaagaggtggtccctgcgccgtgtgtctcaagagagacacacagagaggcggcgcaaggcccaccaaaaagaggattgtggagtgtgtagctatctcattatccccgtggtattttgttgagccacacatctcatcaacaagggttcccccacaaagtctagcgcgtactccaaaacgaatagaattctggtaaatattgtgagaaatacagaaactcccaacctacaaaaaaataggcaaaagaggcgcttattggaaaattatagatcgcgccccaaaggaggctcacattgtgagagaactccaaattaaaacaaaagatcgagggccgcctctgaaagacgcaaccaccccagaacatacaaagaggaatccccctgtggagcacataccaaaaaactagaggccagccacaacgagacacccctctcccgaacagactcggcgcaacacaacagtgtgctggaagaggagcgagatgccccacctcccacaggggccgtaagcgaaaaaaataagccacaccgctgaacacgccccagaccagtgcccacatggtgaacacatcacaaaagaataggggacaccacataacgccgaacgatcacacactaggtagacacgcccctccttgcgaagacggagcacaaaaccactacgaatgcacagctgcagcaaaaccccgcaaacatagaagaaagaacagccaaccacaccagaggaatgagacccacacaaacaaaagggaaacgcaacccacagagaaagtgtaacatcgcggtacactctacttcaccaaccaagtgatccaccacctatcaccagaggaattcctaccaacgaacgaaaagccaatacataccacaaggagatcgaagaacaaactcagagaccaaatcgaagagaaataatgacaatatgcataacacccagaagaaaactaccaggacataaattaagtaatagtcaacgatgcagttacagacaacccagataagaaacaaaacaaagagccgaaaaacacagacag

SEQ ID NO: 493943 - DNA, 772 bp, Homo sapiens
ggggatgtggaatatttgtcataaataaataatgaaaacctaaaaaaaaaaaaaaaaaaaaaaaaaaaaaaaaaaaaaaaaaaaaaaaaaaaaaaaacaaaaataagcatacaaaacaaaataaaaacataataaaacccctttttgggcccccttggcccaagccaatttaaaccccgacaatttttgggggggggcccaaattagggctttcttggccaattcccccttttggggggggatttccctttccctggccggggttttaccaaggaggaccggggaaaaccctggggttaccaaatttaatggctttggggcaaatgccctttttcccagttggggtaatagcaaaagggcccccaccggtcggcttttcaaactgttggccaacccgaatggccaatggaaatttaacccctttattttttggtaaatattccgcggaaatttttggttaaacaaccaattttttaacccaatggccgaatacgggaaaatccctttttaatcaaaaagattacccccaaatggggggggggttggccccagtgggaacagagccctcttttaaaaagggggccctcaccccaagggggaaaacccgttttcgggggggggcccctttggaacccccccctaaaaaattttttggggcggggggccaaaacctaaaatggaccctagggggcccccttttaaatttgcgggaaggccccacccggcgaaggggggacctggggcgcccccgggcccttgtttcgcccccccc

SEQ ID NO: 493944 - DNA, 897 bp, Homo sapiens
catgtcatcattccccggattgaacgtactcttgcttatatcatcacagagctggcatgagagagagcgagaagagcttctataggttaaacgaaaactacaacgagaagacaaaacgattctaaaggaaaaatctgagaaggacttggagcacaaggagcagcagctggagcaggtgttggagcctgctaatcttctggctgaagagaacggacgacggatcttctatttgaataatctttcctgttctggttctttgagaaaccctaacactggcttcattttaattcacagtgtgtagcgttcgacttccgtgtggctattgacttcttctcgagcctacacgaacttctcacctcggcttcgtacacacacttctacctagcactgctctactttactgggcacttactctttgccagaactcactaactttagcaaccatttatcatggcatgacaacgagactctgtaaaacctgcccaggaacttacagaatttactttgcgagaagcgttatcatactccatttacatctgtgttacacgtgatctgcttaccaagcatatcaggaaatacctcttaggaagcattagcggtctcagcgccaattcacctgtggagcagctttcattcctagccacttgcaaaccttgcgcgcctgcgctctgcacattgctgccgcccttcttgcttcccatgggtacttctccaactttgctcaaccccctgcccctctcttccctttgcctgcaccaggcttcccctggtccgctgctctcgtcccctgcgcacggccctcctggccccactctccacactgccgactgctggctctcaacaccccccccccctcgccccccccccaccaccccaccccccccccacccccaccct

SEQ ID NO: 493945 - DNA, 341 bp, Homo sapiens
ccccctccatatgcagtgtgctgcagaggcttggttatcgccctcttctccccaactcttagccacgtcccagtggcggcgggagaacggtggtcccaagccactgtactgggttcgggtttcactatgttgcccaagctggagtgcagtggtgcgatctcagcttactgcaacctccaccttccgggttcaagcagttctcctgtctcagccttcccaagtagctgggactacaggcgcacgccatcacacccagctaatttttgtatttttagtagagacggggattcaccatattggtcagactggttacaaactcctgacctcaggtgatccgcctg

SEQ ID NO: 493946 - DNA, 1670 bp, Homo sapiens
  misc_feature (294)..(294): n is a, c, g, or t
  misc_feature (656)..(656): n is a, c, g, or t
tctcttttaacttttttaatgggtctcaaaatttctgtgttgacaaattttgtgtggctcaagttgtgttttccatttaaaaagtctcacgtgatttttaaaaacttaattaactttaaacacgtgccacacgccaaaacaagacaaaccaagagtgtggctccacgaaaacattctcctccttgttccttctcgtgaagaggtttgttcaccgagtgccctgtgtgtgttattcattatacaccagagtctcttgttatacttcactataacacttttacagatgtggccccnaatgtgtgaaaacaacaaaacgagttttctgtgaagacagcccgtgtctcttctccacacccacactgtgtatatataagagaagtgtgtgggtgtgagacagagagttatatatagaggagactataatattatatctcatattttttacacgccctctctctgtgagacgctttctttcagtggggcagagacactattgtgagtgtagacaaccctattgtgatcccagagactctccgcagagatcagaagaccgcttttctgttgtgtgttccccaactgtgtggcttgtgtgagagttgacaacacacgcccacacagcgcgccacaacagctgtgtgtctgtgtgtctcttcaanttaatccacaagcagaacacagaggacacaaagacggcgaaaccccccacagagagggtgtggggaaatagggactctgtaggagaagcaaacgcgctcttcctctccaagagacaacccacaccaattgtggggcggcctttgtcgcccccaaggagaggagaacccccaattatacttttcacacgccacactcgtggcgaccagcggccgatttcacacgcaagaaggaggctttctcacagagaacatattctagagggggggggcacaatattcttttatccgcgaagcattcattttatttttataaccccccaagaatgaaaacccggcggggcggacaacttcacacacaatttcctatttgtatcaccctcatttatttaccaggcgctctttaccgaaggaccacacaaacactcttgttggtaacttattttgggtaccaccacagttcggtcgttgggaagagcaccccccccgtggtgtctgttgctgcggccaaaaattccccgcaaaattatcacacacgaaggagggagggacacatacttataacgaccccgccggcgggggcgcgaccctatcaaattgtggatggggccccccgttgtgagacagtgacgacttatcaaacagggggatcaattaatactttcccacccccttgtgtaatacccacccagcatgtgaaataagacccccacagtgctgtgtcggtcttataccccactatgaggggaggggaggacgcacaatccttgatcggccgcagtgatacaacccccgcaggcacgaaagtctctgctgcccacaagcgacaagaaaaaacaattaccgcttcgtcagagaagacacaccgccatctgttctttctgaagagacctattttgatgaagagcgcgcccccagatttgtggtcgtcccccgcgagggaaagaaacgaaaatgatctccatcaacagagaacagttccacagaggagggcaccaatcatcacagcacacgagt

SEQ ID NO: 493947 - DNA, 605 bp, Homo sapiens
gcaagcctgtgttgactggacacaagatggtatataatgccattgaaggcacgattcgcttcattgtgcgctgacgtgtgacctcttaatgcagtgaccagacacaatcttgtatttaggacaacgggatcatgttcactattcaaacataagctcttctataccatgctggattggttaccctgggggtgaggagcactgtattatgaaagggataatgcagacagcgaatattgagattgagctagaagactttaagctccatggtctaggacgtgtatatgtaggacaagtgaaggctcccctccactgggttcaaccgactgaacatatgaagatatctattttgtctgacggcataagagacattggtactcaaaggcgaagatggcacacatgttgagtggttcaaaaagaatgtttatggcattcaattgtccccaggatgtgcaacactgtatgtatttctcaatggaattttcaacattttggttgacaaagaagggcgcatcaatttacattgttttggaaagctcccacgtgtaatggagttttaacatctgtggatagtgcaattgatgtatattgctagctgttgctgcaga

SEQ ID NO: 493948 - DNA, 203 bp, Homo sapiens
cgtgaaccatgatagttgagtttgatgtttttcacatgaacatgatcatggtctggcgttgtggtgctaatttaaggtagtacaatccagaggaaggaacctggtctatggaaatggatgtctgggttcccctctgtccttgtcagtatgggcaagttacagcctctctggttctctgagaatttaccacagctttgaagtgc

SEQ ID NO: 493949 - DNA, 696 bp, Homo sapiens
ggggtaaagggatattgtcgacccacgcctcgctcttctcggtaggcctttgaagttgcttactcacatgtcaataaattaaccacagcttcattagaccaccaggtctaaagtctgttgacagtttcagcatgactgaatcgctcatattttttttatatgcttccagaaattggcattggtctctcttatagaagtttgtgtgtaaacatgcccatgttcataaatgatttccacttactggctacaacataaattattagctttcttagaatgtatgatgtagtaaaagctcaatatacaacatttactctaactctcctcttctctcaaaatcttataccataaattagcatattcactaaaaaacactgtgccaccagtgtaaacgaacaagtgtgataataaacaggtgccataaaagataactattgaccttgctggcatcttaaacaccctgacactaccgacatacttcataaataacaaacacttagtgcaacactaagtatattagcgagactacaacaacacaacaaaagacaacaaacgcgaggcacgacccgggctcctagaagtactactccacatcggaaggtgcgcgcccaaaagcgctatcacgggaacatcccccccagacataacacagtacaaaacaaaaggagagccacataataaggaaggagagaatacaag

SEQ ID NO: 493950 - DNA, 241 bp, Homo sapiens
taagtatgatcaaaactacgagcatcagagaccgtacaagatttattagagcagcttattgttccgaatgaaaagagtggagcttttagctaaatatgccaataagaaatattgcctagcacaaaagcctgcaccactgcttgagtctccttttaaagatagagatcatttccatcttggccaccttactctcactactctcaaccattaaaagctagctggtgtacctggtaacttatct

SEQ ID NO: 493951 - DNA, 198 bp, Homo sapiens
gggttggggtttttcccccccccccccccgaaagggccttttcctttttttgggggaaaaggggcccgggggggggagcccccccccccccggttttttgggggtgggggggggattttgggggggcccccgggtttttttttttccgggcccccgggggggtttttggccccccggggggccggggggcccccccca

SEQ ID NO: 493952 - DNA, 235 bp, Homo sapiens
gggtgcagtgcaagctctcagtaggatatacattctggggtctgaaggatggtggccctattctcacaggtccatgaggcagtgccccagtagggactctgtgtgtgggctccaactccacatttcttttctgcactgccctagcagaggttctccatgagagccccacccctgcagcaaacttctgcctgaatatccaggcgttttcatacatcctctgaaatattgacttctg

SEQ ID NO: 493953 - DNA, 175 bp, Homo sapiens
tctgaccttcggaaggagttcacagaagcgatggaagccaaacaggtggctcagcaggaagctggaagctacagaggacatcgcataccagctctcacgctctcggaccatcacctacctgccagcgagcagtccgtgctcctccagctgacccagtgaggcccaccctgcctgc

SEQ ID NO: 493954 - DNA, 371 bp, Homo sapiens
aagagaagagcctaggaaaaatatctgctgcccgggcagggagggcagtgacgcgagtcatggggtcacggcagaccacaagcttccatctcaggtgatcctcccacctcagggctccccaccctgagtagctgggactacaagcatgtgccagcacaccaccaggctaggcgaagggtgggtattcgtgcgagagatgccgttgccctaagttgcttaggcttctttggaagctcttagactcaaataatcggccggcatgggcctccccaagggctggaattaccgggccatctaaatctttaatctcagattggcctggtgacagatggaggggtactttttctgacatgatgaggctaggggggctg

SEQ ID NO: 493955 - DNA, 321 bp, Homo sapiens
ttaagaccttttatattcagaactgattataatttcccccattttgggttactgtcctgccaagggccccacccagttttaagcaaccaagtaattatgtttgggtctataaaccaccgggtccttggtaaacccagccccagttaaaagtttgttttaaaccaggaaaaacctgggtttgaatgctctttgggtcccttgtaccctgtaaaacctgcaagttttttagatcccctaaattttagggtcccggggggcaaagtgaatattgtaccaaacccccctgggttagccccttaaccctttttttttcataaccta

SEQ ID NO: 493956 - DNA, 182 bp, Homo sapiens
catcctttgtcgcggcactgagcctctttttttatttgaaactacttaaactccaagacaggctcacgtaactcgtctgtttcaaggtgcaagaaccatatgtgttagcgtgaaatctagctcaatttacatgatatactttgtgacacagaacactgattatgtgtacgccaagagagccg

SEQ ID NO: 493957 - DNA, 252 bp, Homo sapiens
gttaggacatattctctctgcttctatcttctgacaaagattgtagaacataggtatatttccttccttaaatgttggaaaaattcatcagtgaacccatgtgggcttagtgctttctgctttggaaggaacacttgtttggtgttctctaagtttcctggatctgtggtttatttcctgactttaatttgcaggaaattctcagtcatagttagcttcgcaatactgctatctgactccttttattatttg

SEQ ID NO: 493958 - DNA, 109 bp, Homo sapiens
gaggtgctgcagctcttgaagatggtgggcagcaggaagttgagcagcgccagagctccgggaggttgttcttcagccgtgttcccctcaaccgccagccgccgggttc

SEQ ID NO: 493959 - DNA, 556 bp, Homo sapiens
attgtgttgctctttcaacttcagtcgtcacggagggagctcagtattttgacaaggaatgtgaactggctgttgtatatttagaagtgagtcttccttgtgctcctttcccttccaagtgttgacattatttcagtctgttgctatttttcattggctggtttctctagattagtgaggcctgatcctttccatggcactcacaccctgtttgtacccaactccccactggtggctgctggctgatcacaccatgctgttttcgtgttttatggagaagtgttcaggtgtggctgctgtgtttgatattaaatctgagatgaacttcaggagatttcctgctttttattacaaataattttggctaggggcagtgttatcctgttcataaatcaggtgttctcagagatttaataatttagaattcacatgaggatttggtggaataaacatttcctttctctgttaagctgcctcttaactttctatcttcccctttctcttcactgcttccatttttttaagccttctttaagtctttgccaaaaataaaaat

SEQ ID NO: 493960 - DNA, 702 bp, Homo sapiens
tgagagagagataaggggtgtgaagatgaggagaatagagagagaggaggagtggataggaagggagaggagagaataatagtagatagaaggtaagaggtatagaatagtgagataagtgagaggagagaggaggagaaagagggtagggatggagagtagagatgaggtatgaaagagagaggtggagagagataagatggagaggggaggagatagagaataagaggagggaggagaggataagggaaggagagagggtagaggaggggaagaagagatgagggagatgatgttagaaggagggagaggaatatgggaagggggaggagggtaggaggagagaggaggaggaggagaggagagggggggagggataaggaggaggagaggagggggaggaagatgagtatgagggagtagagggaggggtaagaagagagaagagagatagaggagagagtggagagatagagaagaagagaggaggggagaatgagagagtggtagggagaagaggaggggagggtgagagggagagatagggagagatagggggggggaggttagacgacagaagggggccgggcgcggtggctcacgcctgtaatcccagctctcagggaggctaagaggcgggaggatagcttgagcccaggagttcgagacctgcctgggcaatatagcgagaccccgttctcc

SEQ ID NO: 493961 - DNA, 611 bp, Homo sapiens
caagatagctggcttctgggtgacagttccttctttcttcgaacctggctcatgaccccacttcacattcctgaaactccagcagaatatcgctataacatggcccattctgcaactcacagtgtgattgagaagactttccgaaccctctgctcccgattccgctgcctggatggatccaagggggcactgcagtactcaccagagaaatccagccatatcatcttggcctgttgtgtcctccacaacatctccctggagcatgggatggatgtttggtcctctccaatgacaggacccatggaacagcccccggaagaggagtatgagcacatggagtccctggacttagaggctgaccgtattcgtcaggagctaatgctcactcattttagctaatgtagaaggtggagaggagggatacttcccaggagttgtgacagactttcctcctcatcaccttttacacagttccatcatctagcatgactgagtatacagatacttgtcataaactgacatttaatatgtgtgttttggtaaggttggggctatgccagaatatcttgattcatttgcatatgcattaattaaactgaaaccaagaaaaa

SEQ ID NO: 493962 - DNA, 432 bp, Homo sapiens
ctcgcgacgtgttatccccggtcattgatagcgcacgcatctgccgttcatctgcaggagcctctccattgggttcatccattccaggaatagagtcatggccatcaaacaggcagtttgatctctcctcttcctcctggaggccacaagattagggccgagagtcggatcagacaaatcgaatctacaatccttaagctcctggcagggcccagccaaggccttgcttccatgctaacgactccttccaagatggccagtcccagcatgcttccaagcaggtttcttccgtgtcctctggaccctcatcgtcttaagagctgccgcctataagagggactattcttgagatcctatcctctaacatttgtttccacacccaatacaaaaaatctctgggtcaaaagtctagaacgcttaggctgtcagaca

SEQ ID NO: 493963 - DNA, 571 bp, Homo sapiens
  misc_feature (65)..(65): n is a, c, g, or t
  misc_feature (81)..(81): n is a, c, g, or t
  misc_feature (108)..(108): n is a, c, g, or t
  misc_feature (127)..(127): n is a, c, g, or t
  misc_feature (235)..(235): n is a, c, g, or t
  misc_feature (338)..(339): n is a, c, g, or t
  misc_feature (351)..(352): n is a, c, g, or t
  misc_feature (379)..(379): n is a, c, g, or t
  misc_feature (420)..(421): n is a, c, g, or t
  misc_feature (530)..(530): n is a, c, g, or t
gctggcgggacaagacctcctatcgctggcagcttctgcaccggcctcaagttggctacattcgnggtgaagctctatgangggaccccatgcttggtggcggattcntggggtgatcattgacacnatccatgctgaggggggcgtctgtggtgtattcgtgctgtctcccaatgaaaacagtaatctggtccaagtctcctagtatcggatgcagatgacgacagtgcctganggacatttgagcctattccggacggcagactgctcccagggaagggtcgtgacggaggaggccaccacgattcagaacttcagacctttgtagacctctttgnngccttggggtcnncatcctggagacgcctgaggtctaaangctacagcccgctcaggccgaaccagcagacccgttcttcnntggctcccaaagaggaggttcccagtcccagaggggttggtcgaccccgagcccttcaggggcatgagacagttttcaacggggtattacgtcaggcactaaccccagngaaagatgacagcacattgccataaagttgtggttgttgtt

SEQ ID NO: 493964 - DNA, 309 bp, Homo sapiens
ttcgaccaaagaacctctaaaaagatattcagcacttacactcatcagaaaggtcatagcctcacaggtattgacaatacatgtttgcaacatgtatagaaatagaaatttgcatattgataatgaaaatgttagttggcgctaatgcacttcagcaagcaagtatgcaatatctactacagttgaagatgagtccacattacatttaagcattctccattactgagtttacgctacaagaaaattcttgcatatgtcctaggagtcataaacaagaatttgcactgctaggcattggttgcaacaata

SEQ ID NO: 493965 - DNA, 264 bp, Homo sapiens
gcgatacgacattgaggccaaatgcctccacaacaccagggagattaaggacctgaagctgaaggtgatggacctccgtgggaagttcaagcggccgccccttcgtggagtccctttctcggctgaggccattctccgggcccttctgggctccaagaaaagggtgtccatggatctgcgggccaacctcaagtcttttgagaggggagacacaccgagggggcccctctggaggtggctcacttgggaaaacgtgccccctct

SEQ ID NO: 493966 - DNA, 332 bp, Homo sapiens
tgttccagtatgcgctgccccatgggccgcaagaagggagccaagctgactcctgagaaagaagagattatataaacacaaaacgatctaaaaaacttcagaaaaaatatgatgaaaggaaaaagactgccaaaatcagcagtctcctggaggacgcagttccagcagggcaagcttcttgcttgcattcgcttcacggccgggacagtgtggccgagcagatggctatgtgctagagggcaaagagttggagttctctcttaggaaaatcacggcccgcaaaggcaagctaaattccttgttttgtcttcacccattgtaataaagagtgt

SEQ ID NO: 493967 - DNA, 109 bp, Homo sapiens
cttttgccccttgggccctttttgggggcccttttaacccagttttttccaaaaaaccggggggggccgggccgggatttccggggtttttttgcccccccgggcccca

SEQ ID NO: 493968 - DNA, 613 bp, Homo sapiens
  misc_feature (22)..(22): n is a, c, g, or t
  misc_feature (100)..(100): n is a, c, g, or t
  misc_feature (134)..(134): n is a, c, g, or t
  misc_feature (137)..(137): n is a, c, g, or t
  misc_feature (163)..(163): n is a, c, g, or t
  misc_feature (166)..(167): n is a, c, g, or t
  misc_feature (171)..(171): n is a, c, g, or t
  misc_feature (198)..(198): n is a, c, g, or t
  misc_feature (204)..(204): n is a, c, g, or t
  misc_feature (239)..(239): n is a, c, g, or t
  misc_feature (243)..(243): n is a, c, g, or t
  misc_feature (252)..(252): n is a, c, g, or t
  misc_feature (330)..(330): n is a, c, g, or t
  misc_feature (408)..(408): n is a, c, g, or t
  misc_feature (415)..(415): n is a, c, g, or t
  misc_feature (475)..(476): n is a, c, g, or t
  misc_feature (478)..(478): n is a, c, g, or t
  misc_feature (482)..(482): n is a, c, g, or t
  misc_feature (492)..(492): n is a, c, g, or t
  misc_feature (597)..(597): n is a, c, g, or t
gggccagcagaatgccccaggnagaacgtggaggaggcttccttgactgtggtgcgtagtgtctgaaaactcagggtattatgtgacaacacatttaagnattccattgttgcaaattccttcttctttgttgncanggtcaaacaatcaattggactttaantgnngttntattgttttttttgagtgttcttggcngtggcnccgtgggtacgcggggcgtccggggtagggggccnctgnagtgtgggngtgagttggcgcgtcactagagtatggtggttaagggtgtgccggttcccagaaacaccttacacgggattgtcagtntttaccccagagaagctgatatggtcttgaggggggaaatgatcacaggaatggtctcttcttttttttttcttgatncgtagtnaatactcctagtgatgttgtattgctggccttcatgggcaaatgtcaggacacagcggtnntngccngcatcttccngggccactcgtgtacgagtaagtgagtggtcccctcacacttagaaatttctcattgtctttatccaaaagaagagaatccttgtaccattgaatcttcacgtcngttttgtcacgggtga

SEQ ID NO: 493969 - DNA, 141 bp, Homo sapiens
atccgagtgggacacggggagagctgtgaccatgggagagctacaggagggaggagggggcccagaggctctggcagtgtgtgaagacaagcagtgggtgaccccgtcacggccctactgtccatccctgcaccagtgtgt

SEQ ID NO: 493970 - DNA, 243 bp, Homo sapiens
cgagagatgacatgcagtttctttttatagacattggcccaggtgccaggcacaatagctcatgtctgtaatcccactgcttctgtaggccgaggggtgagaattgcttgagtccaggaatttgatgaccagcctgggcaacacagcaagaccctgtttctacaaacaaaacaaaacaaaacaaaaaacattagctggacatggtggtgtgcaccttgatttccagctactcaagaggctgag

SEQ ID NO: 493971 - DNA, 122 bp, Homo sapiens
cattatggcttatcaatagctcttattctcattatccaggcttttggaaggcaatcaatatatggatctatatccttggaaattaaataggaaacagtttaatcccttaggttcggagactc

SEQ ID NO: 493972 - DNA, 210 bp, Homo sapiens
tcagtcacccaattgccctttggtcagcattgaatgtgaactgggtaatggtgcacaggtgtctttttttataaatgaaatgatggacctgtaagtctgtggtaaacggtaccttgaaggaattgtaattgccggcatttggtcttttgcaataaaagagtaattgtgttccggctaaaaaatacaaaaacaaaaaatataaatagacca

SEQ ID NO: 493973 - DNA, 264 bp, Homo sapiens
ggaacgggctggtgcattcggggggcccggttctcgccgtcgctccaactccatcttggccctcggttattacccggaactcgcaccccagatcggccgccgcgctcagcggtgggggtcggtgacccgggaggaggggttagcccggtccacgagcctggagagctcggactgcaagtccctggacagatcaacagtggcttcgggccggaggaagacacgggttacctggatggggtgtcgtagcccgaaggtcagccctca

SEQ ID NO: 493974 - DNA, 868 bp, Homo sapiens
  misc_feature (460)..(460): n is a, c, g, or t
  misc_feature (485)..(485): n is a, c, g, or t
  misc_feature (571)..(571): n is a, c, g, or t
  misc_feature (576)..(576): n is a, c, g, or t
atggcccatgcagcgcacgtaggtctacataggacgctactatcccctatgatagagatgagctgtatcacctttacatgagtcacgcgcgcgtcgagtaatcgatgtgttgcctgtatgcgtggcttcactaggtcctggtagtggcccttgttcctaaacactcgacaatacaaacgtaagcgtatgtactaagcagtctcacgacgctcagggacagatagtagagacgcggtctggatacgtatgcctgtcctcgtccactcatttccttagtgcctcgagtacggcacgctccccgagttcccttagcgtgcatttcggtatatatctatatatcagactgtaggctgaaacgaatgctccttctccttttgccatttcaatagtcaaatttggggcaaaccaattgggtatctgaaaccgtaacgagataacaccggacatatgcgagtagggnctagatcgtatcagaacatccgtancggtagccattttggccccatgttgtatgtccctagaaaaaccaggcgcgagaccctgacgaagcttccccttgaagcaggttgancatgntcgaagtttgatacatacccgtaatttgggaagtccccccaattacgttattccattaatctacagtggacagagaccgtacttgcgctccatggagcttgtcccccagatttagagcctataaaaccagattgccagttcccccggaaacggtcgtagagtgaaaagtcaactttcacccggtttcatagaagcggggggtgctatcgtactggtgccagtgctcttgaatctctggtgggagcattacagcagatttcgatggccatacgtcgtagagattaattcccct

SEQ ID NO: 493975 - DNA, 411 bp, Homo sapiens
agataacatgttacccaagataacttgacgtgataggtagatagataggcatatagatgactgattgataaatgaatataaataaataaatgcataaaagattatagaatattaatataaatgaaaggtacttgtgttatatactaattttttgaaattaagcagatcaaaggactttatatatgggaatgagagatcttagagggttacagaacattttttgccacaaaacatattttgggaacatgtattttcaagagaattaagctgaaggaaacattagaataacatgtacctaagttattaaattttaaaattcacaattcagttgctattttacatttcagtttctctcaaagtttagccaacaaaaggcatttataagccctccaatgctggtaaatatgtcga

SEQ ID NO: 493976 - DNA, 137 bp, Homo sapiens
cggtctacccttaagttggatagttgagatcgttcgccagactctatcatcgttacgataaactgcgtgcggggtgctcggtctgcaagcgcagtatctgaggaactcggaggaccactactaatatgtaaacgact

SEQ ID NO: 493977 - DNA, 1346 bp, Homo sapiens
  misc_feature (215)..(215): n is a, c, g, or t
gagttcttgttcgtggattgctagtgatcgtcaccttgacaatgcagatcttcgtcgacatcactcgtgcactggttaagtaccactcaatccatcgcatgtgttgaggcccacgttgacggcgcactcgaagagtgtcagatggcacacagatccgaatgactaacggaagggcattcccctcgcatgatgcatgccatgcatgcgctgtgatncttgtgcatggagaacacatgcattgcgatagtagtgagagccgtcgaccctggtcttgaacgtaccaaaccatccctagaaaatgacgtccagcccctgtgctactcgttgggtgcttcccgtccctcgatatgggtgaggattagctagatagtcttatctcgtgtatatcaacgacgttcgaccattgggtctaaggtacccctacttcagcgcgctttctgcatgtgttcgagagggcacaccacgcttgagctatcgcaatcttctggacggaattcttgctacccaaaaagggcgagaacaagaactaccacagtccagactagagcgcgaaaattgcgcgattgtcgcgcttaccctattgacactccagtggacatgatgggcgttgagacgtttccgtttgtgggcccctggtgcattacaacagtccattgattcgaggacaccgaacgtccagggaactgtccgatcccctcccttggctgccattttgacatcctaaacgaattaaaattacaccaccgaaattccaggaaggcctttaaaatagccgacaattgtaaccccccctttgcgggttgtcgcatttgcctgtgacacactatttacgattagacaggcggtttgggtgccaccattgccgaaagattagattcggaattgccgcgcaggaattcgtagaaaaacgggctgtgtgaggcttggggtgccataatgaagttagaatcccacatgtccaattttccccttttcgggaaccctcgaataagggggaaaaaggacacggcgcaaagagattgcaacgttaaagctcacaattttcggaatgctataacatcggtttgtcgtaggaagggcgggtcgaagagaaaagccaaattacgcccagtgtgcggacactcccaaagcgggccatacgggtcgggattaacccctttggcgtctggaaaaaccaattggcaaagaaagacggttttatgacataccctcctttaggggccaagcgaggtttaagggggcaccggctatgcagagaggacaatactgtcgcttcgaaaaaccacccgttggttgcatcgtaaggttcattcagttcgcaatgccacattgggagaaatcgcaca

SEQ ID NO: 493978 - DNA, 491 bp, Homo sapiens
  misc_feature (20)..(20): n is a, c, g, or t
tacagcaacctgctgtgcgnactcctgcgcggcatcgtggcaccaccaaggccgctgcttgcagtacccatcgccttccgcggcccaggacatggtgcgagagggtcaaggagctgggccacagcacccagcagtttccgccgcgtctaggccagctggcagccgcctgagggtggtgaacccccaggacgggcgacaggcaagcggcgaagcgcggtggcggccggttcccaagctcccttggctcccatgtcaacgagtcgctgtgccacaggcttagggacaggaccccagctctgcgtcggtcctggtgccctggatgcccaggaactctgtatatactttatggcccgggcagggctgtggggccatgcctcctcaggagccgaagcccaggcgccggccagtggccttccccagccatgcaccacgggcccgggtcgcggtcaccagacgggcgctggcagctgctgagcggtccttgcaagccc

SEQ ID NO: 493979 - DNA, 748 bp, Homo sapiens
tgcgagtgagacacgctctcgccggcgcatgactgagcagatgacccttcgtggcagccctcaagggccacaacggctgggtaacccagatcggtactaccccgcagtgcccggacagtgatcctctccgcctctcgagatagagacccatcatccatgctagtgaagactgaccacgggtatcgatgcacccaactcatcgtgaattccacagcgtgctcggcaggggtcactcccaacatttgttagtgatgtggttatcttccatcagatggcacagtgtgccctctcaggctcctgggatggaaccctgcgtcctctgggactctcacagacggtggcagccaccgcgagggcgatgtatgtgggccatacccaaggatgtgctgagatgtggccttactctctctgacaaccgtgcagattgtcgtctgagatctcgaggataagaatgcatcaatgctatggaataccctgggttgtgtgcgagtatacactgtccaggatgagagccactcagaggtgggtgtcttgtgtccgcattctcgcaccatgcagcagtataccctatcatcgtctcctgtggctgggacaagcgtggctcaaggtatggaacctggctaaactgcaagtctgaagaccaagccacattggccatcacaggcctatctgaacacggtgactgtctctccagattgatgcctctgtgcttctggaggcaggattggcagcatgtcatgggatccag

SEQ ID NO: 493980 - DNA, 1098 bp, Homo sapiens
  misc_feature (617)..(617): n is a, c, g, or t
  misc_feature (633)..(633): n is a, c, g, or t
  misc_feature (672)..(672): n is a, c, g, or t
acgacccttggggtgaaaaagggaaaagggttctatattctcgtcccgcgttcaagagcctctgtgtggggggccccgctggcgaacacaacagagtggcccccaaggggagtgacgccggagtttttcctggtgatcccccgccccctgtggggcaccacattgtggggtgtcccaaagaaatccgccggcaggggggttatattacaccacaccgcggtggtggagtagagttgggcccccccccccacccgccacaggaggatcgccacagaaatcacggcgttctttggggggtggccccccccccgcaccacagagtgtgggcctctccgggggtgccccatcggggccccacaacagacttcggggccacaagaagagaaaagggagagaaaaagcgtgggagagacactccgggtgtgcctctgtctctgggggcacacacacacagaggcccactctcgattttgatatgtgagctccgttgatacacccacagagacacgggggtcacagattgacacacagctctgagagttttttctcttgagactctggggcccaacacacagggggcacacacttttcgcccttctccacacaggttgtgaatntgctctgagagagagngggagacacacacagtgttgagaaaagtgtgggagagcncggtagagagttcagatttggggcggcctctggagagagacccctctgcgcgcctctgagaagctctgcccacagctctgttggtggaacacagactgggacacctcgaggggctctcacaagcaggccccgcgcttacgccacacacgcctgtgcccacaacacttcactggaatagacgcacagaaagaatagaatagaattcgcagagtggattcacagaccctgggggaacctgggtgttgggacctgacctcccagctctctgtgaatcacgtgtggaaggaaccccccccacgcgcaccggccggcgttcaaggtggagaacccctgtaggagacctggtggcccaagctgaaaggagaattgggcggagatttgagcccctcccagagatggccaatataaactgactttcaacatcca

SEQ ID NO: 493981 - DNA, 872 bp, Homo sapiens
  misc_feature (2)..(2): n is a, c, g, or t
  misc_feature (71)..(71): n is a, c, g, or t
  misc_feature (78)..(78): n is a, c, g, or t
  misc_feature (84)..(84): n is a, c, g, or t
  misc_feature (129)..(129): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (172)..(172): n is a, c, g, or t
  misc_feature (177)..(177): n is a, c, g, or t
  misc_feature (201)..(202): n is a, c, g, or t
  misc_feature (208)..(208): n is a, c, g, or t
  misc_feature (217)..(217): n is a, c, g, or t
  misc_feature (231)..(231): n is a, c, g, or t
  misc_feature (237)..(237): n is a, c, g, or t
  misc_feature (243)..(243): n is a, c, g, or t
  misc_feature (265)..(265): n is a, c, g, or t
  misc_feature (269)..(269): n is a, c, g, or t
  misc_feature (275)..(276): n is a, c, g, or t
  misc_feature (279)..(279): n is a, c, g, or t
  misc_feature (283)..(284): n is a, c, g, or t
  misc_feature (293)..(293): n is a, c, g, or t
  misc_feature (316)..(316): n is a, c, g, or t
  misc_feature (343)..(343): n is a, c, g, or t
  misc_feature (364)..(364): n is a, c, g, or t
  misc_feature (376)..(376): n is a, c, g, or t
  misc_feature (380)..(380): n is a, c, g, or t
  misc_feature (386)..(386): n is a, c, g, or t
  misc_feature (412)..(416): n is a, c, g, or t
  misc_feature (421)..(421): n is a, c, g, or t
  misc_feature (431)..(431): n is a, c, g, or t
  misc_feature (437)..(437): n is a, c, g, or t
  misc_feature (443)..(443): n is a, c, g, or t
  misc_feature (478)..(478): n is a, c, g, or t
  misc_feature (482)..(482): n is a, c, g, or t
  misc_feature (497)..(497): n is a, c, g, or t
  misc_feature (855)..(855): n is a, c, g, or t
gngattacaccactgcattccagcctgggcaacggagtgggaacctgcctggagaaaaaaaaaaaaaaagnagaaccnagaccngatatacaacctaaagcagtgatatttctagaagaaatcctaggngaaaatatttgngancgnggngangaagaatctatcaaatacnaaacnttttttaccaccttgaccaaaagnnattggnttatatacntcatcatatcattnaattcnaaatcnacagagatcaatgtcactttcncagngaaagnncgngagnnttcaatgangccctgaactcacactcccaagngaaccataacaccatatttccagagtngagtttattagaacaataacnggggataatganaaanattgancaaagactgagcctaggaaggggggnnnnnggggnggcgtatgcncaaggnaattcntcagaaccacagggggctcattgggtcctattaanagcngagagtgaatgaatnaacagataaaacagagacctgagtagacggtagtcgaatattcttgtacatgtattctacctctagattccatagaaagaactaaaagtacatgaatttcactaccaacatctccatcagttaccagctgtatcaccttggatcagtcaggtaacctcccgcgaatctggttgcttccggggcaggggatccgcgggctgcaggtttgagcctgggagccggcagggtggagcagttggagggccaagcctttgagctccagggggggtggccgggacagtgggtagtgccagccgatcggcgtcctggggattgcctgaatgtgaggtctgggttcacccgcggtgacctgagtctngggatgccctacagtga

SEQ ID NO: 493982 - DNA, 1014 bp, Homo sapiens
ttggctattgtatccgttgcgtttgtgtctggttcatccattgtgttaaattttttccccccctttatagtacgttgctaaagatattcctattgcagggagcggcatgtgttcctatatgaaattatcttctctggcctaagtacgatcacaacgcagtccgatctccgacatatcttgtggtgctggtacacggccagcagtcgctccggcaccggtgcgggattacttcttgaagttccaggctcagtaacatcagatccctaatgcagcctggggcgcggcaaagcctggtaccagaccaagttggagaccctccaggacccaggctgggaagcaatggggaacgacctccggcatacccggaatgagatttcagagatgaaccgggccatccagaggctgcaggccggagactcgacacacattcaagaaccagcgtgccaaggttggaggccgccattgcagaggctgaggagcgtggggaacccggcgtctcaaggaatgctcgagccaagcaggaggagctggaagccgccctgacagcgggccaagcaggataaggcagcggcagctgcgtgagtaccaggaactcatagagcgtgaagcctggcccaggacatcgagatcgccacctaccgcaagcttgcgtggagggtcgagggagagccggttggctggagatgggagatgggacaccgtgaatatctccatgctgattgaattccactggtggcagtagcagtggcggtggcattgggctgaccctcgggggaaccatgggcagcaatgccctgagatttctccacgcagtgacgggtcctgggctcgcatgaaggacttattccatccggaaccgcatccgaccagtcgcaggagtgcccgcgaatgataccgcctcccaacatctccactctctccacgtccaccaccccacaatcacaagtaagaatttccaacccgctctcacaatgccgtcgcttcccagaccaggtaaatcacgtcgggaaagta

SEQ ID NO: 493983 - DNA, 1116 bp, Homo sapiens
gtcctagctgctggcatcactatactactaacagagcggaagctcgaacacacaacttcttcgaccccgccggaggaggagaccccagttctagtaccaagcagcctatgctgattagtcggtcaccctgaagtagatattcttatcctaccaggcttcggaataatctcccatatgtagacttactactccggaaaaaaagaaccatgtggatacattaggtatggtctgagctatgatatcaatgggcttcctagggtgatatcgtgtgagcagcaccatactagtttagcagtaggaactagacgtagacacacgagcatatttcacctccgctaccataatcagtcgctatccccaccggcgtcaaatgtatggtagctgacgtcgagcaacatctcgcgaggtgaagcaaatattagagagtgatcatgctgccagtgcatctgagcccataggcattcgatctttcttgtatcaccgataggttggaccatgaacgtgggcatttgtagttaaggcaaaaatcaataaaatagaagatacgtagataataagatgagggtcactacggcttggtgaagcctccaactatacccactaatgatcctaatcaaatcaggcagccgtaagtatgccatcgatagagagggcctttcattcactgattgccccaatgctcagggctacagccctaagaaccaggaccatacgacaaaactccattttcacctatcatgttcaatcgggaggtaagaatctaaagtgttcatataggcacgaacaaattttagtggggacatatcccgggaaaggccccggacgtttaaaatgggagatacacggaatggaaaacagaaaattggaaacctgtcttagtatctgtgtagggctcaattcaaatttgcgccgtaaacaggctgtacactgttaagtaacatgtgcagtggatttgggaaaaagcctatcggattgaaaggggaaaggtcaaaaatagtaaagacaggaagacgtcgatagaccgggaggttgaccaaagagtgtgtgagcaccaaagcgagacgaaaggtagaaaagaacggtagtacaaaaccaggaaaacaagagcgaggagaa

SEQ ID NO: 493984 - DNA, 117 bp, Homo sapiens
aggctgctatttggaaagggaaacaggtgtaccagagcttcaggggtgacaggtgtaatatcctattaaagctactggaaatggttcatcttacaaaagcataaacaaattccccaa

SEQ ID NO: 493985 - DNA, 113 bp, Homo sapiens
actcggtccgagatatgtggatgggggcacgaggagggctgcgtaggcatcagcttcctcctgtcctcatcgacaggctggtcctctactgcgggagcctggctgggcaaata

SEQ ID NO: 493986 - DNA, 683 bp, Homo sapiens
  misc_feature (26)..(26): n is a, c, g, or t
  misc_feature (212)..(212): n is a, c, g, or t
  misc_feature (222)..(222): n is a, c, g, or t
  misc_feature (224)..(224): n is a, c, g, or t
  misc_feature (237)..(237): n is a, c, g, or t
  misc_feature (253)..(253): n is a, c, g, or t
  misc_feature (262)..(262): n is a, c, g, or t
  misc_feature (265)..(265): n is a, c, g, or t
  misc_feature (294)..(294): n is a, c, g, or t
  misc_feature (317)..(318): n is a, c, g, or t
  misc_feature (331)..(331): n is a, c, g, or t
  misc_feature (333)..(333): n is a, c, g, or t
  misc_feature (359)..(360): n is a, c, g, or t
  misc_feature (365)..(365): n is a, c, g, or t
  misc_feature (369)..(369): n is a, c, g, or t
  misc_feature (378)..(380): n is a, c, g, or t
  misc_feature (383)..(383): n is a, c, g, or t
  misc_feature (399)..(399): n is a, c, g, or t
  misc_feature (419)..(419): n is a, c, g, or t
  misc_feature (426)..(426): n is a, c, g, or t
  misc_feature (432)..(432): n is a, c, g, or t
  misc_feature (455)..(455): n is a, c, g, or t
  misc_feature (464)..(464): n is a, c, g, or t
  misc_feature (466)..(466): n is a, c, g, or t
  misc_feature (504)..(504): n is a, c, g, or t
  misc_feature (507)..(507): n is a, c, g, or t
  misc_feature (515)..(515): n is a, c, g, or t
  misc_feature (520)..(520): n is a, c, g, or t
  misc_feature (523)..(523): n is a, c, g, or t
  misc_feature (528)..(529): n is a, c, g, or t
  misc_feature (546)..(546): n is a, c, g, or t
  misc_feature (579)..(579): n is a, c, g, or t
  misc_feature (585)..(585): n is a, c, g, or t
  misc_feature (621)..(621): n is a, c, g, or t
gtttcgtgtcgctgcgtgaagcatgngtgctttcagctggacagtagattacaaagcatctccgatcacgttaaggcagatgatcaatctgtggctgcatctgtaactcctcctgggaaaataatcctgttggagtagggggctcttcccagttgtttggttagttggcccaggaaggggcagtactggagctggcgggtggggagccaggncccaactgtntngtcactgctcgtnctgctggccctctgtnactgatgcnganacggaagccctggcccattgatagacatnactgaaagcaacacccaactganncataaaacatgantncttccacagggtcaccttattgtctnnaccanaaanagcaaggannnaangctgtaaatggaccanacaacaaatgaccaaaacanaaacgtnagaacntgtaacaacaaatttaaggggancacgtattngnttgagggaacatacacaggtccaaatagaacaaacgancanactggganaaacnggngaagnncaggtaggcaggccganggagggggcccaggccacaactcgaacccagtnactgtncgcttctagcttctgctcctccttccactggccgtnctcctcctccttccacagcttgatgaggttgttacagccacctgatgcaaacctcttgatgt

SEQ ID NO: 493987 - DNA, 492 bp, Homo sapiens
gaaatgagttgggatctgggcaagatgtcttctgagctcctactagtgtggtggctgaggagttagaaggaaatgtgaaccaatggcaaagaagttaaaagctttgaaaaaaaattagacgaatggataactataataaccaaggcagagaagtccttaaaggacctgatggagctgaaaaccaaggcacgagagctatgtgacaaacgcacaagcctcagtagccaatgcgatcaactggaagaaagggtatcagtgatggaagacaaaatgaatgaaatgaagcaagaagagaagtttagagaaaaaagaataaaaagaaatgaacaaagcctccaagaaatatgggactatgtgaaaagacaaatctacgtctgattgatgtacctgaaggtgacggggagaatggaaccaagctggaaaacactctgcaggatattatccaggagaacttctccaatctagcaaggaaggccaacattcaaattcagg

SEQ ID NO: 493988 - DNA, 966 bp, Homo sapiens
  misc_feature (966)..(966): n is a, c, g, or t
tctcccctcccccccttaaaccatattcccctcggaaggcgctaccccgggcaggggcaaagcgggctcatcaccccgggaaacaccaaggacacaagaagacacagaaggcacaagagaaagaaacaagaaaaacgacaggagagaaacacaagcacgaaaacagcaagaggagagaaaaaaaaccaaaaaacaggaacaacccaaaagaacaaacaacaggaaaaacacagaacgaacaccaaaagcacaaaaaggcgacagacaaaagaagcaacacacaaaaacaaaggaacacaaaacgagaacaagaaaacaaaacggcaaaacaacaccaacacaaataaacaccacaaaaaacacaaacacagaaacaacacgaaagaaacacataaaacaaaagaacaagcaaacaaaaccacaaagaacaagaggacacaaacaagcccagactcaacacaaacgcaacagagaaacaaagcagaaacaaacatccataaccacacacaaagacaacacaggcaacacgaaaacccataaacacacacaagacataaacaacaaaacaaaaaaacggaaaacacaaagacaacagaacaagaagaccacacaacacacaaaaaacacgacaaacaaacagagaacaaagcacagaacaacagaaataacaacaaccaccacacgcacacaacatgaaacacgaaaaaaaacagaaaaaacagaaacaaacacaacaacaaacaagacaacacagacacaaacaagaacaagaaccaaataacaacagaaaaaccagaaacagacgaacataagcttaagaacagagtagaagaaacaagaacaagacaggataagtcaacgctagagaaacacatgtaagcaacgtaacgaagaagagaacaaatacaaaagaaaaaaacagaaacacaagattgtgtgtctctcttctctctctaatcatacaan

SEQ ID NO: 493989 - DNA, 177 bp, Homo sapiens
ggacctcataggttcgcaggcacacaggtgcacagcaggttctggataattcggccgatttggcaaaacgctttcgcaaactgggcgcgccggtggtgatggttcgcgtcggttggtctgacacctttgcagaagcgctgaagcaagaagtggatcgcccgtcccctgcgaacctat

SEQ ID NO: 493990 - DNA, 843 bp, Homo sapiens
gggctgtaccggtctggaatgtataggatggaggagcggagggagaagtaggttgcgagctcagcacaggctccggcgctggctcccgcagactgagtttgggagatgtctaacgtgattttttttttttcccggaaggcaaatggctggcgtggaagcacaacccgctttcactcttcgaatttgtgcttagctcttttcttgtaccttgcgactcgtgaccaacatgctgtgatgtgtgccgagggaggaattggtaagagtgagacggcgaatccctctgactgtcccagccttctgcttcaccgcccacccgcttttcctttctgtttactctctccgtgtttctccccgcttccactttccctagctcggtgtttagactttgatgaccatggctcaacaactacgagttctggcgctgtcactgacacttaaaacaaacaaaacaagcaaaagcataaacatgattacaccacttttcaatcattggttaaaggggaatttcaaaaatctattttacaatgctggattcggtaaaaaggtaaactgcacacgcgggcgcacacgggcacgcacacacacgcattcccacccacacacactccttggtcatcccgttgtgaaataacgcagttaacagaacatacgggtcatcctgcctcaaaggtgatcaacaccggcgaacggctgttgaacgcactttaagccccccgcaggacttgacttccttacagggcttcgcattccccctaagggtcgaattccctctcggacgcaaatcagcggtgtcacgcatcgcgcacgctctcctcggaaacatagttcccagccggacctgtc

SEQ ID NO: 493991 - DNA, 798 bp, Homo sapiens
  misc_feature (34)..(34): n is a, c, g, or t
  misc_feature (86)..(86): n is a, c, g, or t
  misc_feature (223)..(223): n is a, c, g, or t
  misc_feature (312)..(319): n is a, c, g, or t
  misc_feature (348)..(349): n is a, c, g, or t
  misc_feature (353)..(353): n is a, c, g, or t
  misc_feature (355)..(355): n is a, c, g, or t
  misc_feature (371)..(371): n is a, c, g, or t
  misc_feature (392)..(392): n is a, c, g, or t
  misc_feature (395)..(395): n is a, c, g, or t
  misc_feature (403)..(403): n is a, c, g, or t
  misc_feature (512)..(512): n is a, c, g, or t
  misc_feature (518)..(519): n is a, c, g, or t
  misc_feature (521)..(521): n is a, c, g, or t
  misc_feature (524)..(524): n is a, c, g, or t
  misc_feature (638)..(638): n is a, c, g, or t
  misc_feature (663)..(663): n is a, c, g, or t
  misc_feature (687)..(687): n is a, c, g, or t
  misc_feature (690)..(691): n is a, c, g, or t
  misc_feature (699)..(699): n is a, c, g, or t
  misc_feature (701)..(701): n is a, c, g, or t
  misc_feature (715)..(717): n is a, c, g, or t
  misc_feature (720)..(722): n is a, c, g, or t
  misc_feature (797)..(797): n is a, c, g, or t
gttgctcccctgccgggtgtgttagaagcaagtnagaggaagaaggtcttggggactacgggcgccaccgagaacccatacgaggnagccgccgacggggggtcgccggggcggggccagaacggcgcgcgaaggccaaccagaacggcggcaagaactagggggacgcggggcaggtgctgtgggagttggctggacctgtgggatcgacgtctgcgccgtncaggagccgcccaggggagagagcggagactcgggaggaggatgtgcgctccgacccgggcaaggcttcccatccctcccttcctcttnnnnnnnnggggggggggggggtcggggtgaggatcnnaccncnagctctgccaagaaanaccgaataccttgagagcganacntaagcgcnggggaagacagggatagaagagacgacagcgctttgataagagggtttttagactaacttccacctgtgacgagtgcatggggcctgcgccctgagaggttgcctttcnttttcnncncgnaccctgggggtttgtggtgatgttaagttctgttaggaccaaggtggatctcagtaaggaggtagagtagatttgtgaacagctgtcggaggtagaatctttgcagacccagantgggtgggtgtagacactttgccangggtggtagctttatttgtaatcntcnnagtgaaancnttgggaaatccagnnntcnnnaactcttgcgtttcttgtaagactttctaagcgcatggctttgtcgtaagacttctcgtggccatgtgtctcacnc

SEQ ID NO: 493992 - DNA, 313 bp, Homo sapiens
agggcggaagaaagatttagtggcccggcgcggtgggtcatgcctgtaatcctagcactttaggaggccgagacggtagaatcgcttgagtccaggagttggagaccagccctggcaacatagtgagaccctgtctctattaaaaaaaaaaaaaatttgaaattcagccaggaaaatgcctttagcccctgtttagaagttgttggggaggctgaggtggaaagattgtttgagcctgaaaaatcgaggttgaagtgagttttgattgaaccactacactccagtttgggtgaaagaccaaggccctgtttca

SEQ ID NO: 493993 - DNA, 130 bp, Homo sapiens
gagtgatcctcctttccaaagcggagatgctgcagttaggctgttggttagggcaatgaactaggacagtcccacagtgtaccttcagatcatcttttctctccatttcatgtcccctaaccaacagcct

SEQ ID NO: 493994 - DNA, 253 bp, Homo sapiens
agaacaagactctgtctcacaaaagaaaatataaaaatttgaggccaggtgtagtggctcacgcctgtgattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgaggcaggagaattgcttgaccccggga

SEQ ID NO: 493995 - DNA, 173 bp, Homo sapiens
tgccgagacaggcgatctcagtcgatgatgcgccgtggcgatctgggctcagcaggcggatgcatggtccttcaggatcaggccttcttcatggcgtggaagagggagatgagcttcccagagtaggggttccttgtacccagtgacggcgcgcctctggccgacagcagctt

SEQ ID NO: 493996 - DNA, 217 bp, Homo sapiens
gacagcagcacacaggattccaggaaccagtgtttgatgaagctaggactgagcgagcaagctagcaagcagcatcttcgtggctgaatatcggaaaagagtccaggagccactgcgatttggtgaaggaagctaggaagaacgaaggagcgctaactatttggtggtcaagctcggatacaggattctaggatggagcgagtgcaacaagtgtgct

SEQ ID NO: 493997 - DNA, 474 bp, Homo sapiens
gccaatgttgtaatttgtattttccctttaaaattatttattttttccagatattcacatttactgatataacattgttcttgaaattgacaaagtcttttagatctgtagtcttgtctcttttaagacagagtattggccaggctaggtggctcacgcctgtaatcccagcactttgggaggctgaggcaggtggatcacagggtcgggagtttgagaccaggctgcccaatatggcaaagccccgtctctgccgaaaagacaaaaaattagctgggtgtagtggcaggtccctgtaatcccagctacttgggaggctgaggcaggagaaccgcttgaacctgggaggcggaggttgcagcgagctgagatcgcgccactgtactgtagcctgggcaacaagggtgaaactctgtttttttttttttttttactgtagcctgggcaacaagggtgaaactcttttttttttga

SEQ ID NO: 493998 - DNA, 213 bp, Homo sapiens
aaaccccccgggaaaattttcccccccccccgggaaaaaaaagggggaaaaaaaaaatttttttataatgtgggcttaaataaaaagccccccggggcgggtttttttaaaccccgccctttttttccggggggggccccgggtttttttgcccccccccggggcgggggaatttttaaaaaacccctttaattccaaagggtttttggggta

SEQ ID NO: 493999 - DNA, 494 bp, Homo sapiens
cccatttcctccacagagaaactcggggagctgctcaggggtgtctggggcgtccccaagagcggcaccccgcagcctcggtgctctggacttcgggagccaggttactccgggttggtctcctcagcacaccgagcagcaccccgggcctctgcccaccagaggccaacagcctggccccagctgtgaggactgaaatatctccagatgttgccacgggtcccctgggaggcagaagcagccacagtttgaactgtgccctagaagacggcaaagctccacagaggccttccctcctcatgtccctgtcctgtgcatgaagtctggtggggaccccagaggcaggggcttgaggatttgtgccggagagtcccgagactgcagcagggccgacctggatccctccctccctgccttgcccctcccaagctgtgtgagtctctcaacctttcacagtgtcagaatcctctgtacaataaagttcatcagatcca

SEQ ID NO: 494000 - DNA, 341 bp, Homo sapiens
  misc_feature (39)..(39): n is a, c, g, or t
  misc_feature (243)..(243): n is a, c, g, or t
  misc_feature (327)..(327): n is a, c, g, or t
gcactcccaccactgcccctgcagcaccgaggggcaggntgctggggtcctgttacctactgcgtcccacgaaacgcaggcctggggggctccaaaagcttgttctccactcagcctgtaggctcctccttgatcctgcttggcctgcagaccctcctcccaccccttgaaccagggcatctggatgctgactctgtggtggcctctgatgtctgacaccaccaacagaccctgggccaggtncctgaccccagactctgtgcctgaggccatggtatagtggggaagaccaggctcagggccctagagtccccctcccagcccatnttgagcaacgtggg

SEQ ID NO: 494001 - DNA, 436 bp, Homo sapiens
  misc_feature (149)..(149): n is a, c, g, or t
  misc_feature (167)..(167): n is a, c, g, or t
  misc_feature (314)..(314): n is a, c, g, or t
  misc_feature (325)..(325): n is a, c, g, or t
  misc_feature (334)..(334): n is a, c, g, or t
  misc_feature (349)..(349): n is a, c, g, or t
  misc_feature (378)..(378): n is a, c, g, or t
  misc_feature (428)..(428): n is a, c, g, or t
actaagggagcttggcaatcttaccccgccttgtggccggaagacatcgcctctagatcaccagtagtagaggccccgcctggtcagtgaccagatgcttaacgcccggcggtaccctaagccgtgcggaggtgagcatcatcagtttngtccttcaaatagggccnctgtatggatggctacacgagggttcagctgtctcttacggtgtgaggagtggtaatgaccttcccctggagaggcggtgatggtgcagcaagacgaggagaccctatggatctcccatttattaatgcgggcagtacctaactaancctcgggtccnaaactaccnaaccttcaatggaantttcggttgggacgacctcggaacagatnccaacctccgaccagtacatatcttagacttcgccagtccaaccgtgctnctaaaaaa

SEQ ID NO: 494002 - DNA, 103 bp, Homo sapiens
  misc_feature (5)..(5): n is a, c, g, or t
tattngtgtgtcgacgtgtattcaccatgcggtcatggctccctgtacaagtaccgtcgagaagtgagcacgtgctgacctccaaatatcgtaagctggagct

SEQ ID NO: 494003 - DNA, 992 bp, Homo sapiens
acaaggaggaagttgctattgaagtctcaagagacatacatatcgaacgcttgtgaatgaagagagaaacatacaacatcttataatcattaatacctgtcatgttcgcctcaagacctatctgtggcccagtatgcattattgttgtggaaagtgtaaccgaatgtgaccacgcgccaccatgtgcctggagcttggattagaagcaatcacgattctgtatggttgcgacattaagtaacaaagaactggttagttgaacagatattctgaaaaggaaagagcataatgagtgaatatttagtccatcaatgtacctggacccctaatgccttaaaatacctggcaactacttgggaagaggcattcgtttaaaaattgcatgtaattgacgtggttgttattgcgacccatgcgccagagtggccagggagcactggaacaaggtaactgcacttattgagaaatattcttggcaatcaaaaaagcacgtaagtctgctagagagtaatctatctgtgaaaagttcctcagtgattctatagtgagactgtctagtaactcagtgcgatgatactagggctgtgctacggtccactttgcctgctgaaggatgatacattgctattccgagaacatttgtgcatcagagcgttatatggaagccccatgaaaacttttaatgagtggttttaggcatatgaatttccgttccagtaaaaaactggcttttgaatacctcaagcgattttactgagaaaggtgctctgaaccccatgaccctacaatttaccggattgggttttggccaggcctttggttccccactggtgagttgaggacactgtctacgggccgggttgcggaatgaggggaagctctcgttcacaagttcctttaaactttgcccctttgtttcatggaaagggctgcccttattttcgcgcccataagacgttttgagtccacaaatttctggcacgcggggtttg

SEQ ID NO: 494004 - DNA, 126 bp, Homo sapiens
aagcttaatagtgaacagccaaaagctatatgtgatggcttattgtagtgaaggtaactaagacgtggtgttccatgactatcagagtacatccatggcggaggtccagttatttgagctttgacc

SEQ ID NO: 494005 - DNA, 516 bp, Homo sapiens
  misc_feature (145)..(145): n is a, c, g, or t
  misc_feature (177)..(178): n is a, c, g, or t
ccgcgcctcgccaagaacgccggcgctgagttctccgacaaaggctattccaccatcgtcgcccgtgccgagggcgatgacgaactggtcgagatcctcgggttgcgcatcgacattccggccaagctgttgcgcgacctgctgncagcgcgccaaggataccgtacgcgcccgccnntgtcgcgctcgcatcgccccgggcacgcgaggagatcagccaggtgctgaacgacatcgcccaggacgaggcccgcagccgcgccgcaactagcgcatcgccgaagagctggtcaagctgatgaagcagctgaacgagctcgatgacgcggcggtctacaaattcgccgagagcggcaagttcgacgaagtcacggtcgtctgccgtgctcaacgacatgccgatcgcgatgatcgagcgcctgatgctcggcctgcgctccgacctgctgctgatcccgtgtcgttcggcgcggctcaactggccgacggtcgagaccatccatggcaagcggccgc

SEQ ID NO: 494006 - DNA, 812 bp, Homo sapiens
  misc_feature (365)..(365): n is a, c, g, or t
acccaccgaggcagctgtcagcctgggctgagggtgggcatgaggcacggagtcagcacttggatctagcggatgtgagtgtttttctgtgccccaagttgtagtggaaggtgggcactagctgctggtgcccacagacacagccagtcggtggcaaacagggaggtctagcccagcagagagatgaggacatttggcttctccttcatgcccgacagctatgagctgagcttctgcttggcttggaaatgaaataagacttggtatgaatatgtgccaaggcctccccagttgtcatcctgcctctttgtgccctcgccgtgtcctttggccccctatccctacacccatgcaccctgtttccnttacagattttgatatggttcgtagtgtgtaatagaaccaagccgagtcgcccttttatcagaagggtctgaagaaggcagcgagcggacagagtaggtgaacacatggcctgcaagtgcgaccagcgtcagacccagtacgtgtgcccacagtggacacacttcacatgctccaaatataacgccaccgcggcagggcatgtgtacacggcatgtacagaaacagcattgcatgcactagcagatgggcactcagcacagatgtggagagggactggtctgatcctgctgaaagccattaaggagaaagcgaatttcccagtgccgggctgcagcagagccttataggggccctgtttccgtggggatgcgcttcctctggcagcaagccccaattgccaagtcactggtggataacttttccgtgccttctcaagaggcgagaaa

SEQ ID NO: 494007 - DNA, 172 bp, Homo sapiens
ggtcggagcctggacgggatactcgaaggggaattcatcggtcatgctgctcggtgaaccgagacatgcctcttgtccgtggggtcttgctgatgtaccagttcttctgggccacacggggctgagtggggtacacgcaggtctcaccagtctccatgtagcagaactgact

SEQ ID NO: 494008 - DNA, 145 bp, Homo sapiens
tattatgtgggtttgtcacctaaagtattttaaaataaagactggtttgtatatttatttatttatttatttatttatttatttattatatttatttattatagagatggagtctcgctcatgttgcccagctgtggatgagacg

SEQ ID NO: 494009 - DNA, 580 bp, Homo sapiens
ggcacgaggtctacggagactgtgacttccagctagggaaactagatggcatgctctccgcggtatacgctgcgaatgcagtccagactcaggcgaagacgtgcgcaaggagtgccaagactgcccgctgctggccacgctgaacgacaccagcgtggtgcacagccgagaaagctgccctggccgccttcaacgctcagaacaacggctccaattctcagctggaggaaatttcccgggctcagcttgagccactccgacctgctacctatgaggagtatacagtgactggcactgactgagatgtaaagaggcacacaggcagcaagtgaacctgctggaggaacctgccggtgttcaacacagccgtgactacagtccacagatgagcatgagagtccaccggtgggatcaatgcactctcgatcaatgggactgactcacagtgctacccagatcatggactgagtcccagagacatgacgcgacacactgaccactcagtgcgctatagacactcgaaactagctcgatcaccaggaggcattcgcttggcggtctcagcgtagtgacctgctgc

SEQ ID NO: 494010 - DNA, 830 bp, Homo sapiens
aatgtcttttttataaagcaaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttccaatggggggttcctggcaatcggtttcataattaagggcctccatttaatctctatttcataatttttaattttaagcgcagcaattgaaccaaaatgggccagtttaaaaattggtgtgcgcctggtaccacaaatgtgtccagagggttaagaaaacgccttctttggatttgggtggggccttggattggccttgggttaagggtaaagggaaccggttacacttgggagcttgggaacccaaggcagcgctttgggtgaacctgggcccggggatagaaaattggcgggggaaagctatagagcaaggggaggggccctgaaggccgtgccaggggtgtacaggggtgctccaattaaggggcggtcctacgggtaccctttaatggtgacttcaacatttccaaagctttacaggggtccataggtgttctccgcgtactggtgttttaccaccaagtgggctttcttggtcctagttcgcggtaccaattttgcgggcaagaggttacaaacttggtttatccagaccataatttattggcggggccatgtatccattaaattgggttaccgttaggcacaggtaggccggctattgccgaaaaattgccttaagacta

SEQ ID NO: 494011 - DNA, 147 bp, Homo sapiens
accgcatactcggcagggctcccgcggtctcggcggaggcgggcgtgggccacgagagtgtggaggagttgtacttgtacaggtcgaagagtgtctgctctgtgatacggtccagctcttccagctcctctttaatttccttgtacc

SEQ ID NO: 494012 - DNA, 169 bp, Homo sapiens
gagagcagcctaattccatacaggtttcttacgtcaagtagaaaatgatttcgacagttcctgagaactgacaatcatctttcattatcagggtaattctatcacttcaataagaattatataagtgctttgacaatcgcgtgttgtgttgttcagtcatgtttggctt

SEQ ID NO: 494013 - DNA, 186 bp, Homo sapiens
tgactactttgccaggctctactgacctatgacgactttttgtaccacagtgacattcaagttcattctggcaacgctctacccagtgtctgcccgcactggtttacatggagcgcctcgaagtccacagcaattgctccgtcgcctacttcaatgcttccaggtcacagggcccagcatctactc

SEQ ID NO: 494014 - DNA, 139 bp, Homo sapiens
gtaaggttgtacagaggttggtccagtgtgttcagtgtgatatcagtgaaggtccagctccaggagaagcctgttttcaagaaggttgacagaagaactagggggtttcagattaatgtcctccatagcagcctttcgt

SEQ ID NO: 494015 - DNA, 103 bp, Homo sapiens
tgcatcacttcgcgcacacaaatcgctccaccaacaggatttgcgcgaggatgtgtgcgcgaagttgtgtgcgaggatgtgtgcgcgaggatgtgtagcgcga

SEQ ID NO: 494016 - DNA, 86 bp, Homo sapiens
  misc_feature (2)..(2): n is a, c, g, or t
  misc_feature (79)..(79): n is a, c, g, or t
anagagatacacaaaaggcacaacaatcctaaaaatcatatacaaaacaggagcacaactaccccttcccatataaatnaacaggg

SEQ ID NO: 494017 - DNA, 923 bp, Homo sapiens
agtgtccattacggccgggggggctatgctggcttgacaggggctgggctcttccgaacagaagcatggatctcggaagtccctgagctgctggagcgcgtgtgtggagccccccagaggatatgctttcgtcgacaaggaatccgtcgcctggcagctggtgactccaaatgtcctcacctcgcagtaggttcctggtaacctgaggactactgagaacagggactgtcgatggcttggaagtcccggtggggaccgttgtactgtatcaggtggagccacaggcatttatgggggcctgatttccctgcatggtcaagtgaactgccctttgatgctcatggcccacattctgtcccaagagcaggcaccgtagcccccagtgccctgtacaaccctgctgcgctgtcaaagcactgttccatgactcgatgaggagaagcgtccgctggggcgggagggggtcgcgcgtgcctctcagcctgtcccctcacacaaggcgagaaggagagggtgctcaaggaaggtcaggagggaacatccgtaacaagcaggcagtcaggagcagcggccggggaagacggagtacacttgatggggtggaaagccggtggcaagcctgttctgcacaggagccatggaaatgctggaagacagtcatggcctgggcaggcacgatcttctgggaagttcaatcacgcagattggagacgctattggtccaacttgcaagaaggcgccacagccccatgtgttagagactaacccgggcaatatcagcacagggcaactcaagaccaaagggcgcgggacgcccgggggagaaatagcaagaacaacgatcggcacggacacaccggcccgcgaaataaactagcagaagaccacagacaagacacacaagcagacacgacacccccaca

SEQ ID NO: 494018 - DNA, 143 bp, Homo sapiens
atcccccacgagccggcggccacgctgagatcgtcctctgcttgcgcattccctcggcatccggacgacgctcagcggtgagtgacatggccccagacgtcccgttacttcggtgatccgacgccaggccacgtcccagatgc

SEQ ID NO: 494019 - DNA, 167 bp, Homo sapiens
  misc_feature (45)..(45): n is a, c, g, or t
cgactctagaaggatcccctcaacgctttatacttccctcaacgnctttatactttctcacgctttatacttccgtattgaattcaagtataatattaagtatgcatggaagtataaagcgttgaggtgcgtaggcgacggcgcggcgggaagtataaagcgttgag

SEQ ID NO: 494020 - DNA, 874 bp, Homo sapiens
cagcaccttcttcgaacccgtccgtgaaggaggatgaccccattctatagccaacacctattctgattctgacggtctaccctggaaagctaatattcttgtactaccaggcttcgagaagaatctcccatattgtagcttacatactccgtgcaataaacgagccactttgcgggtcacataggtatggtctgagactatgatatcaactagtgttgtcctacgggatgttagcgggtgagcacagcatatatgtacaggaggaatgagacgtagacgcatgagcatatctaaccgtccggtggccataatcatcgctatccccaccggcgtcaaagtatgtagctgactcggccacactccacggaagcaatatgaaatgatctgctgcagtgctctgagccctaggattcatctttcttttcaccgtaggtggcctgactggcatgtattagcaaactcatcactagacatcgtactacacgacacgtactacgttgtagcccattccaatatgtcctatcaataggagctgtatttgccatcataggaggctccattcatgatttaccctatctcaggtgacacctagaccaaaactacgccaaatcatttcactatcatatgcatcggcgtcaattaacttcttccacacacttctcggctatcggatgcccgagttctcggactaccgatgttcccaagaaatctatcattgtagccctcctttctacgggattatattctgatggaggctcgtcgaggaagcattgaaaactccaccggggattgggcccccccatgaacgttatcaaagggcgccagccgacagcgtgaaaaaaaagccgcgctctggccgagatcgtccgaaccg

SEQ ID NO: 494021 - DNA, 1214 bp, Homo sapiens
gctgagccagcaggctgacggtgatcgattcggcagctgcaagagctgcggctggctggcaggacggacggtcctggctccatgcgtggagacctcgctgcagcagaagatgagtgctcagcaggcccagtgccatggagctagaggctctggcactgggcggcagcacaggccggccgcagctgcaggctgagggcctgcgtgctgctttggctaggggctgcggttgtccggcaagaattttggcacagcagtggtgcagccagctgtgagctggcacagcaggttccagcaggctgcacccaagcagcagctgtcctctttgaccacaggctccacgcaggagtgctctttccagtttagaccatgcaaggctgcagggctatgcgagcaagtctctggcagtcagtacttggcaaacccagcacagcagccagggggcacagcccacaggcagctaggcctgcaggctccagcgtggcaggcctgagctagcttcgggcaagcgagctggcagcaagcaccacaggcaagacttggcagtgactcagggtgcaacactagcgttagcgcactctacagaaaaaatatagcagggaggcaaacaagatacccatacttgcagaacccaaagactagcaactgggacactaggagcagacaagaaaaagcacccagggcacaacccattgcaagcgaactatcgcagaggcacggaaccggagagacagacctgaccaggccacacagagagaacaccgcagacaaggagcgggaatgcacgagaccaaggacagcatcgcacggacggggcggaaggacgagcatgcatccggggaatgtgggacctcacaacagtgggaacaaggagtaacatgccgcgaaaacaggcaggcaggcaatgctgaagttgaacccaggacgggcacaagacgcagcgaggtgtatgatgacggttattgggtgacatgccatcacgtgaaaggagtcggggcttgttgtcgagaactgagggcagccaaagacaacggcgaacaggcgcagggagaagagggggccaggcggggcgagacacacgagcagagaagaagaagaattggggccggaggaacagaaaagcaaccaagccgacgaggcgagccagcggaccggcaggaggggagagggaacggcgaagaccacagaaaaaagggcggggggcgccagacagagag

SEQ ID NO: 494022 - DNA, 116 bp, Homo sapiens
ttggggctccattcaggtgagggcagagtattatggccttggagctcctctcctcgctggtggcacacataatgccagtaagaagatccacactgcagccccagttaggcgctgcc

SEQ ID NO: 494023 - DNA, 193 bp, Homo sapiens
  misc_feature (43)..(45): n is a, c, g, or t
  misc_feature (47)..(48): n is a, c, g, or t
  misc_feature (50)..(50): n is a, c, g, or t
  misc_feature (55)..(55): n is a, c, g, or t
  misc_feature (61)..(61): n is a, c, g, or t
  misc_feature (65)..(65): n is a, c, g, or t
  misc_feature (187)..(187): n is a, c, g, or t
gcggcggcgtatcgcttaactaaattattattataattattannntnngnagatngatatngccngcgcgggggagtatcgctggagtttcaaaagggaagtggtatctccttcatcaagactacttgccattgagtccatactggcaggaagatgaagcatacacacggctgtatggctcagcgcngggtac

SEQ ID NO: 494024 - DNA, 183 bp, Homo sapiens
caagtataaataaaatcctgagttttaaaattttgagtcccgcttaaacattttaaaaattttgttatgtatttttctttgaacatgtctttctgcctgcaaacaaaacagaattttagtattggtttacaaaaagttaactaaacccatatattactttaaaaataaatgttaagggcaaga

SEQ ID NO: 494025 - DNA, 562 bp, Homo sapiens
  misc_feature (23)..(23): n is a, c, g, or t
  misc_feature (67)..(67): n is a, c, g, or t
  misc_feature (123)..(123): n is a, c, g, or t
  misc_feature (142)..(142): n is a, c, g, or t
  misc_feature (171)..(171): n is a, c, g, or t
accagtggggcctgaagattaanagcttggactttggattgaaaggctccagttccagattctgatnccttgactatacgccttggacagattccttaatttctctgaagtctgggttttccntcatctgaaaaatacttgncagtaggctgggcacagtggttcttgccngtaatcccagcactttggcacctgaggctggcagatcacttgaggtcaggagttcaagaccagcctggccaacatggtaaaacctcgtctccattaaaaatacaaaaatagggccaggtgctgtggctcatgcctgtaatcccagcactttggcaggccaaggcgggtggatcacctgaggtcgggagttcaagaccagcctgaccaacatggagaaaccccatctccactgaaaatacaaaattagacaggtgtagtggtgcatgcctgtaatctcagctacttgggaggctgagacaggagaatcgcttgaacctgggaggcggagattgtggtgagtcgaaatcgtgccattgcactccagcctgggcaacaagcgagactccgtctc

SEQ ID NO: 494026 - DNA, 792 bp, Homo sapiens
gaccgcagcgtaggtgctaccacctgtgcgtcgccgccgccattttgatggctggaagagtccggttctgggacagctggaacagtggtggtgactggaataactttaccaaatgtaaagctattgcggaactaatcttctccagcggagatggccaaatgtgctttgtaacagagccagactgttttcctatctcccaggatttttgctctttacttaaaagggttgtcatcccaaagcctttttcgactgcaggatcatcaggttcggatgagtctcatgtggctgctgcaccctccaagatatattgctctcgaaacagtgtggcctcgactgaaactattggggacccttttggacctcaagatcacgaaggttccaggcttccttgggaacatagggttttaggatgtcaccttcgcatggggactgcgttcacaggaacgaaaagcctggttcataaaaacttttgcctgatgttctagcagaaccctttattcacggtgaacgaccatgacgtatgctagatgggccccactattgtgcaattgcacctttcagggggttactggatgccaccctggtttgaaacaatgaacagtttaacgcagtgcaggaaagaccttacttttgcacagttgcccagaaggtagacgggtgtccctatacaaaaacattgtcccagcacattgcttgcgccacaacgattttggactcacctggttgtccaggaagtaggcttcgtggcgaactaatgaattctgactggtaacctcacaaaactaagaattg

SEQ ID NO: 494027 - DNA, 221 bp, Homo sapiens
cgcagtagggcatcaagcaagaggaagaaagtggagatctacgatgtcctcatgtctactcacatgcacacgttacgtttgatcgggtttctgggccacatggtctgtgaatcactttcaggtctgaggatacaagagtcattgaaaaaggtaaaatagcctgggtcagtggctcacgcctgtaatcccagcactgtgggaggccaaggcaggtggatcag

SEQ ID NO: 494028 - DNA, 207 bp, Homo sapiens
gcggacctattggggatcgcctggtggctggcgatcaccaagctagcaagtgatcttccgttcttgtcatcattcacagtcgtgacactgacgctgcgcacaggagtcttgaacttgataagaggatgggtatgattatgcctgttgctcgggtgtgcttcgcagttctggcagaaatcggtatcgtggcacactgcgcacttgtag

SEQ ID NO: 494029 - DNA, 386 bp, Homo sapiens
ggtggaaaaaaaagcatgtccggtccctccgggcttggccacattattaacccaggaggaatgtcagggggcggcaattttgccccagggggggcctcccggggccctcccatcccacccggtggcatgcagggcgggtttggaggccaaaaccgggggagcaggcccaacgatgcccgcttcacttgccgctaatgagaacttggaatcctgtgtcctgtttcgtggcaacaaggctatgttctgttaggagttcccttaaactgggtaaaaaaatttttttttaatttgctgccaaattgtagctcaaaacaatgtgaatttgtttttcgttttggggttttttttttttgtaaaaaatgtgtttccgttcacaaaccctttta

SEQ ID NO: 494030 - DNA, 350 bp, Homo sapiens
  misc_feature (324)..(324): n is a, c, g, or t
cagaatggcacgctctacatcgcctgttacgaaccgtcatgcatcattcgcctgaccgctggcggtacgccggaaacctatctcaccgaccccacggcccacacactctgtcaccccacgaactgcgccttccgagcatcggagttgttcattgccaacctcggccggtggcacctggccgtcatcgacaccgacaccacgggactggcgctcccggtcctgtaaaccagccatccgcatcacgcaacgtccggccactttcgatcgcagcagaggaacgaatccaccatgcccgttgaccgcgaacccgccgatgagagccgnatgcagcccactaccgccggcaactc

SEQ ID NO: 494031 - DNA, 286 bp, Homo sapiens
acaacccaaagtccgggactaaaacattttcggtttctagtggttgttacgaagctacaagagcgacgatggaggatgacgcaccgagtgttgatggtcgagatgtctccgggagcggcgaggctttaacgagggagggaggcagaacttcaatgtgaggcctcagtctggggcaaatgggcttcccaaacactcctactggttggacctctggcttttcatccttttcgatgtggtggtgtttctctttgtgtattttttgccatgacttgttagcgcgtgctgt

SEQ ID NO: 494032 - DNA, 1483 bp, Homo sapiens
tgtgtaggagagctcctcgctagagttgttgatgatacacgcaggcggagaatttgttttccccgaggacagacgaggggatattttttttgctgggtgctccagcggacgaccgccgtggggggggtgactaccataccgttcataaactggtagaaagaagagtcgcccctatgtcggggccaagggcctgtataaatatgccgcggccgctttctgcgtcgcacgacggaaagagagttcgtgtgtggtgttatgatgatagtatggttgatcacaaccgctttctctggagagattctctatagtaggaatggtaagagcggtgtgtaaaatagacccccgaaaatggacggctatcgaaggaagaggagccggaaagtagttttggttgtgtaggaaaggcccccccactttggtcgacggagaattttcatgtaaagcattcgtgggcaccatgtgtgttttgtcccccgccccccgacgttaagcgggggttggtgtggttgccccagagaaatggcgtgttgttgagagaagaaaggtttgcgatgtgcccccacgatatgtccccacgggagaagggttaccccccacgtgtttaaatagaagaagggagttgttggcctgtggagaccccacaaggccacaaaagattttttgtggcgcacatccaacaaagggtgttacacgccagcgccacagtggtctctgtgggaccccacagagggcttcgagactcgtttgtggcgtttttaaagactgccctctctctctcgtgaaaagggcacttttttggacactatgtgtgcccccgccaaggctcgccctctgttctcgagataagagaagagcccccacgtgggccacgaaggcggccttctgtaaactgtgtgcacacatgtgtctttacactgccgtgagatatatgacctcatctctatagaggagaaaaatgttagagagtttcacaggggtgacaccacagagaatggagattataggagttgaccgcagagtttgatatggcgcacattgttccacgtatcccgtatattctataagagaaaataaaatatacgcaccacgctaaggaggctcttctagagcacttgttctcggttgtttataacgctggttctgttcactcacaaatttcccctctttcacgtttttaaagagaatgttcgtctaaccacgaagaaaaatgctgtaaatattttgtaacacacacttttttttaaccagggcccaaaaaaagaaaaaaaggtttttgggaaccacaatgagacttattaaagtggttttatataaaaccatccaattgtctttgtatattttggataagccacgccagtacccagcgtttccatttgtacaccagtctgtggccattggaaaaaaaggagtcttgtgattgttgaagtgaattatgttatataatgccaagagaagattaaatatttaaaaacatattttttta

SEQ ID NO: 494033 - DNA, 347 bp, Homo sapiens
tgaacactcgatgtttttcatctacacaatagaggtaatcctagtaaccgtctcatatggtggttgtgaggattaaatgggattgctagcatggaacctggtgaagcactccataacggttcaaacagtggtagtaataacagtaataacaatagcaatattatctgatctctctgggcctctgttagccagctgtaaattcgatctctttccctctcccttccaactttactgagttcttttaataaccagccacgggcttggaaatgccttgacctttactaaccgagttgtatattgagcctagccctagcccttttaagtggcactgcccgggctccccagat

SEQ ID NO: 494034 - DNA, 1471 bp, Homo sapiens
gccctggtgtgattaccgtcctgcgacggttgttctctggagcagcgtacttttatctccgatccgacttctcatcctaccataagtgcgtgccgacacccgatggaagattcgatggacatggacatgagcccccatgaggccccagaactactcttttcggttgtgaccctacacacggccgaaacacagacttactcaccatttacacggtggactaactgactgacaccactgaccgcaaccacgttactcctttacacgacacccggatcacgattatacgagggactggatgcaacacggctgacgattgcaacactatgattgaacgcacgcaggcaactgacattaccgaacaggcagatccacaattacaacgtaacacacattggaaacatttagacacaaaatgtcatggtaccagaccaccacgcggttatacacacatttgggcggagacatatttgaacaaattacaacgacacaacacacgaatgaggtcatataacgggatactgacacggtggtgggtttacaagagggactcaattgttgccaaattattcacgatcgggcaccacgacaaacatattaagataagacatggtatagagacggggcacacggagttggacactgaaaggatcaacaagaacaggcatatggacaatagacagagatcggaaccggaacatcggtctgcaaaacacatatcattgtcacagggatagtcacttccatggaggaaactacagaacgagaatacatagaatcacacattgtgaaatagggtggagatcacgacaccagagatttccccagacacgtacaactaatcatgttaaaacacatattgtaatcgaatgacctgtgccacgcactggacaatgaccgcacacggcaccgcaacggcaccgcacgagaccagcacatgacacgacacagccatgaccgtgcacaggacccggatcgcaccacagggcacagacgtgacaggaaccgcgagacacgcacaaccaaaacacagacacacgtaccaaataccaacagcaacaacgagacagacgacgaaagcgacatgacacaaaataatggcaccaaatagaggatgcacaagaaacaggcgaatgtagcaagagaaacagcaaaaataacagaaagaaatactaaatatcacaatagcagtcaatcaataggagatacaacaaaagattcatttcacagcgacacaatagttctaacaatcacgtaacatacatacaaaaggagacataaaatatgatataaacaatatcaacgcaccacaacgacctacatataaaaataagcgataaattaacaaaattaggaccacataataactaatacaacaacatggaaccaaaaatgaggaaaataaaacacaaatagtgtatcaatcgacaacaaggtaactatacaaaacatagcatgtaagtacacaaaagat

SEQ ID NO: 494035 - DNA, 662 bp, Homo sapiens
  misc_feature (8)..(8): n is a, c, g, or t
  misc_feature (75)..(76): n is a, c, g, or t
  misc_feature (82)..(82): n is a, c, g, or t
  misc_feature (88)..(88): n is a, c, g, or t
  misc_feature (91)..(92): n is a, c, g, or t
  misc_feature (106)..(106): n is a, c, g, or t
  misc_feature (113)..(113): n is a, c, g, or t
  misc_feature (115)..(118): n is a, c, g, or t
  misc_feature (121)..(121): n is a, c, g, or t
  misc_feature (137)..(137): n is a, c, g, or t
  misc_feature (147)..(147): n is a, c, g, or t
  misc_feature (150)..(150): n is a, c, g, or t
  misc_feature (170)..(170): n is a, c, g, or t
  misc_feature (181)..(182): n is a, c, g, or t
  misc_feature (191)..(191): n is a, c, g, or t
  misc_feature (193)..(195): n is a, c, g, or t
  misc_feature (199)..(199): n is a, c, g, or t
  misc_feature (204)..(204): n is a, c, g, or t
  misc_feature (218)..(218): n is a, c, g, or t
  misc_feature (227)..(227): n is a, c, g, or t
  misc_feature (259)..(259): n is a, c, g, or t
  misc_feature (285)..(285): n is a, c, g, or t
  misc_feature (289)..(289): n is a, c, g, or t
  misc_feature (305)..(305): n is a, c, g, or t
  misc_feature (309)..(310): n is a, c, g, or t
  misc_feature (358)..(359): n is a, c, g, or t
  misc_feature (372)..(373): n is a, c, g, or t
  misc_feature (379)..(379): n is a, c, g, or t
  misc_feature (389)..(389): n is a, c, g, or t
  misc_feature (396)..(396): n is a, c, g, or t
  misc_feature (401)..(402): n is a, c, g, or t
  misc_feature (408)..(408): n is a, c, g, or t
  misc_feature (423)..(423): n is a, c, g, or t
  misc_feature (476)..(476): n is a, c, g, or t
  misc_feature (478)..(478): n is a, c, g, or t
  misc_feature (510)..(510): n is a, c, g, or t
  misc_feature (518)..(518): n is a, c, g, or t
  misc_feature (521)..(521): n is a, c, g, or t
  misc_feature (542)..(542): n is a, c, g, or t
  misc_feature (557)..(557): n is a, c, g, or t
  misc_feature (575)..(575): n is a, c, g, or t
  misc_feature (578)..(578): n is a, c, g, or t
  misc_feature (588)..(588): n is a, c, g, or t
  misc_feature (627)..(627): n is a, c, g, or t
tccgatanagagactaaaaatacaaaccaaaactagcgtaatcccccagcccatacttcatttttaaacaaaaannccaacncctganaannattcttccccattnaaatccnannnncanctccagtcccaactcnaacccctgcntgncgccgggggcggcttcaggnttcgggcaagnnttccagcanannnaagnaggtngtggccctattgtnagttttcanccttcctgccctggtccaggctcaccatgttnttccgggggttgcaccaggtcacggngttnttggtagcgcattttngtcnntgttgtttgctctccagttttttggtgttcacatcccagatgttaagnnccccatcataggnncttgcnagtgcatagnttctgtncgggnngggcanagctttggtccagtnagaaccacacttgaggccatcggccctgaacacctggggggtgttgctgacangnaggtcgatgaccttgagtgtgttgtctcgggnccagctgngcnggtgcagttggtcgtggctgnggctcagggaggtgncccggccctgcacagggntgncctgggtgcngtggggccccctgctgtcccagaaccggattttttggtnattgtgggcactaatgatgatatggtccccacaca

SEQ ID NO: 494036 - DNA, 256 bp, Homo sapiens
acaggtggctttatctgggattggttgatcagggttgttgaaaatgagacgcctggtgagtcattttacgcttatggtggtgactctggggaccacccaatgatcggcaatttagtctggatggtttgcttttcccagaccgcaccccaaagccagccttactgggagcggcattttgtcagcagtactttggctttcgctgttcggacacgcctgtcacccgagcgtacaagttactagcagcatctgttaaaca

SEQ ID NO: 494037 - DNA, 328 bp, Homo sapiens
ttttcttttcctattgaaatagcacatctttctgatacaggccatctacttaaatcttcaacaaaatataaatatttgaaatgggattaaacaaaataatcacaattccatttcatctggtatttcagctgcttgccagccacttagttatattggatcttagcaaacactccaattagtggcaagaatgggaatgcccggtgacagatgtgtcattgactttttgtcctctggtagcaaagagcaatccttccaggacacaactgctgcatacatgcgtagtccaattgacgtaactacagtcattgttttaatggagcaggacttt

SEQ ID NO: 494038 - DNA, 1249 bp, Homo sapiens
  misc_feature (117)..(117): n is a, c, g, or t
taaagggggtggtttaaattattttattggtcctttgtgttacacataattctcacggtaagaggggttagtgaaaaatattacagaccactgtgggagtgttttaagaaacacctntacatgtgtggtgcccttccacttgggcgcgtggtaaattatatagtggtcaaagataaatctccccttataaaatgtgtgagcgcccacgtgtgtgtggagacaaaatgtggtaatttgtgtgggtctctcacacgcgtggacaaacatattattttcacacaaataggtctcaaaaaaaaaaaaaaaaaaaaaaaaaaaaaaaaaaaaaaataaaaagaaaaaaaaaaaaaaaaaaacaaaaaaaaaaacaaagaaacaaaaataaagaaaaaagaaaagcagagacagacgaaaaaggcaaaacaagaaacgaacagaagcaaaaactgaagaaaaacgacacgtggaacaaccaaaaaaacaaaaaaagaaaaaagaaaaaacacaaacagagagaagagagcaaacaagaaaaaaacaatgaaaccaaaaaacgaaaacataaacaaaagcgaataggaacaagaaaaaacaaaaacaagagacccaacaacagacagaagcaaagccgaaaacaagaaaaaaagaaacagacagaaagaggacagacagatagcagagggacaaaaaaaagagcaaaaagagaaacaaaaaacagaaaaaaaaaacaaagacgaaaaggaaaaaaagaaacaaaaaaccaaaaggaaaaaaaaacaaaaaaaaagcagagtgaacacgcgacagacaaggaaacaaaaaagcaaaggaagatacagaaagaaccacgaacaagtaggaacgaagaagaacaacgacaaagggagagcacaacggcagcaaaagagcagaacgaagaggaacgacacaacgcccacaaacgaacaggaggaagacgacaagagagaggatacatacgggatacacccaagaaaaacaagagaaacaacgacaagaagcaacaacaagacacaacagaaaaaaaaaagaacgaaaaaatagagacgaaaaaacagacccgcacgacaacaaaaaacaaccaagagaacgaatgaaagaacgagaaaacaacagacaacgcataaacaaaccgacggaggacaaaacacgatggaacacaaggagcacaaaacacacgacagacaaaaagaacaaagacaacaaggagacacacaacaccagacaacca

SEQ ID NO: 494039 - DNA, 1469 bp, Homo sapiens
  misc_feature (2)..(2): n is a, c, g, or t
  misc_feature (72)..(72): n is a, c, g, or t
  misc_feature (151)..(152): n is a, c, g, or t
  misc_feature (155)..(155): n is a, c, g, or t
  misc_feature (393)..(393): n is a, c, g, or t
  misc_feature (431)..(431): n is a, c, g, or t
  misc_feature (511)..(511): n is a, c, g, or t
  misc_feature (515)..(516): n is a, c, g, or t
  misc_feature (607)..(607): n is a, c, g, or t
  misc_feature (611)..(611): n is a, c, g, or t
  misc_feature (849)..(849): n is a, c, g, or t
anggaccttgtaaaactacaggcaggggaatatgtttctcttgggaaagtagaggcagctttgaagaatctnccactagtagataacatttgtgcatatgcaaacagttatcattcttatgtcattggatttgtgtgccaaatcaaaaggnnctnactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcgnacattgagcgaatgtatggaagaaaataattattctcntctggcatcagtttgctacagtgagctcagatcaaataggaaaatacttgaaatgcatgtctcaagctgcaaggcaaacnccanncctcatattaaactattacttctcatgacgtcaccatttttaactgacaggattagtaaaacattaagacagcaaacttgtgtctgtctcntctnccatttcccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaantacaagggtattgatatgaaattatgtaaatttcaaatgcttatgaatcaatcatgtcgaaccacaagattgtcgctgtcgtaattatcgtctatgtcatgcattctgagagaaataccatatacccatacttatgttttcacagcaagttgacgatcttgttcgaatcatatgcctgtccagtgtccttctttattaatcattccatttctttaattcacgaacaaaaattgaatctcgggtcggtgatagcactgaacacaagacatcacgcacagacgagggttcactcaagttctacatacagtaaagtggagcatacacaccagcatgttgtacaaccaccagattcgcataaatcgagactcttagtaagactctacgtggcaccaactgtgtcactgacagtcctccctgtctcctcctgatggaacaactcggggcaaaataccccacaattacagtcggagcgactttcttgaccaaacgacggatagaattcatcgacaaagtagtatatcaacgtatccatcgcatctccgggactatatgatatctgatatccatttggaaccaactactcccgacacactactatccaaacactcgttcagccaacc

SEQ ID NO: 494040 - DNA, 2872 bp, Homo sapiens
cttagatggcacaatccaggctgttgcaccccttcttttcatcagtgagatgtaaagtctttatcagggacttcaaatttgcatttgtcctagaactcactgctaggtaaatctgctaactatgcgagacagagagctacttattctctgctttgagattcccggaaacagcatctacagccttggacaaggccatagtctgttttacccctattagcttaacaggtcctaccttctgccttgctttggtttctcctactgtattttttttttttttttttttgagatggagtctcgctctgtctcccaggctggagtgcggtggcacaatctcggctcactgcaacctccgcctcccgggttaaagcgattctcttacctcagcttcctgagtagctgggattacaggagcatgccacaagacccagctaatttttgtgtttttagtagagacagagttttgccatgttggtcaggagttcaaaaccagcctgaccaacatggtgaaaccccgtctctactaaagatataaaaattagtcgtgtgtggtggcgcgtgcctgtaatcctagctactcaggaggctgaggcaagagaatcactggaacccggaaggtggaggttgcagcgagccgagattacaccattgcattccagcctaggcaacagagtgagactccatctcaaaaaaaaaaaaaaaaaaaagaagaagaagaaagaaatgatgcatgcaaagttcttagcacaatgcttgccaccattatgattattttcctattcttgggggtaaacagtgggtcttttctttgatgtggtctttgcaggaggccaagctcgttgttttgatctatgtaggggccgtttggttctgccctgttcccccatccatcctacaagcctaaccttggcctactggcaagacagatggtccttgtctcactggccttgcagtggggtgaaggtcattgttctgacccactaccctggcgatttgtcttggcccacattgctagatggggaagggctgtgggttggctcagccttacgcactgtctcctggcagtggcatgctgactagcattaggggtgaggccaacctctgcctcagtatgctggagccagctagagaagatgctttcccggagggtgtcagagccctgtttggtgttgaaacaacacagaaactgctgtgctcaccccttccccatctagcagtcagccacccagcccagcttctggtccttctactcactgtgactcctcacacattacacccacatgagcatgcatgcatacacacacgcgtgcacacacacgtgcgcacacacacatgcacacactcgcacacacgtgcgtgcacacacacgcgcgcacacacacaggcctgccctcatcttccccatccctgttactacccttcctcctcctggttaaataagcagcaaagggaaaagtgggcactgacaaaatgtgtaagctggcaggacctaatctaatatacaggtggataacaaaacctcatagccaatgaacaggacaggaatctgataactcacaagagtgtgctatagttttctgctgaaatttctaaaaaatttctcttcacagccactcctcttttggatcaaagataatcaaagtaagatgattcttctttacaaaataaggcgggtctcattacctttggcctgattacttacataagtgcagcaagaatggtaatcgatcacataggcctttttaaatttgctttgctgaaacttttcgtaaggaatctcagattgtacctttgaaagctacgaagccaaggcaagaattcgtcaccagattttgcctatagcacctacagattttgggtagatcttctcttcctgaagttcccaaaatatcctaagcctcctggacctggcaggaagtgaccttctttactcatctgtaatgctgaggacactgtaagccaggtaccaggctggctttccctagaagatattgtagactgggtccatcaagtctacttcagttccttaagactgtctggtcatatctgatgcatcattttcaaatatgacattccagtcaaagccttggttgtataaccagtatttcccatcatgtcctgttataaggaggacagattcttattgaacttgtgtgaataaatatattccatgaagatgagaacattcaataagaatttctggccaggcgtggtggctcacgcctgtaatcccaacactttgggaggctgaggcaggcagatcatctgaggtcaggcgttcgagaccagactggctagcatagtaaaaccccatctctactgaaaaatgcaaaaaaaaaaaaaaaaaaattagccgtggtggcaggtgcctgtaatcccagctacttgggaggctgaggcaggagaatcacttgaactcgggaggtggaggttgtgatgtgctgagatcgtgccattgtactccagcccaggcgacagaacaaaactccgtcccccaactcccacacccctcaaaaaaagaatttttgaattctggaggggttaggcagagagaaaaagataaatgcttcatttctgttttaaaaaagcataatcagccaggcacggcggctcacgcctgtaactccagcactttgggaggccgaggtgggtggatcacctgaggtcaggagtttgagaccagcctggccaacatggtgaaaccccatctctactaataatacaacaattagccaggcgtggtggcacgtctgtaatcccagctactccagaggctgaggcaggagaatggcttgaacccgggaggcagaggttgcagtgagccgagatcgcaccactgcactccagcctgggcgacagagtgagactccttctc

SEQ ID NO: 494041 - DNA, 156 bp, Homo sapiens
tccataatgtgtgcccagggcctgaactagcctgtggggcatggagcaggaggcagtggattttagaaacacttagaagggccaggcatggtggctcatgcctgtaatcccagcacttagggaggccgaggtgggtggatcacttgaggtcaggag

SEQ ID NO: 494042 - DNA, 184 bp, Homo sapiens
ctgtgctgtcaggtcatttgccactgagtcacctcatctagtttgcattgcttcattcaagcgttcttcatgtagaccacagagcttctcagcattagcctgtgagatgagaagaagaggttggacatgatttatagaagccgtgctgaattaactggataaggaaggaggataggggtggttc

SEQ ID NO: 494043 - DNA, 201 bp, Homo sapiens
ggtttgaccaacatggtgaaaccccatctctactaaaaatacaaaatttagccaggcatggtggtacgttcctgtaatcccaggtactcgggaggttgaggcaggaaaatcatttgaacctgggaggtggaggttgtcgtgagccaagatcacaccactgcactggtcgcagcctgggcaatcgagtgagatcctgtttca

SEQ ID NO: 494044 - DNA, 316 bp, Homo sapiens
cacgaggcggtaccccgacatccacgccgctgcctttggaacctgcctggccgcctccgtggttgcccctggctctggcagggtgctatatgctgtcttcagcagagacagccggcgcagtggggggcccggtgcgggcctctgcctgttcccgctgggcgaggcggacgccaagatggaggacagccgcaacgcctgctacacagggacccgggatgcccgtgacatcttctacaagcccttccacggcgatatccagtgcggcggccacgcgccgggctccaacaagagcttcccatgtggctcggggcacctg

SEQ ID NO: 494045 - DNA, 240 bp, Homo sapiens
tacatttgtaagaaaaacctagagagccatagatagtgcgacatctaaggtcctctgtacacagtgaattagcaaacctcagcctatgtgttactaccctgataatattctttgcaagggtatctagaagcctctaagtttttcacaactggagtatcacacacttgagtgaaacacaatacttaatgtatggtactagattgccaaatccataaaaggtgtctggaagctattggatgt

SEQ ID NO: 494046 - DNA, 524 bp, Homo sapiens
ctacctctttttcctgaagcttgaagctcttcgggatgtcttccagcgtaatcagcaggatggcaattggaggatcaacagggttgtggcagggcaggtacatccgcctaaagcaggatgtgttttcagccctggtagggcagggccagatatacgtgcatctcaatgatggtatctggagtctgatcaagtccggtaggttcagccctctacgcctcccgcctctacctgagccgataccaggacactcaaccagaacggctggccaagcacaccccaggtggcccatggatccgagggaatgtgtacatccacccgaacgccaaggtggccccctcggctgtgctgggcccaatgtctccatcgggaagggggtgaacgtgggtgagggtgtgcggctccgggagagcatcgtcctccaatgagccactttgcaggagcacacgtgtgtcctgcatagcatcgtgggctgggggagcaccgtgggacgctgggcccgcgttgagggtaccccagtgacccta

SEQ ID NO: 494047 - DNA, 382 bp, Homo sapiens
  misc_feature (176)..(176): n is a, c, g, or t
  misc_feature (192)..(192): n is a, c, g, or t
  misc_feature (216)..(216): n is a, c, g, or t
  misc_feature (233)..(233): n is a, c, g, or t
  misc_feature (272)..(272): n is a, c, g, or t
cccttaaacggggggccccaggcttattaaaggagatggcgaggtcctaaaggaaattgtaaccaaagaacgacccaaaaagatcaacaagcaagccccccgagggggctgcctggccttccaaattcgaagtgggttgcttcccttagggccccccctggccaaggcctttggangaccctggcggcccancctgggcaggtttcagggggccantgggaaaccttatgggngctggtggcctttcccccctggattggtttttggcccancccagttttttttcaggggcagggggtggaggttggggtccccggcctgcttggcccccccattttaaaaagcagcccttttcagctattaaaggccccctggatagcca

SEQ ID NO: 494048 - DNA, 627 bp, Homo sapiens
tagaggatcccggtattgagtggccatgtgaggtcatgttttcctggatggtgttaatgctagtagatgttcttcagtgtctgggcatgaagagttgagcatttatgtagtcttcactgtccaggcttatttataggcagcctttttggaaaggctttccagatttgaaaggacttgagttttgtgatctaaggcatttctgctttagagggcaccctaagcccagtaatgctgtggttcttgcacagtcatagaggtaccaccttaatagtcttagacaaaatctggttgaattatctaggttaccaggcagagactcttgttctctttccttactttctgccaaacatacagtctctgtctcttctaagccacctaaagccacctttaacctcattagaaagtgacacaagcacccccgtggccacctaccactatgactgtgctccaaccaagaatttcatatacagccaaactaagccttataagcgaaggagaaataagatccttttcagacaagcaaatgctaagggaatttattaccaccagacctgccttacaagaggttcttaagggagtgctaaatatggaaaccaaagaccatcacatggccactcaatactgggt

SEQ ID NO: 494049 - DNA, 714 bp, Homo sapiens
tttgggctctagagggggtagagggggtgctatagggtaaatacgggccctatttcaaagatttttaggggaataaattctaggacgatgggcatgaaactgtgtgttggccccacagatttcaaagccattgaccgtagtatacccccggtcggtgtagcggtgaaaaggtggttgggtttagacgtccgggaatgtgcatcgtgttttataagccctaagttgtggggacagctcatgagtgcaagacgtctgggtgatgtaattattatacgaaggggggctctcaatcgggagtactactcgatgtgtcaacgttcaaggagttcgcaggtcgccgtggtctctaggaataaggggggaagtatgtaggagtttgaaagattagctccgccgatagtcgggtgtactcgtaggttcagtaccattgggtgggccaatttgatttgatggtaagggagggatcgtgtgacctcgtctggttatgtaaagggatgcgtagggatgggagggcgatgaggactaggatgatggcgggcaggatagtccagacggtccaatatcccggagcgtcagagatgtagtatcagtaacgaggtctgcgaggtgtaggacagggctacaggactaggaagccgatacggaaatgatacagagggcggaccctgaagggggaaaggccccaagaaagggagacgcctgggaacaactggc

SEQ ID NO: 494050 - DNA, 447 bp, Homo sapiens
  misc_feature (17)..(17): n is a, c, g, or t
  misc_feature (41)..(41): n is a, c, g, or t
  misc_feature (49)..(49): n is a, c, g, or t
  misc_feature (183)..(183): n is a, c, g, or t
  misc_feature (401)..(401): n is a, c, g, or t
cccaccttaatccaaanttgtgaaacccttcaaaaaataangcccctantgttaataaaagagtctgtgaaattaatacccttggcctacccatttatggtttttccagcatttgggttgttatatttgaaaaaatacttttagttgtttaatccttataaaaaccttttcctaaataagagnctgggccgggcgcagtggctcatgcccggcgggtagatcacctgagatcaggagttcgagaccagccctggtcaacatgatgaaaccccatctctactaaaaatacaaaaaattagctgggtgtggtggcgggtgcctgtgattccagctactggggaggctgaggcaggagaagcgcttgaacctgggagttggaggttgcagtgagccaggaatcngccactgcactccagtctgggcaacaattgcaaaactcttgtctca

SEQ ID NO: 494051 - DNA, 1051 bp, Homo sapiens
caggcggagaagagacaagagaaactcactgcagagctggaattagcttcagacagagcttgactggagacgggctgaaggccaggctgagtggagatgcagcccaaaaatatgcatgtggatgtgacgctggacccggcctcggcgcaccccagccttggaggtgtcggcaggatggcgagagctgtgtcttcccgctgggtctgccgccaggctccggctgcctggccatccgcagctggttctcgggagcagacgtgctgcgctggagcccttggaagcggttctccgctggcccggcaacttacgtgggcgagtgctgacactgttggagcccggccggctagtcctgcttgatttcccttggagcggcccttgcccttggcccgtcgggtttcactgtcgccgccgtgtgccccttgcgtgctgtctcttgacccccttgcggcccggtcgctaccgtggtatcgcccttggtggcgcctgggtgcgaacacgagcgcgcttgcgcacacagctcaccctctcgcggtacccactttgagcgccacgcggtcaacccctcggcggcatctcgcgacgagcctaacatcagcccgatttggtctggtaaagatgtgacaccccaccaatggagtgcgaaccatcccctcatggaggggacagatcttctactcgcgccatggtgcgatctcttcacctccatagatgctctcactcaggattattaccaaaatctcacttgtggcatcactcactctatactacctattacccaacaaaccacgaatagtagctactacccacgaaaaccaacagcaaactcttcaccctcccaaaagcaccaattcacttttaaccaaccaccctattttacccctcataagttaaaaaccacaccccactattctacacttacatacagtaataattccatcatcactacactacaactgatagcaataggaaagtacataacaacttatccatccaccaagagggcagccaccgataatgtggtgctccacaccaaataacatcaaccgtgtga

SEQ ID NO: 494052 - DNA, 1473 bp, Homo sapiens
  misc_feature (331)..(331): n is a, c, g, or t
  misc_feature (608)..(608): n is a, c, g, or t
  misc_feature (1473)..(1473): n is a, c, g, or t
gctggacttgtcttggttgccagacacctgacgtacccggcgagcggcgacgttctctttgtgactaaaagacagtgtcctagtgctccaagcctagtgagtctactggggtaccgcctctccgtcgtccgcccatcgatgccctaacttctcatggctaactggcaaaatctatccggatcggcacaaacttctgaggcaattagctcgaaaggtgcttggggcgtgaattgtgatgcgtgagcgagagattgcgtgtggctgctagtcggtcacatagccagctaggtggagcatcaaactatggatgggagtagcactttcggtacantcaaagagcatccgaccagcgcgtgcgcaaccgagccacgtaggattaaacctttcacaggttggggggaggacgttccgaaggacgcagcacgtggtcggcatggggaagggccctgtcacagaagcctgtgtggaacattggggatgcacctgatgagatatacagagtggttccttgtgcagccagaaaagcgtccatgcagaggggcagcagcggccccggaaagcatcctcgaggggcacccaaggatacacatgggactcagacgtatggngtgcacacgtgcagtcctgaagcatgcacggccggcatggacggcttggtgatgcacccaggggtcataccgctcccgaggagctgaagtaggtcagcaagcgtagaaacccgcagggcccgtaagggcgcgatccgattgggctcgatgctcaggcgcaccgtgcttcaacattggacccgcctatcctggtccctgaggcccaccgtttccctggggaggtcaataaggagcagtcgccccctttgaacagccaggttggcactgttgctctgggggaggtcccccatgggcacatttgtcccctatttaggcgccatggggtgcttcaggcgaccttcctctaggaaagcatagatattgatgcaaaactttacacctgggtaaaaccggagaacaatagagactggaaagcggcgtttgcactgaaggcgcccaaaaggtatctggccctcgaggggggttcacatctgctgagaaaccccccccacaatatcaacaaggggccctgggacgccctaaaggaacagcccaaaggagaggactttgagaagacgaggagacaagtacaggaggcggacacacagagagacatgggcccctaaagaattaacccatggccacgcaagcaacaaacgctacacaacatcagcggcgagaaaaataaacaggcaagcagagacgaaaaaaaccaaacgagatactcaacgaggagacacaccagaccgacgagcagcgcaaccgacaatagccaggccgagagctagacccacgcgcacaaacagcagagacaagcaaccaacacaaaacaaagcgaccacccagcgcagaccagaagcaccatgcacccaccaacaccgagcgn

SEQ ID NO: 494053 - DNA, 194 bp, Homo sapiens
actcgagctcgacgccatggaagcgcgcctcaccccgcggaaacgcgtacaccgggtacgaggcgactcgccgtcctcccccggactcctccatcacctccaccggtgccttccagcgcgatgaagcgagagaaacggctggcgaaggcgctcgccttgaagcgagttcgatggcctccattccacatgtgcgg

SEQ ID NO: 494054 - DNA, 424 bp, Homo sapiens
ggcgcggccgcgcgctgcagctcgagttcgggccgcggggggaggctttggagcggcgccggcggtggctcggccggttcaacccctccgccccgcatccccaccgagcgcggacttccatgatgcggacgtccgcatgggaccgggatcgacaggactggcggacgtacacacttcaggaatcccagccttacggcgtgctcggcgacgcccagaatgcacaatgtcacccggccctcatgtacctcgcatgtgcttgcccaccgacgctcatggatctgcattattgcaccgtgagcctcctgggcttattcgcacgggcctaatcgaacttattattgcttgtcacacatctcatcactcgaactgtacattacacattcactcgctttgtacctatcacaagtgtatctcatatctcctc

SEQ ID NO: 494055 - DNA, 985 bp, Homo sapiens
  misc_feature (964)..(964): n is a, c, g, or t
tccatggcatcctctcgctgctacaactgttcttcacgttgtaatcctctgccaagagcaacttcaacggtacccggaaccattccccccacattggagatacgcctttaccggatcagaaccaagccccgtcgatccctcaccccctgggccacctattctccaaagtcctcataggacctcacgcgctcatggtcaaccaatcttccgtgacatccccagcagcagaccacatagcaatgcttcctcattacagagccaattccatgtcagctcttcttatgaaggtatctgctcgcactggtacttactgatcatcatttgtccaaggacctgatcccaaccttgaagaaagtccttaaagaactatatacttacatatgtaggcattaaggaataagtacagacagtcaaactgaaggtatcctttgacactattagactgacccctcagtcaggcctatgcatgaaagagtgcctttcctaagtaagtcaaagctcaacaagtatggagatacttgggacgagtgaaaagacttacatcatttgcacatgaaggagtttcaacatccagcttcatctaggctggtcatgattacctgcatgctttgagctcagcagcagtcgttcataaacacaggttaaatacagagatcctgggtttttgtaggtttgacttctatggtgttttaaaaaaacacagagttttagtggtaatatgtgtgtaaatgtactcaccattagggattcatttgaatgatggtattataccatggattgtatacgagtttgtgaaattgttgcaagggcaaagataactcttacaaaaccgtcgagagtacaatgctctagaatcgagcatatatagaaaatacaatgatatctgcagtgttgaaattggggtggatggggggagcaagcataatttttaagtgtgagctgtgcatcaagaaattactaaaantatcttccgtgtggcatattt

SEQ ID NO: 494056 - DNA, 1034 bp, Homo sapiens
ccagcgcgtcgtagatattatactaagcattaagcatctcacttgctaggaatactatatatatcgctcacacctcatatcctccctactatgcctagaaggaatagagtactatcgcgtgttgcattatacgctactgctcataatgcctcaacacccactccctcttagccaatatgtgcctattgccatactaagatcttagccgccctgcagaaccacaagcagagttgtggggctagcacctacgaaatcttcaagtcgtccaagcaacagtatggccttagacgtactgttatcagtaactactaagacgcatgaacatccaaaatgcgtaaatgttaatcagtccctaaatcagataaatattacttacgcacatgacagtgagctttccaagaaggacataattctgaatcaactacaaaccagcccatcgagtctctaatttataagtgatcattccctctactatttttgaatccaaatccctgaaacagaactattgatagctgatttcccccagggccttttgcctctcgaacaccgcctaacataggccgcgccgtctcttaaatactaaacatacacttgtacatcactaatcctcattcaaaggaacactggaaatgaccaagcgttcatttttcattcacgtgtatacctaggttattcacgatcaaacagtacatcatatatcatgcgtcatataacgtaactcctctcctgagaagatgtcttcctctaagtgcaataaggcgattcatcgaaggcaataagaaagggaaagcactacttatgtaggaatgcttcctccagaacaacgaggctttatacaccacacacttaggggaaaataatcaaccccagattgagagccacaccacgataggattgtctgctgaggcaaggtgataattgccaatatttaaagcccctaagaggttcacttcctctacgcaacagcgctatttccacatccaaacctacggtctaaccatctaatcactcctaagccagaaattaattctacc

SEQ ID NO: 494057 - DNA, 313 bp, Homo sapiens
tcgacctcgtgggaatgcagcccagtagatctcagcttcattttgaagtggctacatgtctggggtatatacctgggatttgttgtctggcgccaggaaaatttaggacacagacacacatgaggagtttaagagcgaaggtttaataggctgaggtgggtagatcacttgaggtcaggagttcgagaccagcctgaccaacatggtgaaaccctgtctctactaaaaatacaaaaaaaattagccgggctttgtggcacacacctgtaatctcacctacaggttggggaggagaggctgaggcaggagtttg

SEQ ID NO: 494058 - DNA, 123 bp, Homo sapiens
atggtatctggggctctgtgggactgattgtatactggcagagagaccagcctgaccaacaaaaaaattaggtgggcgtggtggtgcatgcctgtgatcccagctatttgggaggctgaggca

SEQ ID NO: 494059 - DNA, 171 bp, Homo sapiens
attcatggaagagttatatgcagattgcagagagaaatgagggaagttcgcctacaccgggccatctgctggggtcagtggtggtgctgctgtatgtcttgtgactgcccaacggtgacctggtggtgatcctcatacgagtctgaccgtgcagtgcactgcaatgcttgt

SEQ ID NO: 494060 - DNA, 235 bp, Homo sapiens
tagtgactcagggcagagtggccagcacacctctcatccgcccctcctgctccatcactgctgagcctctccccatctaggaatgttggaacctggggcatcataaaggatagcaagctacccttccaaggcccgagccagcccagagaggagcatgtttccttatacattccccataagggggatacatacatgggaggggggacacagaaaagaggggggggagaatggcgca

SEQ ID NO: 494061 - DNA, 194 bp, Homo sapiens
gaagattggcactctccaacttctatacctcccaaacctgatcagcccctagacgtaatgccagcccctccacccgaggacaaagcgtgcggtgaagcgcaagtctcaccctcctgctctatctcagagctcagacacagaccggccgtccctacaaatggtgggggaaaagtagctccagctcaaccatctga

SEQ ID NO: 494062 - DNA, 326 bp, Homo sapiens
  misc_feature (12)..(12): n is a, c, g, or t
  misc_feature (102)..(102): n is a, c, g, or t
cccccccccccncccccccaatcttcttatactggggtataatagttcataaaagaaactctctttatgggtgagatattcccactttttggtaacccattncaaaaccaaccgccctcttcagttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacct

SEQ ID NO: 494063 - DNA, 470 bp, Homo sapiens
tgaatatgaattaagttaaaaaaaatcctcaggaacttgagaatacattcacatggtatatacctgatttcccaggaagaactgataaaaatgaataaatggaagaaagacacaattagttcaacaggaaacttactgtatgactcgtagaacatacacacatactcacactctgtgcttctggatgtaggactttcttaagcatttcttctagggccagtctagtggtgatatattccctcagcttgggcttgtatgtgaaatactttattataaactcatttatgcaggataactttgctgggtatagtatccttgactgacagttattttagtcatggagcacttcttacaaaaaattattttttcagacagtctcactctgcactccagccggggcaacagagcaagagtctatctcaaaacaagaaaaataaagagcatcctataattttatcatagatggccgg

SEQ ID NO: 494064 - DNA, 111 bp, Homo sapiens
ccctggtatgcggttggtctggttgttctcccggatgaccatgttgtacgctgcatgcatggggcaccacagataggatgtatggtccgttcacatgttgattgaaacgct

SEQ ID NO: 494065 - DNA, 170 bp, Homo sapiens
taagcagtctctcccatcaacgcatcttctcccatcaggatctataacctatttatttagatagaagtggcagtgattcatattcatttgttatattcaagttggcagtattttattattggaacaaccataataatccttagcatatatgctgatgggagaagactgcg

SEQ ID NO: 494066 - DNA, 458 bp, Homo sapiens
atatttatttacactgtaccaactcgctgggagcttaaacaacacactgggaacatcctccgtgaggcactggatgcacagatttatttgaaactacatgaactccacgacaggctcactaactctttttcaagtgcaacaacaaatgtcggctctgagaaataaccaagtcaatagattattggtgacacacacacgagtacgtgagcccagagagcctacccacctatgtatttcctgcagaggcagaggtctcagggagcttttgagtgaacgccccgctgtattcactgcacttgaaatggccattagcatttcatcacgatccaacatttgagcatttctttattcagacacaccatgtttactgctctattctaattcttcaggatcagatgatcagccggtattcggatgcacgagactctactatgtatccaacatacgaggacactatc

SEQ ID NO: 494067 - DNA, 173 bp, Homo sapiens
gacgaggggcaccccggacagtgacctgatgcactgaataaatagatcagaatgactgaaaaagccccagagccacatgtgggggaggatgaccatcattacctggacagcaagctcaattagaagcctccaccacagaagtccctgagggagctgcaggaaatggacaaaga

SEQ ID NO: 494068 - DNA, 183 bp, Homo sapiens
  misc_feature (13)..(14): n is a, c, g, or t
  misc_feature (108)..(108): n is a, c, g, or t
  misc_feature (147)..(147): n is a, c, g, or t
  misc_feature (158)..(158): n is a, c, g, or t
cttcagtgtcctnngagagattattgggcagtctttaataatgaaaactttaccttgaattacacacacacacacacacacacactcacacactcacacacacacagngagagagagagagagagagagagagacagagagagaggngagagtcaagntctagggtgttaagtccaacattat

SEQ ID NO: 494069 - DNA, 94 bp, Homo sapiens
gggacggtgactcagaatccttgggttaggccctttttgcctttcttttcctttcttttttttctttgtccttttttctcctggcggatttttt

SEQ ID NO: 494070 - DNA, 1541 bp, Homo sapiens
  misc_feature (1)..(1): n is a, c, g, or t
  misc_feature (47)..(47): n is a, c, g, or t
  misc_feature (830)..(830): n is a, c, g, or t
  misc_feature (953)..(953): n is a, c, g, or t
ntcgctgcgttctcccgcggggttttttgtcgctgaccacagcggcngggctcgcgcgcagatctgcttcgttgccgccagggttgtccgcgcgccccccgaatagtgttgctctggtttttgtgtggcagctggctcccgttccctcccaatgtgggggggtagtttcgctccgacaaccgcctacttggtgtactaccgtcgccccctttcccgggttggaaagagaacgggggcgccgtgtagtcgtcgcgctgtgtcgccattggtcccgccgccctccaccgccgtggtatatttctgtgggggccgccttcctaaagcccagccccccgcttttggatgtgttctctgccccgcagggtttgttcctcgttgggaaccttcgcgccctcttcttgccccgccgtgacccaggcccccgcccgggttgtgtgaccgaggtctcctgggaaaagggggcggcccttatttttaggcccctctttttttttccaaggaggcaacaggttaccccccccgcttgtttcgttccgcgcgggacccccccacggagaagggatttccaattctctgggggagtggccccgctcctaggaggagaactctggggaagtggccaccattttccaaagacaccaaatatgcccccgcccatgtggagaaattccttgttgcccacaggagggaaagaggtctcttctcgttgcgcccaaatatgtcccaaagtcgaaaggcccctggtgggaccccccccaaaggatattccagaaaagggcacactttggaaaattcctcaaagcgccccaaagtgcgcaaatagtgcgctnccccataggggggatacacacagaggcgcccccttttgtgtgtcccacaggcgcgaagatagcgtggagcaacacagcgtttcttgccgaacacattctccgggagttatagagacagagatntctcccccgggagaagcccccacagagatttcttgtctccccttcttgtatccggcgcccacacatgtggctcacacgtgtcgacattgggagaatgtgcacgccacatgcacacccctgggcgtcctcgtgcacattttctggagttctctgttgcgcacacgccacagagggtatatacacacgcgccgcacagtgttgtgcgcccgccacattcacatatagcgctatacctccacatgcgacatatagtgtacgaggcacgagcccttgcacagagaggtctctcgggccctatatgttcacacagagaggcgcacacaaacacacacacatggtgtccacaaatcgggggagattggtgaggcccacgcctgctgtgagaatgggagagaaagagctatccttggagattccactcacccaacactcactggatccgcctttatctgatctttctccgaggcccacccgcaagggtactgaagagcctcacacctgggggcacttttgtgggtggagggccacgagtgtgtataccccggcttgttctggaaggagaaggcctttgctgcctgaaagtttcca

SEQ ID NO: 494071 - DNA, 1253 bp, Homo sapiens
attggtgttcggtcctttcgcggggtgtgacggtcgtgtgatgttttgtgtttggttggctggcttggctcgtggtgtgggttggccccctttggcctgtcccggtttgttttctccgcgatttttggggggctggtatttttgtgggtctttgtcacctcgcttttcggcgtgtgcgtcgttgaactcttccacgcacacttttctggttctcccctttttctccttgggcctggtgtggcggcgctctcgtgggcttggaggtttgtcaatccacgcgcttgcccctcctgtttgtggcgaaagtccccctctgtgattgtggattgtgtcgtgtgtcggcccgggggactgggagtctccagagtgggtgggtggggccccccagttgtttttgtggtgtggcggcggtgtgtcccctggagttcctgtctttattgtgtttgttgtcgccgtgccgccctgtgagcggcccttttttttgtcttgtgtgtgaatctgtctgttaggcccctttcttatgatgtgctcttggaatttgtttgggttacccccacatcccacgtgtgttagttctaagaagtccccgcagactaagttctcttaggtatactgttgtgtaccccacagttagaattatcgagagctccacaaactttggggcctgtgtaacataggttgctcacaccacagcgtaaatatattggcagacgaatcttgggtacccccaacccccccccgcagtattaataatatatttctcacatagtaataatatatattatgctcgagataaaattatccctcgagggaagtgtacaatgcttaatttttgttgtgtaatatcttttcgccactctatcttcttaataataattttgacccacaaagaggacctgtgagaatatcttatggccctgcccgaaatatatgtgaccagaccaccgagccactgtgtaggaagacctttaccgcgtaatcacttaactctatccccgcaaatgatggactacccaggttataatggtgtgttacctacaccttcacatcacgtaatattacgccaattctccacaatgttagtcaccacttggtttgtctgcccttgtacactttctttattcactgatattaccacgtgctgtaacctgggtggtcccttttataacccaaaccacttatttgccaaacccgagggtattatttgtttttaaagacttttgtaaataaaggcttccaaatgttttcttata

SEQ ID NO: 494072 - DNA, 395 bp, Homo sapiens
  misc_feature (19)..(19): n is a, c, g, or t
  misc_feature (21)..(21): n is a, c, g, or t
  misc_feature (27)..(27): n is a, c, g, or t
  misc_feature (47)..(47): n is a, c, g, or t
  misc_feature (55)..(56): n is a, c, g, or t
  misc_feature (98)..(99): n is a, c, g, or t
  misc_feature (102)..(102): n is a, c, g, or t
  misc_feature (109)..(109): n is a, c, g, or t
  misc_feature (135)..(135): n is a, c, g, or t
  misc_feature (137)..(137): n is a, c, g, or t
  misc_feature (164)..(165): n is a, c, g, or t
  misc_feature (184)..(186): n is a, c, g, or t
  misc_feature (206)..(206): n is a, c, g, or t
  misc_feature (218)..(218): n is a, c, g, or t
  misc_feature (233)..(233): n is a, c, g, or t
  misc_feature (300)..(300): n is a, c, g, or t
  misc_feature (305)..(305): n is a, c, g, or t
  misc_feature (313)..(313): n is a, c, g, or t
  misc_feature (319)..(319): n is a, c, g, or t
  misc_feature (343)..(343): n is a, c, g, or t
  misc_feature (366)..(366): n is a, c, g, or t
  misc_feature (374)..(375): n is a, c, g, or t
ggtaatatgatttatctcnanactagnagagaccaaccgaacccccncgaccttnnggagggagtccgaactagtctcaggcttcaacatcgaatacnnggnggccccntcgccctattcttcatacggaatacncnaacgttattataataaacaccctcacnnctacaatcttcctaggaannncatatgacgcactctcccgngaactctacacnacatattttgtcacnaagaccctacttctaacctccctgttcttatgaattcgaacagcatacccccgattccgctacgacnaactnatacaccncctatnaaaaaacttcctacggctcacccnagcattacttatataatatgtcnccataccnnttatcaatctccaacattcc

SEQ ID NO: 494073 - DNA, 998 bp, Homo sapiens
gcctccggcggccgcggtcgcgatgctacccctgaaagccaaaatgggaaaggcaaagactcatatcaacattagtcgtcataggtacacgtagattcgggcaagtccacactactggccatctgatctatatatgcggtggcctcgagaaaagaaccattgagtaatagagcaaggaggctgctgagatgggaaattttctccttcaagtatgcctagggtcattggataaactgaacgcctgagcggtgaacgtggtcatccccgattgtatatcctccttgatgcaactttgagtaccagacaagtacttacgatgactgaatcattgatgaccacccaggcacacagagaactcttatcgaaataacaatgattatcgagggacatctcaggcttgactgtgctgtcctgagtgtgttagctgcgtggatgttggccgatattttgaagctggtagtctccaaggatatggggcagagaccgatgagacatgcccttctggcttacacaactgggtgttgcccaccacggtaatagtcggtgtataacagaaagtggacttccctctgaggccagcctacacgccagaagagatatgaggaacattgtgacgcgaaggtcatgcacttacattaagaacaattggtctacctacccgacaaccgtatgcattatgtgaccaaatctctggtgtgggtatggtgacaacatggctggacgcctatgttggtaacatgcacttgggttcccaggtgattgggaaagttcaccctgtgaccgattggaagtgacacacgggcacccaccactggctcaaggaatctggactgaattattcccaacaaaccgtccaaatggacgagacacttgcacatagcccatacagagatgttcccaaaattgggcgcatggcaatagtcgtctacgccgaggccacacggtacacaaccagagtgcggcaccaggcccaaacctacaagacaccaacacgtaac

SEQ ID NO: 494074 - DNA, 404 bp, Homo sapiens
taatttgtgtattttctcttagcagcttgctcccccaatttagaacaattactcaattcagtacttgcaatacagttttatttggctctatgatattatctttattaaagtaatagagaactgggctgggtttggtgactcacgcctgtaatcccagcctttgggaggctgaggcgggtggattacctgagctcgggagttcgagaccaacctggccggcatggcgaaaccctgtctctactaaagatacagaaattggccaggcgtggtggcaggtgcctgtagtccaagctacttcaaaggcttaggcaggagaatcacttgagcctgggaggtgaaggttgcactgagctgagatcacaccattgcgctccagcctgggtgacagagtgagactctgtctc

SEQ ID NO: 494075 - DNA, 115 bp, Homo sapiens
gccgtgcacgagctgtgggtctctgaagggacccccccatcggactgccaaattctccggttgccccgggatattatagaaaattatttgtatgaataatgaaaataaaacacac

SEQ ID NO: 494076 - DNA, 181 bp, Homo sapiens
cgtgtgtggcaaacctgtctgtacaaaaaatacaaaaaatttagctggatgtggaggtacacgtctgtagtcccagctacatggggggctgaggtggggaagatcagttgagcctgggatgcagtgagccatgatggcaccactgcactccagctgggatgacagagtgagactctatctc

SEQ ID NO: 494077 - DNA, 104 bp, Homo sapiens
tgttgggattacaggcatgaaccacctcacctggccaaacttgacatttttgggagattttatttagtgcccagtaaatctacattttgaatagggtaaggctg

SEQ ID NO: 494078 - DNA, 219 bp, Homo sapiens
cccggcccgaatttcccgggtatttggccaccccccgggccgggccccttaagtgggatcaacccccgggcccggttggtttttccttcccccccccccccccctgccctttgggcgcccggtttccaaaaaaaagattttttggccggtttttttaccccgggttctgggattgggttttttagggaccaaaaaaaagccggttttttccgcccccca

SEQ ID NO: 494079 - DNA, 181 bp, Homo sapiens
ggggaaaaggaaagcatatgtcagttgtttaaaaccccatatctattttttaactgattggataactctaagatctgatgaaggatattttttattgcccttttgtcccttgattatattgggaagttggctaaacctgaaaaatgtttttaaaactgtgaataaatggaagctcctttta

SEQ ID NO: 494080 - DNA, 462 bp, Homo sapiens
agggcgcatggttgcaagtaacagaaatccaactcaaagtggcttaagcaaaagaagccatcaggaatcggtctctgtctcctacctctgctatcctgtctgcctcacaggtgggtctggacctgcagggcaaaacagcactcagcaaggccatctatcagaggaacaaactccctcttctttgtgcatagctgccaggatcacccgagattgaccctgctcccgagtacccatgcctgacataagcaccatgaccaaggagatggggctcacgacctcagcacagcctggtctgcaccagaaatttgtagagtctagtactattaagaaaataggccgggtgcggtggctcacgcctgtaatctcagcactttgggagactgaggtgagcagatcacctgaggtcaggagttcgagaccagcctggccaacatagtgaagccccgtctctactaaaaatac

SEQ ID NO: 494081 - DNA, 447 bp, Homo sapiens
agaaacaaagaacatgtacctaacactagacatagccccctgaggctgtctcacacatgtaggacagagatggtcttgcatctactagacctacgtgataccgcccgcctcggcctacccaaaatgctagaggattacaagtatgagccaccgacgcccgaacatactcccacatttataaaccctttatatctggggggttgtacgtgacagagaccaaagtccaactgacttcaacacaaaaaggcactatgagtgcgtcatgtaactgaaacgttcggagtatcaggcatagctcgatccaggggatcaaacgatgacaaggattctctctataacctctcttggctctgccgtctgctgagtaggcctcctcctcagaggggttctacctgcttgcggccactccaggcttacatcctactgcttttcagcgccatagaaaga

SEQ ID NO: 494082 - DNA, 211 bp, Homo sapiens
aagtatataataagactagtataattctaggtaagaagataacagaatatttccaaatagagatttgccacatcacatatggcacattttccaacactattctatgtctatgcaactattcctcatagtcttggcttatgtcttttctctgtaagacacagtataaaagatcataaaggcaaagaaatatgtaccactcgcacacacaggc

SEQ ID NO: 494083 - DNA, 184 bp, Homo sapiens
tgaagggattacttaacttccctacagattgtttagaagacccttttaggagttatttgattttagaagggtctaaacttgtccctgtctttaagctatttggccactctacgtgttgtagaaaactgataataaaaccaatgattgttgttcatggaaaggccaataaatttttttccgtgga

SEQ ID NO: 494084 - DNA, 774 bp, Homo sapiens
  misc_feature (30)..(33): n is a, c, g, or t
  misc_feature (36)..(36): n is a, c, g, or t
  misc_feature (125)..(126): n is a, c, g, or t
  misc_feature (128)..(128): n is a, c, g, or t
  misc_feature (160)..(160): n is a, c, g, or t
  misc_feature (164)..(164): n is a, c, g, or t
  misc_feature (168)..(168): n is a, c, g, or t
  misc_feature (180)..(180): n is a, c, g, or t
  misc_feature (182)..(182): n is a, c, g, or t
  misc_feature (203)..(203): n is a, c, g, or t
  misc_feature (207)..(207): n is a, c, g, or t
  misc_feature (224)..(224): n is a, c, g, or t
  misc_feature (233)..(233): n is a, c, g, or t
  misc_feature (237)..(237): n is a, c, g, or t
  misc_feature (260)..(261): n is a, c, g, or t
  misc_feature (264)..(264): n is a, c, g, or t
  misc_feature (272)..(272): n is a, c, g, or t
  misc_feature (278)..(278): n is a, c, g, or t
  misc_feature (284)..(284): n is a, c, g, or t
  misc_feature (295)..(295): n is a, c, g, or t
  misc_feature (326)..(327): n is a, c, g, or t
  misc_feature (335)..(335): n is a, c, g, or t
  misc_feature (349)..(349): n is a, c, g, or t
  misc_feature (361)..(361): n is a, c, g, or t
  misc_feature (363)..(363): n is a, c, g, or t
  misc_feature (374)..(374): n is a, c, g, or t
  misc_feature (412)..(412): n is a, c, g, or t
  misc_feature (421)..(422): n is a, c, g, or t
  misc_feature (427)..(427): n is a, c, g, or t
  misc_feature (433)..(433): n is a, c, g, or t
  misc_feature (436)..(437): n is a, c, g, or t
  misc_feature (483)..(483): n is a, c, g, or t
gggctgatcgtcagatcaaataaagttatnnnnttncaaaaaaaaaaaaaaaaaaaaaaaaaaaaaaaaaaaaaaaaaaaaaaaaaaaaaaaaaaaaaaaaaaaaaaaaaaaaaaaaaaaaaaannanaaaaaaaaaaaaaaaaaaaaaaaaaaaccttntggnccgnttggcccaagtngnttttaaattgggccaggtttntccntggggccgaatttgggnctaattggnccanttccccttatggggggccgtttnncanttaatggnccgcgntttaanaacgtcggacntggaaaaccctgggggttcccaaattaaatnnctttgaanaaaatccccttttncccagttggggnantaccaaaaggncccgacccgatggcctttccaaaaagttgcccaccctnaagggcaannggaantttgangcnnaaatttttggtaaaaatccgggtaaaattttggtaaaaccagttantttttaacccaatgggccgaattgggaaaaacccttattaattcaaaggattaccccgaaataggtttaagggttgtcccagttggaaccaggagccccttttaaaaaaccggggactcaaacgtaaagggccgaaaacccgtttttaagggcaagggcccattacgggacccttcaccctaataagttttttttgggccaggggcccaaaagccttaaatgggaccctctaagggaccccccttttaagactttacggggaaaagccgggaaccgtgcaaggggggccct

SEQ ID NO: 494085 - DNA, 830 bp, Homo sapiens
gtagaaaagtcttatgtgtagcaaaagtatgtttcctattacctgagtaaaagtgggttttctagattctgcatctttgtttacatctctcgttgcctaggatggctttcatccttcaagtggtagtgatcttttaaagcctatttcagatgttacatcttttgtgaagcccttcctgcacatatctctttgagagacatttgtgctactaatatttaattcactggtattgcctcttgtcatgtaccctttcatcccagctgaaccgggcactaggactgggtatagctcttatatttctttatattttcatctcggtaaaatgccgtagcactaactatgagaataattttaattaacttagttgaaagtagttctgaaacttgccagactcaaagtgtagagcacaacagcaactgtgcttgaccgtactccttggtttacatctattgtcttgacaaaaatattaatagcatttcctttcacttttagaaatactcgagtttgtatgataaattttaggttcactttacctcatgctataaatggtggtgttctggtggacttggtgaatcaggagatgtttatcaacaattaccaaagcagagattctgattagtaggcaaggtggctataaatgtgattttagaaggatgtctaagatcaggtaagtagtgtgaaagacgaactcgttcggacggggaaaggcttggtgggaaggaggggaagggggggggagagaacatttcttgggggttggggaaataagatgtatggtggggttttttttagactattttttttttggaccgggatgggggggggcaaac

SEQ ID NO: 494086 - DNA, 184 bp, Homo sapiens
cgatctagagatccccaaatattataaacgcctcacactacaatcttgctaggaacaatcatagtgacgcggctctcccctgtaactcgtacacaacatagttagtcaccaggagcctacttctaacctccctgttcttatgaattcgaacagcatacccccgattccgctacgtgtccggcca

SEQ ID NO: 494087 - DNA, 1831 bp, Homo sapiens
  misc_feature (1297)..(1297): n is a, c, g, or t
actagttctagatcgcgagcggccgccctttttttatttggtttatttaaaaggcagagcctcctaagaacatcaaagtgggtcctagcaaaagtatataaagtccctaaagcaacttaatacgtggaaagcttagtttatttgatttgacaagaggggggcacactcatctcgtggtgagcaggagagggggaaatacagtgggagacaatccgaatagcatcacgggtacaccctttggagggacaggggaatcactttccacctatcagagccatcccaaggaatacgaccacaacaaacacgcggtgtgtgtgcaccaaacacagcgccgcggcataagttctaaaaacttgagcgaggcacggagataaaacaccgcgagacacccaccagggtgtgccgcccaacggaggggacccacacacaccaccaggagacacccacaaaggaacacaaagacactacgcgtggcacgagggagcccactcacatacaaagtggcaccgaacaattaaccagggcacgcgatacaaacagaggggcccccaacgccaccaacaacattgcccacaaagaaccaccacccgggaggggcaactaaccacatcacccactacacaatcacaacaaccccatcatcacctaccatcacacccaaagagccccgcgacaacacctaagcaaacaccacgtgctgacaacacccgcgacaactaccaccaagcacaccaacacaactacgcgggcacagcgcgcgcccaccacccgcgactcgagcacgacccccaccccccagagggactagcaccccagccgacacaacaacaccacaacagagccgccgcaactcctccaccacacgacgaaaacgaccgacaggggggcgacccgcagaaacaacagccatataaacacctacagatacgagaaagcacgcaatacatctcgccaacaacacaccccgctgcaacctgcatcaacacgacgacgacacgccgagggggacccaccccccagagaattagcagaccacacgaaccaatcacaaaaccaccagcggtcgaaacacaccgttgtcggcaccaacaacacagccaaccgtgtcgaacagcacagacagcggacggcagacacaggaacaaaccaaacaagacaaaaaaaaccacccacaacacaagctacagcagcccacaacgcacgtggatcaaccaactgctagacaacccgcacacatgacgaaccactctccagatcagacccatcagcaagcagatgaaccacaccacacagcgcnacacaagccagacgaccccacaactgggagacagaccacaccaccgccacaaagcagcaacagacaacaccaactacaccagcggcgcagaccaccccacgagcaaacccccgacacaagacagacgggaccgacagacaagcgccccaccaaaccactactaacgacacaaccacaaatcagcggagaacacagccaaactactagctagcagccacccagctgacgatacccgccacgcgtaatcacacccaacaacagtcagcgcactcacaggcgaccacaccacaaacagcgggcacacagcaaacactagtacgaccaaataccgaacacggtactaactcattcccatcggcggctgctcttatcccgaccagcagcacaacgaccaaagacaagaccagaaccacacacacaaccaccacacacaccccgaacacccaacacaagaaaagaacgcacagcacacgctcaaacgacgacacgaccgagacaaacacaacacaaacagacacacacaacgaaaacaca

SEQ ID NO: 494088 - DNA, 180 bp, Homo sapiens
gtaatatcatgacgcgagctagggattaaggtcaccgtatgcaggccatggctgagaaaagaccagagatacagatgatagccagtgatgtggtcatatatgatccatgatgccagccttgaagaatgcaaaaaaagagggcacccatcatgctgtggtggttctacccaagagagtcaa

SEQ ID NO: 494089 - DNA, 449 bp, Homo sapiens
tgcaacatttttttgaatgttagtttgattaacattaattttgagtacacagtgtgattgtcagtaccttgtaatggtactacttttgaaagtaatttaaaaatttgaatgaatttaaggtttacagaatacttgttcattgtttcctcagcaagtcagtttaatgttcattttcccgtttgtcgttgggataaagaatacgggtgtttgagggctcactcacttgcatgcaaaaatttccattttaaagattattttgcctaaaattagcgttgtaatactttaaaagaaatattttgtaaaccttatttcactgcaaatttccaaatctgcataaaacaattataattggagaaagattggtaattgttttataaagaatttatgaattctgtataaatttcttctaacatttaatacaattttttaataaaaatttattttaacct

SEQ ID NO: 494090 - DNA, 364 bp, Homo sapiens
aaatattcctctgtctctattttgtgtcatactaataaaatcactctggttttcttatggttacagtttgtattatgtatcttttccacaattttactttcaactaacttgtgattttgaatctgaagtgggtctcttagatgcatataattaggtcttgcttttttatacagttggataacctgtaccttttaactcgacatgactttacgcttaaggtaattatcgctatggttgcatctctgcctcccattttgagtttctcaaatgctctttacattcctctcttactccttccctgcattcctctgtcgttgaataaatatttttactgtccccttttcaaaaaaacacaacacaaaac

SEQ ID NO: 494091 - DNA, 668 bp, Homo sapiens
  misc_feature (81)..(81): n is a, c, g, or t
  misc_feature (195)..(195): n is a, c, g, or t
  misc_feature (314)..(314): n is a, c, g, or t
  misc_feature (484)..(484): n is a, c, g, or t
  misc_feature (486)..(486): n is a, c, g, or t
  misc_feature (574)..(574): n is a, c, g, or t
cggcgacaaaccaacccctttaaaaacactcttaaaaggggtaaccattttttaattcatccggggccaactccggggaanagagaatgttttcgttcccatttccgggataaaagccctttccccaaggaatttttttaaaagacctttgttttttgtcaaaaattttttttttttttaaggggggaaaccccnttttttttgccctcacaaaacgcccccatttcaagttctatgcccgcccccccttttaatctccccaaggtcttttccttttcctgcaaaaaagggaaattgcaccacggttttttctnaggaataacttttccattccccggagtttttcacgtatacagcccacattcgccacggcttttttttttgtcttccaccaaaagcaaaggcccccccatgtggttctggcggaggcggggcggtcctttacccctttttgggaaaccccaccccctgtaagatcttcaancnctttgcggggttaaggaaccccccccctccctccccccgggtagaggtgggctcgtttccccccgccccccagtggtccatctcggcnaaattcccagagggcgaacacacttcgcgggggtttctccggcggggcgagttttaggtgccctttacccaacggaatatcaaacacccccggc

SEQ ID NO: 494092 - DNA, 345 bp, Homo sapiens
cgtactcctacatctgcaatcccagcaaccttggtcggcgggggcagtcgggacacgagctcaagcaaacgagaccatcctggccaacatggtgaagcctcatctccactaaaaacacaaaaattagctgagtgtggtagcacgtgcctgtagtcccagctactcgggaggctggtgcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaag

SEQ ID NO: 494093 - DNA, 270 bp, Homo sapiens
aggattgcgccactgcactccaacctgggcgacagagtgggactccatctcaaaaataaaataaataggtgaagaactccaggacagttagctgggctgcatgaaggtcatggccccccgtctctggagtgacctagggtggtcctgcactctgggaggggagcctgtaggacgtggtgccagccccagatcccagcacctcccaggtgcccccacagaagggcatcagtggagaagcctgtccacccatggtcagcacccagggggctg

SEQ ID NO: 494094 - DNA, 959 bp, Homo sapiens
tgagtttgtttgtttgttttgtgggaggatggggaagagaaagctgaggagtaagcgaaaagcagagagacagtccggaagaggaagagaggtaatatgtttcccggcaatgttatgctggtccgtatgcttggtggttgttaataagtctgttgtttgtcgcgtcctggtgccataaacctctgggttgtttttccgttggggtgtgcctccccctcctgttttactcccggtttctctttggggtcctgcagctcccaaagaaaacggttgcgtacgaaaaaggggcgcgccggttgtttaagcctggagggtccccataattctcctgggtctggggagccgccgcccctttctatatagtgggttcccccgccagccgccacacccgtggtggggggcttttccaccggaacatacacctccgtcggagcacacttcctcgggctgtgggaaataatcagcagccacgaaccaccacgcgacaggggcggtcatctacaaaagcacacgcagggcacaccaagaggcgtctcgaaggctagcctacacgtttgccacacagttgtctccgagcaaatgctgaaccgcgcatatccgagtgttttgacgcccaacatcgtctccagcccccccttacagagcaacagggggccgagaagcgctctttcataactagttcattctctcacaagaggccaccgctaaagttacattgtcaaataaggacgctgttagataggtaccaatgcacgtctctgaagccctccacacaggcgatagagtggacaactgttctttggggacacccttagcgggttgtatcttttctcatcgccgtgcacgctatggacattgttagcagcttgtacataacagcaaatttgtcaaccagggcaaccagggccccacacttatgccacaaatttggggccccctcaaaacagtccacataaaca

SEQ ID NO: 494095 - DNA, 411 bp, Homo sapiens
cgacattgcaaactttttggcagggtgggagactgagtctcattttgcactccagcctgggcaacaagagcaagactccatctcaaaaaaaaaaaaaaaaaaaaaaataatgagcagggcgtggtgacaggtgcatgtaatcccggctcctcggaaggctaaggcaggagaatcacttgaatccaggaggtagaggttgcagtgagccgagatctcgccattgcactccagcctgagtgacaagggtgaaactccatttcaaaaaaaaaaaaaggatcgggcatggtggctcacacctgtagtcccagcactttgggaggcggaggcaggcggatcacctgaggtcaggacttcaagaccagcctggccaacatggtgaaatcctgtcatcacaaaaatgcaaaaaaatag

SEQ ID NO: 494096 - DNA, 431 bp, Homo sapiens
ctgaatttacacagtttgcttcattgtattttcaaacaaatagaaaataaacttattaggaagcattttcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaggggatccctagtaaccctattacccaaaaaacaaataaaataaaaaaacttagggaaaaaattttaaaaatgggaaaaagggaaaaaccatgtattaacgaaattaaaatgaccagacgaatttcctaaatgcactttacctaataggaaacagccatgcccaattgacatttaaacatgatacccccgaatagcaattggcaaaatgaatgttaaacattagggaaatacgaggaaattattagaa

SEQ ID NO: 494097 - DNA, 109 bp, Homo sapiens
agatcgagctcggccctctagtttagaagttcaatagcacctagttttagaagtgtcaatagcacctagtttaagaactctcaacagccctagtttaatgctattgaaa

SEQ ID NO: 494098 - DNA, 1531 bp, Homo sapiens
  misc_feature (229)..(229): n is a, c, g, or t
  misc_feature (1144)..(1144): n is a, c, g, or t
agggaagcgcacgatagctgcgccggagacgatgagcgaagagcagcgaggcggaatcacaggcgacgccacagacatcccacgatggagggacagagaaccatggtagtctggcagtacctgggcgcgcgagtggaggaggcaacagctaggccttcgtatgacattgtgagctctaatgtccagagagcataacattacaaggcgctgctctagagattctattgtngcaagttgtggatctgcatcgatccgtgaagaagactcctagtggcaattccttcatgaggaagatatcatttgaggacgcgcttggacgatgcggaaggacggcaacaaagcatgatgttcagtaagatcttgacaggacacatgtgcatgtgcacttgccgttaccagaatctccagaagtggggaatgcgcattgaaggactttatcttgcacttgctcatacccgagcaccccatagctcgcgacgaatgagctctaaaacagggaggtatcgcgcaggtggccgcaactggaggagatggccatgaattcaagggacggcccttgggaggcagcttcatgagccatccagtgacatgggccacacgtagtagactgagactaattccttttaaacttgtttttgaaggtaaacagggggttctaaattcaaccccgattaggataggcaattttcaaacgcatagccatccaacatgggtggcccctggtgcgttctatactagaacgccatatacgcgtcccaacattgtctgactatagacttgaaagcttggttgaccatatggtttgtgataccaaacaagatgctttcttgaaccttagaacattacacccttagaaccgcacccgacacctgtatagacctaaccttctctgctctcagagcgatttgaccctaccgttgttatcatacgtaatccggcgggattacctgtagccccattattcttacttttcccgcctaagtgccggaacggaattgggaaccccttggaattggcatttcttaccttcgcgtcacaatgtgggttggaaccttggaaacactcggtggcggccgatcgttataccctctttatcacccataaggcttggatttagaatctttctggaggaatcagcaaggcnctgtgggccataggaaccgcaatcacccggacgacaactttttcggtttccggttaacatttggctgtcttaaaacgccctcacgaaacttctggcacgacagtttttgggtgttgacgggccaaaaaagaggcccccaatgagtgtgggtgtttatcagcgggcgctgtggacacacacccggtgtacgacgctggtgcagaatggaccattttccacgggcggtaatcggcaaccacacccctttctgtgcccttctcactgcgggaggctttattctacacttgggtgacacatacacaagcccgggaaaacgaattaggcctatgagaatcttaagagaattggggtgctacaaaagcagtgcgtgcgtgacacacggcgacc

SEQ ID NO: 494099 - DNA, 444 bp, Homo sapiens
  misc_feature (348)..(348): n is a, c, g, or t
  misc_feature (414)..(414): n is a, c, g, or t
  misc_feature (423)..(423): n is a, c, g, or t
  misc_feature (441)..(441): n is a, c, g, or t
aagtgcagctttgttacatggatatattgcgtggtggtgaagtctgggattttagtgtaccatcccccaagcaatgtacattgtacccataagtcatctctcaatcccccatcccccatccttccacgcctccagtgtctgtcattccaccttctatgtccatgtctgcacattatttcactcccacctacaggtgaggacattcggcgtttgactttctgtgcctaagtcatttcacttaagataatgggcctccagggtccatccatgttgttgcaaatgacaggatttcattcgttttgagggacctaggcaggcattccgtgtataaatggcaccacatttttnttttatccagccatctgttttatggggacactcaaggtcggatccctggcaaggaactaagggatngaaagggtngggaggaaaggggaggantta

SEQ ID NO: 494100 - DNA, 136 bp, Homo sapiens
ttgagacagagattgagacatccagccccacctctctagacaagaaagatgactggggagtgaaacacagtgtcagcattggaacagtggtcaccagtggacacaagggttggctgtactctccacctcctcacat

SEQ ID NO: 494101 - DNA, 126 bp, Homo sapiens
aagtcgctcctggtttcctggatactttagtctctccactgtgacggacatgttggccaaactggagaggtcctgtccaggctgacagcttgcgaaactgttccccatatgtacctcatcgaatgc

SEQ ID NO: 494102 - DNA, 331 bp, Homo sapiens
  misc_feature (152)..(152): n is a, c, g, or t
  misc_feature (160)..(160): n is a, c, g, or t
agcaggtgctctgagtacctgagcctggccctaggctcgcagcaaaagcaggaccggattgagggcttgaagcggcacatcgagaagcaccgttaacccacgtgcgcatcgtagaagaccatccttgcgcatgcgtggacaagtgactccantcctcgtntgagcgccatccgcaaggatcaagggacgactgttgactgtactatgtttgactcactcccagtgaccccgactttcgagggagaactgagtttctcatacgattgacctgtgacctctgaggacatttccacagggcgtctggtcgccaacctcacccccccaagccaca

SEQ ID NO: 494103 - DNA, 124 bp, Homo sapiens
cttccgtgcccaggtggcacctacttaagacagctgctatagaaggccattgtcatcacagactagggtgtgacatcaatagtttatgaagcgactaaggatatagaagagggccggaagatca

SEQ ID NO: 494104 - DNA, 128 bp, Homo sapiens
tacttaaattcagtatattcagcagtgctggatacatacacgttgctatgcagcccatctccggcaactcctattgtgtctttcacagtaaaactctgtatatgttacacaaagagtacccatttagg

SEQ ID NO: 494105 - DNA, 271 bp, Homo sapiens
acggcatcccactgttctactagtagaaaatgcgtgatgttgtttcctgctgccctcatggtcttgcgtctgaagcctacaagaaagtttgcctatctggggctcctgtctcacgaggttggcttgaagtactagtcagtgatagccaccctggatgataagagtaaagtgaaagtcaagatcttctaccgtaataagatacagctcattaggtcacgtaaacaggcctataatatcgtggagaatgaaaattgacaaatacactgaggtc

SEQ ID NO: 494106 - DNA, 804 bp, Homo sapiens
  misc_feature (594)..(594): n is a, c, g, or t
aatataatttggcatgatgatccatattacatatgtattcggtagaatcttgaagatagtccataaacttaatgatcgcgttgacaaatgaggttatagatattacggcaattttttctggataggatatctgttctatggtggtagtgatgattcgaacttgatcagagacatcccatttgccttgtaacatataggggtgaaagctgagggctcatttactaagagtacaaaggaatgctggggaagcagattattctagtccttatgctagaggatgaagttggactcgattttaatgtgtgatcgtttggggtctagtcaggtataattgtatagctttcgttgataatggggtaagttttctacatgttatggagtaacagtaataggttcatttatatgtcgcatagctagaagacgagtgtcaaatattttgagagcacctggtctacgggacataattggagtctaaagtcgctgatccgtagctagagtaggaaaacagatatagtatttgtaatagccttattgttttgtgaatccgtaatgacgcatgacgggttcttggcgtctcttttggaatctaagtgngaggtttccggtagatgattgtacgttaagtcaatccctggcgaacaataaattggaggattctggtgttgcagtaagtggaaacgtttgcatgagcgactgtggggggaacgatgtgaaggatattgtgccgacagtggcagaggttaacttcggtttggggcattttttgaagcttggattgaatttcaagaatttgggggggagaaa

SEQ ID NO: 494107 - DNA, 134 bp, Homo sapiens
  misc_feature (36)..(36): n is a, c, g, or t
  misc_feature (115)..(115): n is a, c, g, or t
  misc_feature (121)..(121): n is a, c, g, or t
gagagcttgagctcacacgcaaagatcagaggaccnacagagagggctctttggaatgaggaccagggctaacctttccggcctttgacccatcacaccccatttcctcctcttncccttnccccgccgcccca

SEQ ID NO: 494108 - DNA, 635 bp, Homo sapiens
  misc_feature (473)..(473): n is a, c, g, or t
  misc_feature (529)..(529): n is a, c, g, or t
  misc_feature (558)..(558): n is a, c, g, or t
  misc_feature (615)..(615): n is a, c, g, or t
  misc_feature (635)..(635): n is a, c, g, or t
tactgtggctcacacctgtaatcccaacactttgggaggctgaggcaggcggatcacgaggtcaggagatcgagaccaactctggcctcccaaagtcctgggattatagctgtttcctaatccaggacaaaattatgctggcgggtaagaataaaggtctaactcctaacttgactccaagtaattagaggaaaggacagcttacagtagccataggtttccatggagtacacactatctacctgtacaccatagacgtaaatgctaattacagcaacaaaaagggccacccttatcctgagaatggactcctgaagtttacagtcttaaagtctaaagattattggccaggcgcgatggatcacgcctgtaatcccagcactttgggaggccaaggcgggtggataacttgagctcgagtttgagaccagcctgggcaacatggtgaaacccttgctttactaaaaatacanaaaatagctgggtgtggtggcacttgccttgtaattcagctgcttgagaggctgangcacgaggatcgcttgagccctggaagcngaagattgcagtgaagttgagatggtggcaacttgccttccaggcttggggaacagnatggagacctttgtctcccn

SEQ ID NO: 494109 - DNA, 287 bp, Homo sapiens
gctctgagggtcccgggccggttggcagctggcgcaacgaggccagagcccgtgcccggcagaggagctcaagtcggtctgggcccgttgccaccgactcccacctccagcacccatgcccgctgcaccgctgccatcctcagattcaccgcgtgctctgcgcggccgaggccggagccaccacatccacctcgccccagagcaggctctgctccctcctatggagcggctgtgtgccaggctgctcagactcctgggtggcttccagacggaccgggcagcccctc

SEQ ID NO: 494110 - DNA, 485 bp, Homo sapiens
ggtatatttgaccaaacagggctttagtttaccccttttgacaccctgtgacttagactgacgtgacaccacgcgagtgctttccgttagcctcatgatgttcggactagtacagacgcatacctacaacggaggagaaccagtggatatccatcagttggctgccatcaaccgcaaagggccatttggactctaactaaggaccgcgtgaaaccgtgtgatacttctgggcaagtgcgtgactcaatgacagcgagccacggggcctattgctctcattgatcacggacgtactattgagaaggcctcgccttatggctagtagacatatgggtaaggacatgctacccttaaaatgtcagggtgcataaaagctggaattccatgggccatacgcagatgaagggaactcgaggacccgtcgattccttggataaattaggtatgggaaactgtgggaacttatccatcttccagaaagatgc

SEQ ID NO: 494111 - DNA, 200 bp, Homo sapiens
aaatgttatcggaacggagctgactgtgtgtaatgtctcccctgtaatcccagtaccttgggacggccaagggggaaggattgcttgaggccaggagtttgggatcatagtgagaccccgcctctatttaaaaaattaaattttgttttgttttgttttgagttgcagtcttgctcttgttgaccatgctgacgtgcaat

SEQ ID NO: 494112 - DNA, 145 bp, Homo sapiens
ggcccgaatcctaatacggggagaagggggtggcgaggttattaagaaaaggttggtaagatcaggatgaaggggaattcataggatatggcagttaggtggtcaatgatagccttgaaggagaaagagtgtcacaggaaggttg

SEQ ID NO: 494113 - DNA, 225 bp, Homo sapiens
  misc_feature (60)..(60): n is a, c, g, or t
  misc_feature (83)..(84): n is a, c, g, or t
  misc_feature (88)..(88): n is a, c, g, or t
  misc_feature (94)..(94): n is a, c, g, or t
  misc_feature (99)..(99): n is a, c, g, or t
  misc_feature (106)..(106): n is a, c, g, or t
  misc_feature (108)..(108): n is a, c, g, or t
  misc_feature (114)..(114): n is a, c, g, or t
  misc_feature (124)..(124): n is a, c, g, or t
  misc_feature (126)..(126): n is a, c, g, or t
  misc_feature (128)..(128): n is a, c, g, or t
  misc_feature (133)..(134): n is a, c, g, or t
  misc_feature (141)..(141): n is a, c, g, or t
  misc_feature (146)..(146): n is a, c, g, or t
gaggcgaggaagtcaccatcaaaccactttatctacagttagcataagatgtgagaagtnttgacaggaagctgcagcttagnntggnatgatnacatnctccatngncaacangattgacacngnantgcanncagaganccccnaggggaatcaagggaagccttctttgctagttctggttccctgagggcccccagtcccctttcttttgttccctccccc

SEQ ID NO: 494114 - DNA, 205 bp, Homo sapiens
agagaataccaggagacgagcacatctacacgtcatcgtcacagcccatgcatttgtaataatcttcttcatagtaatacccatcataatcgagaggcgtttggcaactgactagttcccctaataatcaggtgcccccagatatggcgatttccccgacataaacaaccataacgcttctgatctcttaccacacctctctcct

SEQ ID NO: 494115 - DNA, 116 bp, Homo sapiens
gtgggatacacactactcacattgaccagtaccaaaagagacacacatagtaagatcacttgaagctgggtaccaactatcaaatgacagaccaaaaggagagacgcacacacaga

SEQ ID NO: 494116 - DNA, 114 bp, Homo sapiens
ataccctacttatgtgttaatgcacttggcattcttgcagagagacatccggttgttcaactcatcgcattcatttacatcgacacaggtcatcttggccgtatccaagtgata

SEQ ID NO: 494117 - DNA, 424 bp, Homo sapiens
  misc_feature (57)..(57): n is a, c, g, or t
  misc_feature (79)..(79): n is a, c, g, or t
  misc_feature (148)..(148): n is a, c, g, or t
  misc_feature (217)..(217): n is a, c, g, or t
  misc_feature (219)..(220): n is a, c, g, or t
  misc_feature (222)..(222): n is a, c, g, or t
  misc_feature (230)..(230): n is a, c, g, or t
  misc_feature (277)..(277): n is a, c, g, or t
  misc_feature (280)..(280): n is a, c, g, or t
  misc_feature (405)..(405): n is a, c, g, or t
  misc_feature (410)..(410): n is a, c, g, or t
gactctagaggatccccgtcagatgctcagctcacgggaaggagatgttaactaacntaaaactaaagctgatactcgntgctctttagggagcttcccttgactctcttgaaagagacacagccccattttacattatttcgtggantttcaccacatagtatagtttttttctgtaagtccctattcttactgtaataacaggctggaacctgangnntntgaagaancctcagtggcccatccctgactgacacttgggagacctcaaagcagncanagagcagcagctagggctttaaaaccctgagctttaagactccccactagcttcgctgctccctttggcactgcttaacgctgccctcagctttccctcactctgctactaactggggcatactnctggncaggcacccacctc

SEQ ID NO: 494118 - DNA, 255 bp, Homo sapiens
cgcgagggagcaccctcggatattctacaccagagaactcatatactacatcaccgctcagagatacccacggtaccactcacatgcacacacacataccagaccacagacatacaccactcacatacactcacacatataacacaccagacacacacactcacacatataccataccacacacacacacaccactcacattcagataataccacaccaggccaggcgcggtggctcacacctgtaatcccaaca

SEQ ID NO: 494119 - DNA, 1090 bp, Homo sapiens
  misc_feature (1)..(1): n is a, c, g, or t
  misc_feature (452)..(452): n is a, c, g, or t
  misc_feature (454)..(454): n is a, c, g, or t
  misc_feature (479)..(479): n is a, c, g, or t
  misc_feature (529)..(529): n is a, c, g, or t
  misc_feature (535)..(535): n is a, c, g, or t
  misc_feature (553)..(553): n is a, c, g, or t
  misc_feature (584)..(584): n is a, c, g, or t
  misc_feature (737)..(737): n is a, c, g, or t
  misc_feature (867)..(867): n is a, c, g, or t
  misc_feature (879)..(879): n is a, c, g, or t
  misc_feature (910)..(910): n is a, c, g, or t
ncactagatgcggggtgtggaatgttcgcgttctgtttctctctctcttctgtgttcgttatacttgcgctcgttcttgtcgtgtcgttcttgatctctcctccttgtgtctattatttctgttttcgtctgtgttccttcctgcctattcgctcggtgtgttttgtcccccgcgccctccccgtttgtgttctttccgtgcttgacctttccgttccgcgcccgtgtattatgatttttataggtctttttttgccccggccctactctggcataccgcggtgtcgtggaaaattgggggagttatattagtgattccccttcccctttatgggggcgcacgagagtgttcttatgagagtgtgtagtacgcgtgcaacaaagtgaaatcttctgagtgtgaaccaacccaccactggacatactgtttagcccacttttttagaaaaggncngcaccctccggaaccatggtgatgncacttctccaatactgcccagactcacagtcccaagaagtaatgttcttnaacganttagaagagattttagangtcattgaaccatcagaatttgtgaagatcntggaacccctcttccgccagttgcccaatgtgtctcccagcccacacttcccggtgccagagcgagctctctattactggaataatgaatacatcatgagtttaatccagtgaccacgccagcgaagattctgccccatcatgtttccttccntgtaccgccactccaagaccccttggaccagaccatacatggcttgatatacacgccctgaagctcttcatggagatgaacccaaagctatttgatgactgtacaccaccgttccaagcccgagaaactnaaagagaagctnaaaatgaaagaacgggaagaagcctgggttnaaatagaaaatctagcccaacccatcccccggtactaaaaaagagaataacatgaaacgccccgggttacttgaatgtttttataagataggaatatatgtcttcaccctgggggggtctcgatttcactaacgttgtatatgaaaatgtctgccataaaaagtacttttaaactttgta

SEQ ID NO: 494120 - DNA, 408 bp, Homo sapiens
aggaggcagggaggagacagcacagcccccaccacagtattctagcacacacatgaggcctgctagggagaagagaacatgaatagggaagctacagaagtatatgacggacagacgaacaggaaaatgggcacggagaggaaaggacaggaaaggaagagaaggtactgaactatagcaaggtaaatataaggtccacgatacctagagggactgaacgcacagagccgaagaacgtcccggaaatagggtaccacgaagggtgtatatctacatgcacaaccgcagctcggaatattcagcccacacacatacccaccttgaaactctatgttatcaaggcccctagatggcctccactgcatcctctgcccgctccatgtgtacaaaggcctaatctatcacgat

SEQ ID NO: 494121 - DNA, 103 bp, Homo sapiens
gcggccgcctactactactactgctcgaattcaagcttctaacgatgtacgggggcatgtgatgtctggtctgaatgcacaagctaagagagcttgcaaaaaa

SEQ ID NO: 494122 - DNA, 298 bp, Homo sapiens
tggaaagagtcatatcactatctgtgtatgttctttatcgcgttatcagtgtgccgggcgccactctgagcatgctacatgcagcatcttgtgtgttccccacagtgccctgtataatgtgtgctctgggttgtgcccattaacaaatatgtcttctgccgttgtttttttattctatgtaggctgtcctccacatattgtcgtaacccagttccgctgctctcttggttgacctcttttatcctacgataatgcacaaccacggcgctgtgaatgatgtaggataggccaggctatt

SEQ ID NO: 494123 - DNA, 140 bp, Homo sapiens
ggttgaaggctgcagacattggagttgcgatgggccagactggtccagatgtttgccaagaggcagcagacatgatcctagtggatgatgatttcaacccataatgtctgcatcgaagggtaagggttttaataccttaa

SEQ ID NO: 494124 - DNA, 498 bp, Homo sapiens
gagagagaaaggcagggcagagaggactccctgtagcttgtgaggtgaaggcagaggtatgaggaggagaggcctgcagatgaggaccccattgctccatggtgacagggggctgctaggtgtcttcactcttcaagagggtgagcggtagggaagcagagtggtcaggaatgcagtctctgggagccagtactgtctggtttggaagtcccagctctgtactatgtctagcagtgtgtacattttaaattcttcctctggaagatagaaggaacaatggcaccttcgtcatagggatgtgggtgaagtattcatggaggcagggtgtgtaatgtcgctgatagcagctcctggtacagaagtattacccttcattagcagggtcttgttgagctgtgtgtgagcaccagcacccctgatagggtgtgttcctgtaagtccctgggcctccgagcaagtccccagcagtctactcggctactcaagtggaccttgtct

SEQ ID NO: 494125 - DNA, 246 bp, Homo sapiens
actggtcgctgatttacatcattaaacagctgtgcccgtccctacgccatcggggggctgtttagagcaaagggagacagcttttacgctcctgctcctgttcccatgccaataatgctaagcagcccaaactgttgaagtactccaggaagcatttccgccagcttacccatggagggttacacgtcccctgcgaggaaggaggctgcgccgtcctgctggccaggggcgtccacgtggcagacg

SEQ ID NO: 494126 - DNA, 104 bp, Homo sapiens
ccacacacgttactggtgtcacggtggcggcgaggttgtaggtgagtggacgatcacgccatatgcactcccacctgagatagagtcagatcctgtctccctcc

SEQ ID NO: 494127 - DNA, 279 bp, Homo sapiens
ttacaacccacgatcacaatgcatgttaagtacgtgaaccggtcaggcacagtggttcacgcctgggatcccacctactatatgggaggacaaggtgaggtggatgtgcctgagagtacccaaggtcaagaagtttgagagcagcctgggcaacatggtgaaaccccatctctatcagaaatacaaaaaattagctgggcgtgggtgggtgggcgccggtaatcccagttactcgggaggctgaggcaggagaatcacttgaacccgggaggcagaggt

SEQ ID NO: 494128 - DNA, 279 bp, Homo sapiens
ccccgggttttttttaaaaaatttttttaaaaaaaaggggttttttcccctttttcccctttctcccaaaaggtttttttatttaaaaaatgggggccccccctatttttccctttttttttttttgttaaaacccccccccggaagtgggggaacaccccaacccaaattttttttgggggaaaccttgtggggggggggaaattgggggaaccctttttttttttttaaagttttttggaaaaaaaaagcgcccccaaaaaatttattttttttaaa

SEQ ID NO: 494129 - DNA, 757 bp, Homo sapiens
  misc_feature (428)..(428): n is a, c, g, or t
gactcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctatgatgtctaccgtagaaaagcctcagaaagacagtatcagagaaggctggaagatgaatgagactgaacttcagcagtcaataaagtcaatatgaatttttaaaaaaaaaaaagaaacaaaaanaaaaaaaaaatttgggggggcgcctgggcccctggaagagagttgaaacaccaatcgttgggggacgagcgagcgcccacagggagtcgtgtaatgtcaaccagggggcaacaaaggagggtgcccagagaagaaagaacagcgggcaccgagaaacaaggggctgtggatgtcaccacccagtaaaaacacgcccgggggggacaacccgggcgggtttgtgaacacgaactcccacgagaggggaggccggaggagcaaagaggggactagtatacacagaggggccaagggagctcgacatacaaatatcccacggcggggggaga

SEQ ID NO: 494130 - DNA, 1046 bp, Homo sapiens
  misc_feature (717)..(717): n is a, c, g, or t
gtttaccatactggccaggctggtctcaaactcctgaccttgtgatccgcctgcctcggcctcccaaagtgctgggattacaggcgtgagccactgtgcccggcctggaaagaagattctttacatgaaggtggcgagtcaaaggtctggcaaagcagcagctggaacaaggaaactgatctcctctccccacctgaaggtttctggatatgggagagggagcatcagagagccaagaggcaagaagtgcctttgaggagccaggttttagttaagaaggatgacttcagagcacagaatagaaattatgggggagaaggaagtgagggacatcttaaaacactaagagatgtgctaagacatgattctatctttcaagacactgacttttaccctatttaagtctagaactccattatcatagtcctcatctaactcaagttttgttttaagtttattttggcattgagttaaatattaatgccaagattcagaagtaggtgacagacctagactattggttaaattattcagattgttttaattttaaatatgtttcttaaacatctgagcaactttttgtttgatacagatgatgtctaccgtagaaaagcctcagaaagacagtatcagagaaggctggaagatgaatgagactgaacttcagcagtcaataaagtcaatatgaatttttaaaaaaaaaaaagaaacaaaaanaaaaaaaaaatttgggggggcgcctgggcccctggaagagagttgaaacaccaatcgttgggggacgagcgagcgcccacagggagtcgtgtaatgtcaaccagggggcaacaaaggagggtgcccagagaagaaagaacagcgggcaccgagaaacaaggggctgtggatgtcaccacccagtaaaaacacgcccgggggggacaacccgggcgggtttgtgaacacgaactcccacgagaggggaggccggaggagcaaagaggggactagtatacacagaggggccaagggagctcgacatacaaatatcccacggcggggggaga

SEQ ID NO: 494131 - DNA, 270 bp, Homo sapiens
gactcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccagatgatgtctaccgtagaaaagcctcagaaagacagtatcagagaaggctggaagatgaatgagactgaacttcagcagtcaataaagtcaatatgaattt

SEQ ID NO: 494132 - DNA, 807 bp, Homo sapiens
  misc_feature (478)..(478): n is a, c, g, or t
gcactgacccgtcaactcccggtttcccggcgcacgcccctcgtgagatgctgtggtcttttctagcaacgtcgacaggctttccaacaaaattcctctttcctgcgcagaaccgctctccactcgcatttcttctgctcagatccgtattccgagcccgcacgcataccaggctgtgctcagggtccggaggaggccgacccagtagccgtgggccctgtcggaggggagccagctgggcgcgcgttgttttctgaggtggccgcgctgtctttcagggtgtgtgtacattcgaaactccactgaaccttgattgaagacctacagtgtggcagtccatggcctggggactgatgatgtctaccgtagaaaagcctcagaaagacagtatcagagaaggctggaagatgaatgagactgaacttcagcagtcaataaagtcaatatgaatttttaaaaaaaaaaaagaaacaaaaanaaaaaaaaaatttgggggggcgcctgggcccctggaagagagttgaaacaccaatcgttgggggacgagcgagcgcccacagggagtcgtgtaatgtcaaccagggggcaacaaaggagggtgcccagagaagaaagaacagcgggcaccgagaaacaaggggctgtggatgtcaccacccagtaaaaacacgcccgggggggacaacccgggcgggtttgtgaacacgaactcccacgagaggggaggccggaggagcaaagaggggactagtatacacagaggggccaagggagctcgacatacaaatatcccacggcggggggaga

SEQ ID NO: 494133 - DNA, 136 bp, Homo sapiens
agtactccatgacagtaatttttttacttacagcgataattagaaatttctgtggttttcacttgaccttaaaatctatttttccttagggagactttacattttccatacgtacctggagtatatgggttacgcc

SEQ ID NO: 494134 - DNA, 624 bp, Homo sapiens
  misc_feature (295)..(295): n is a, c, g, or t
gactcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccagatgatgtctaccgtagaaaagcctcagaaagacagtatcagagaaggctggaagatgaatgagactgaacttcagcagtcaataaagtcaatatgaatttttaaaaaaaaaaaagaaacaaaaanaaaaaaaaaatttgggggggcgcctgggcccctggaagagagttgaaacaccaatcgttgggggacgagcgagcgcccacagggagtcgtgtaatgtcaaccagggggcaacaaaggagggtgcccagagaagaaagaacagcgggcaccgagaaacaaggggctgtggatgtcaccacccagtaaaaacacgcccgggggggacaacccgggcgggtttgtgaacacgaactcccacgagaggggaggccggaggagcaaagaggggactagtatacacagaggggccaagggagctcgacatacaaatatcccacggcggggggaga

SEQ ID NO: 494135 - DNA, 598 bp, Homo sapiens
cacggatgcatctgcagactggtgtgaggtagactcatttcatgttcataatatgaaatccagatctttggatacttctcctctgaagaagatcctattgcttcccagttggatgaagaaaatttggttttctttgtgtctagaaaaaggcgaattttaatttcaggtagtagaagacgagatgtgattaagagcattgtcaagatacctcacctggatttactaataacagctactcagaaaggattaataacagtttttaataaccagttcttcagtaatctccagctcaggaaatctttcagaagttgaagtcacagacagccagattctgtcagaggagggggctgtgtgggccctggaggtggtgcagtgagggatgcagagtgtgggcgtggagtctgggctccagcctcgcactaacacttacagctgtgcgtgttatttaatatctgcatgccctggttcctcatcccgaatcatagaccttctttcttgctgtttaagtgagttaatactcatgaagtgcttagcatcattagagttcctcagcaaatattggccattgctataataaacaaataatgtgaaaacaaaa

SEQ ID NO: 494136 - DNA, 449 bp, Homo sapiens
atacaggtaaaagtcccagctcatcactagcatgtctagggtctagggtgagtagatgggtatttagatgatctggggagcaccagctatgttcattctacgataaggggaggctggtctgtaaacacaaaaattgttgtccagatctttcatctgtttatgatcatcaacaaagacttgttagacaggtctagtcttagacactatggcggttaatctagggaagatgaattaaatgggtagatagtgatgcatacctgtatacactgatgtcatgtataagggatttgggggggatacctcagttcatgtggaagggacagtctcggtgtgtcccatgaatcaccttggcactgcaacacatggtttgtgctcagaaaaagtctttcatggtgacaggaagacagtttccctggagctggccatgaaggccttagaagccatttctg

SEQ ID NO: 494137 - DNA, 393 bp, Homo sapiens
ctttatgcaagtaaaatacctttgaaataatcattatgtgattaaaattttatcataattttcagttcttcagtaatctccagctcaggaaatctttcagaagttgaagtcacagacagccagattctgtcagaggagggggctgtgtgggccctggaggtggtgcagtgagggatgcagagtgtgggcgtggagtctgggctccagcctcgcactaacacttacagctgtgcgtgttatttaatatctgcatgccctggttcctcatcccgaatcatagaccttctttcttgctgtttaagtgagttaatactcatgaagtgcttagcatcattagagttcctcagcaaatattggccattgctataataaacaaataatgtgaaaacaaaa

SEQ ID NO: 494138 - DNA, 836 bp, Homo sapiens
aagtgccgtaggtgttaccggcccccccggagttacgggatggccggtgtgcgtccgcctgctggacctggtgcaccgtcagcctgcctggtgcactgggactggtgctgggggctgctgacctcgtggctattgagtgcccaggatcccgtgagacgcccgctgccctcagtgaccctgctgggtcgcacgccctccccagcttctgctgctcgctgctcttcgtgcagggcgaggtcaggtgcccccttctcgcctctcttctcttctcttctcttcctcctccacttctgtgcccgcggagactccggccgcccccttccgcaggggtgtagtaatctgcggagctgacagcagcccctgtagccaccctgcccgaagtctcctggaagcggcactgagctcatggccagccgcagcccctggcggacccactagttggacctgaggagccatgccctcctccctgcacccaaacttggagcacttgaccttttggctcgttgcgacgggggcaggctcgctgggttggctggaccatgctgcggatgcctgcgagggcatcttgcctggatgacctgtctggctgcactcccgggctcctggctttgcctctggggatcccgagtgtgtccaacatcagaccgcatgtggactgagacctagagtcatggatgtatgccgtcgtcttgcactgtggctcctctggggactcctcctgcaccatgccagagcctcagacatagtcacatgtgagaaggcgaccaggaaccagctcgggggccaactctgagtgagtccactggagcagagtatttggcgaattgacaaagccc

SEQ ID NO: 494139 - DNA, 414 bp, Homo sapiens
gttctgcgcgtgcgcggaagacggacggcgcgtggcggaaggcaggctagctcctcgccgtgcaggagggtatacggcttaaggaggctgcggtggacaccacttcttaatgtcgaaggtcttcgcggcgctcacctcggctcctactgttcggcacggtacgcaccagccaccttctgcgccgaaggcagtcggtcgccactgagaggaaccgctctaggcacgtacaggcactatgaggatgcgtcgcgcgcggagcactctgggacttgtagctctggacatggagcgagctgtgccgctcgcggtgcctctgggtcagacagaggtgttccaggccttgcactggatgcatatgaccatgttctgccagagcgtctcaccatgagcgaagagtctgacggctgtcaactt

SEQ ID NO: 494140 - DNA, 199 bp, Homo sapiens
gtggccagaagcttctgacgagaaaggctgacagcagctccagtgaggaagagagcagctccagtgaggaggagaagacaaagaagatggtggccaccactaagcccaaggcgacttccaaaggagcttttacctttccttccaaggaggcttcctagggtagtagggacaacagctctctatttcaggcacactctcc

SEQ ID NO: 494141 - DNA, 992 bp, Homo sapiens
  misc_feature (37)..(37): n is a, c, g, or t
  misc_feature (42)..(42): n is a, c, g, or t
  misc_feature (45)..(45): n is a, c, g, or t
  misc_feature (50)..(50): n is a, c, g, or t
  misc_feature (713)..(713): n is a, c, g, or t
  misc_feature (786)..(786): n is a, c, g, or t
  misc_feature (987)..(987): n is a, c, g, or t
taacatacggtctaggacatgccaatggttatcaggncgagnccngctcntgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccagggtgacgttcacgcgcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgnggattgaggtgacggtcaaggccaaagcagatgccctctacccggtggttagtgctgccagcatctgtgccanggtggccgggaccaggccgtgaagaaatggcagttcgtggagaaactgcaggacttggatactgattatggctcaggctacccaatgatcccagacaaaagcgtggttgaaggagcacgtggagcctgtgttcggttccccagttgtgcggttcagctgggcacggccagaccatcctggagaaagaggcggaagatgttnatggg

SEQ ID NO: 494142 - DNA, 123 bp, Homo sapiens
ctgtaccgcgattaaactcactacagtaacaccattgacacaaatgttaacccagaacagtgacatgtgtgtaacctggaacagggacatgatgtaaccctgggacagtggagagtgctgtaa

SEQ ID NO: 494143 - DNA, 950 bp, Homo sapiens
ggtatgggttagtacggttaattgatagagaggtgtagtcagtgggtcgggatcggaaattatggtgtatgcagatcgattacgtatagaaactggatagttaagaagtgagggttgcgttagtgacgatccattcgctggatacactcatgcgagaggagactcgcctagtgggaattggtgctaaagcaccagaaagtcgacataatcctgatccctcgtctcgaatccacgtgggcactcgtatcccttctttcggcacctaccggagtattaaagtacactccatgatgatgataaactgtttcagggaatctgtatcctcttcattggaaattcccaacagagttggtctgcggtgtctgtgctcccatctcttgttcaggggcctgtggtgctttggttccttcccttcgtgaatgtgcgcacgtgtttgacctggtctacatgagcttcggtggtgaattgtgtgacccttgcgggtccgggagacttcttcacgagtttgtggcaaccatccaagaggcgattttgtggggccattacccaaacggttgtgcttgacttgtgcgccattctactctctgaactaacggtagcttgtctctgttatactcggcatgaataaatacagctatggctatgcccagtgtcctgtggaagttagtgccagtgagaactcgtccaaggattgaaaagccactcgagagagatatggtcagagagatctgctacgtcatgtcccatgaggaatattttcaaaacaaggagttctccctgtggtgacgcggcacaagcatggtttaaagtcttcggcactcttggttctgaaagtgccattgtggacacgtttagaaatcggcacggggaacaatgacgacatggtgagtggacttcggctgaatcattctgcctcgcgagaagaaggcccccgtcaagcatcttcggac

SEQ ID NO: 494144 - DNA, 848 bp, Homo sapiens
  misc_feature (37)..(37): n is a, c, g, or t
  misc_feature (42)..(42): n is a, c, g, or t
  misc_feature (45)..(45): n is a, c, g, or t
  misc_feature (50)..(50): n is a, c, g, or t
  misc_feature (642)..(642): n is a, c, g, or t
  misc_feature (843)..(843): n is a, c, g, or t
taacatacggtctaggacatgccaatggttatcaggncgagnccngctcntgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccagggtgacgttcacgccggtccacggcataggggataaggtcagtggcagtgtagtgtgactgggacggctggtggttagtgctgccagcatctgtgccanggtggccgggaccaggccgtgaagaaatggcagttcgtggagaaactgcaggacttggatactgattatggctcaggctacccaatgatcccagacaaaagcgtggttgaaggagcacgtggagcctgtgttcggttccccagttgtgcggttcagctgggcacggccagaccatcctggagaaagaggcggaagatgttnatggg

SEQ ID NO: 494145 - DNA, 844 bp, Homo sapiens
  misc_feature (37)..(37): n is a, c, g, or t
  misc_feature (42)..(42): n is a, c, g, or t
  misc_feature (45)..(45): n is a, c, g, or t
  misc_feature (50)..(50): n is a, c, g, or t
  misc_feature (565)..(565): n is a, c, g, or t
  misc_feature (638)..(638): n is a, c, g, or t
  misc_feature (839)..(839): n is a, c, g, or t
taacatacggtctaggacatgccaatggttatcaggncgagnccngctcntgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactcccacatgatacagccactgggcttatacagtatgcattggaccagggcgtgaacgtcacccaggtattcgtggacaccgtagggatgccagagacataccaggcgcggctgcagcaaagttttcccgnggattgaggtgacggtcaaggccaaagcagatgccctctacccggtggttagtgctgccagcatctgtgccanggtggccgggaccaggccgtgaagaaatggcagttcgtggagaaactgcaggacttggatactgattatggctcaggctacccaatgatcccagacaaaagcgtggttgaaggagcacgtggagcctgtgttcggttccccagttgtgcggttcagctgggcacggccagaccatcctggagaaagaggcggaagatgttnatggg

SEQ ID NO: 494146 - DNA, 15534 bp, Homo sapiens
ccagccgtgtgtgatgagtggccacaccttgcctcctcttcccgtcccaggcaccaacagcacagagcaggccagtgtacccagagccatggcagccacgctgggagccggcacgccccccaggccccaggccaggagcatagctggggtgtatgtggaggcctcgggccaggcccagagtgtctacgccgccatggagcagggcctcctgcctgctgggctcgggcaggctctgctagaggcccaggcagccactgggggcctggtggacctcgcccggggccagctgctccctgtgtccaaggccctgcagcagggtctggtggggctggagctgaaggagaagctgctggccgctgagcgtgccactacgggctatcctgacccctacggcggtgagaagctggccctctttcaggccatcgggaaggaggttgtggacagggccctggggcagagctggctggaggtccaactggccactgggggcctggtggaccccgcccagggagtgctcgtggcccctgagccagcctgccaccagggcctcctggaccgggagacatggcacaagctgtcagagcttgagcctggcacaggtgacctgcgcttcctcaaccccaacacgctggagcggctgacataccaccagctgctggaaaggtgtgtgcgtgcccccgggtcggggctagccttgctgcccctcaagatcaccttccgctccatgggcggggcggtgagtgcagctgagctgctggaggtgggcatcctggacgagcaggctgtgcagggtctgcgggagggcaggctggccgcagtggacgtgagtgcacgtgccgaggtgcggcgctacctggagggtaccggcagcgtggccggggttgtcctgctgcccgaaggccacaagaagagctttttccaggctgccaccgagcacctgctcccaatgggcaccgcgctgccactcctagaggcccaggctgccacccacaccctggtggaccccatcacaggccagcggctgtgggtagacgaggcagtcagggcgggcctggtcagcccagagctccatgagcagctcctggtggctgagcaggccgtgacagggcaccacgaccccttcagtggctcccaaatcccccttttccaggccatgaagaaggggctagtggacaggccactagcactgcggctcttggatgcccagctggccacaggcgggctggtctgtccagcacgcaggctccggctgcccctggaggccgccctgcgctgcggctgcctggatgaagacactcagcggcagctctcgcaggctggcagcttctcagacggcacgcacggcggcctgcgctatgaacagctgctggccctctgtgtcaccgacccagagaccgggcttgccttcctgccactctcagggggaccccggggaggggagccccagggacccccattcatcaagtacagcactcggcaggccctgagcacggccacagccaccgtctctgtggggaagttccggggccggcccgtgtccctctgggagctgctcttctctgaggccatctcctcagagcagagggcgatgctggcccagcagtaccaggaagggaccctctccgtggagaagctggccgctgagctgagcgccacccttgagcaggctgcagccactgccagggtcaccttttctgggctgagggacaccgtgacaccaggagagctgctgaaagccgagatcatcgaccaggacctgtacgagcggttggagcatggacaggccacagccaaggatgtgggcagcctggcctcggcgcagaggtacctgcagggtacgggctgcattgctggcctgctgctccctggctcccaggaacgcctgagcatctatgaggcccgatgcaaggggctcctccggcccggcactgccctcatccttctggaggcacaagctgccacaggcttcatcatcgacccaaaagcaaacaaggggcactccgttgaggaggcactgagggctgctgtcattgggcctgatgtgttcgcgaagctgctgtcggctgagcgcgctgtcactggctacactgacccctacaccgggcagcagatctccctcttccaggccatgcagaagggcctcatcgtccgggagcacggcatccgcctgctggaggcccagatcgccacgggcggcgtcatcgaccccgtgcacagccaccgcgtgcccgtggacgtggcctaccggcgcggctacttcgatcagatgctgaacttgatcctgttggacccttctgacgacaccaagggcttcttcgaccccaacacgcacgagaacctcacgtacctgcagcttctggagcgctgtgtgcgtgaccccgagacgggcctgtacctcctgccactcagcagcacgcagtccccgctggtggacagtgccacccagcaggccttccagaacctgctgctctccgtgaagtatggacggtttcaggggcagagggtctccgcgtgggagctgatcaactctgagtacttcagcgagggccgcaggaggcagctgctgcgtcgctaccggcagcgcgaggtcacgctggggcaggtggcaaagctgctggaggcggagacgcagagacaggcggacatcatgctgcccgcactgcggagccgggtcaccgtccaccagctcctggaggccggtatcattgaccagcagctgttggaccaagtgctggccgggacaatcagcccggaggccctcctactcatggacggcgtccgcaggtacctgtgcggcctgggagctgtgggcggtgtgcggctgctgccctctggccagcggctcagcctctaccaggccatgaggcagaagctgctggggcccagggtggccctggccctgctggaggcccaggcggccaccggaaccatcatggaccctcacagcccagagagcctctcggtggatgaggccgtgcgcaggggtgtggtggggccggagctgtatggcaggctgaagcgggctgagggtgccattgctggcttcagagaccccttctctgggaagcaggtgtctgtgttccaggccatgaagaaaggtctcatcccttgggagcaagctgcccgcctcctggaggctcaagtggccacaggagggatcattgaccccaccagccaccaccacctccccatgccagtggccattcagcgtggctatgttgaccaggagatggagacagccttgtccagctcctccgagaccttccccacaccggacggccaggggcgcacgagctatgcccagctcctggaggagtgccccagggatgagacttctggccttcacctcctgcccctgccagaaagtgctcctgccctccccaccgaggagcaggtccagaggagcctgcaggccgtgccgggggccaaggatggcacatccctctgggacctgctcagctcctgccacttcaccgaggagcaacggaggggcctgctggaggacgtgcaggaggggaggaccactgtgccacagctgctagcctctgtgcagaggtgggtacaggagaccaagcttctggcccaggcccgcgtcatggtgcccggcccacggggtgaggtacccgctgtctggctgctggatgctggcatcatcacccaggagacccttgaggccctggctcagggcacgcagtcgcccgcccaggtcgccgagcagccggcggtgaaggcctgcctgtggggcacaggctgcgtggccggtgtgctgctacagccctctggggccaaggccagcatcgcccaggccgtgagggatggcctcctgcccacaggcctgggccagaggctgctggaagcccaggtggcatctggcttccttgttgaccccctgaacaaccagagactgtcagtggaggacgcggttaaggtcggcctggtgggcagggagctgagtgagcagctcgggcaggccgagagggcggcggccgggtacccagatccctactctagggcctccctctctctgtggcaggccatggagaaggggctcgtgccacagaacgagggcttgcccctcctgcaggtgcagctggccacagggggtgtggtggaccctgtccacggggtgcacctgccccaggcggcagcctgcagactcggccttctggacacacagacgagccaggtgctgactgcagttgacaaggacaacaagttcttctttgaccccagtgcgcgggaccaggtgacctaccagcagctcagggagcgctgcgtgtgcgactccgagaccggattgttgctgttgccactgccttcagacacagtgcttgaggtggacgaccacaccgcggtggctctgagggccatgaaggtgcccgtcagcacagggaggtttaaggggtgtagcgtgtcactctgggacctgctgctctccgaatacgttggcgctgacaagcggcgggagctggtggcactctgtcggtctgggagggctgcggccctgcggcaggtggtcagcgcagtcaccgccctggtcgaggctgcagagaggcagcccctgcaggccaccttcagagggctccggaagcaggtgtcagccagggacctgttcagggcgcagctgatcagcaggaagacgctggacgagctgagccaggggacaacgactgtgaaggaggtggcggagatggacagcgtgaagcggtccctggagggaggcaacttcattgccggggtccttatccagggcacccaggagaggatgagcatcccagaggccctgaggaggcacatcctgcggcctggcacagccctggtgctgctggaggcacaggcagctaccggcttcatcatcgaccccgcggagaaccggaagctgaccgtggaggaggcgttcaaagcaggaatgttcgggaaagaaacctacgtgaagctgctgtcggccgagcgcgccgtcaccggctacaccgacccctataccgggcagcagatctccctcttccaggccatgcagaaggacctcatcgtccgggagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttcttcgaccccaacacgcacgagaacctcacgtacctgcagctgctggagcggtgcgtggaggaccccgagacgggcctgtacctgctacaaatcataaagaaaggagaaaactacgtgtacatcaatgaggccacgagacacgtgttgcaatccagaactgcaaaaatgcgcgtggggaggtttgctgaccaggtggtctctttctgggacctgctgtcctctccatacttcacagaggacaggaagcgggagctcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgcacacacttcgtgtggggaggactgggggacaggcactcagcacgctggagtgtgtgaagccctatctggaaggcagcgactgcattgcgggggtcacggtgccctccaccagggaggtcatgagcctccatgaggccagcaggaaggagctcatccctgcagcatttgcgacttggctgctggaggcgcaggccgccaccgggttcctcctggacccctgcacccgccagaagctctctgtggatgaggctgtggatgtgggcctggtgaacgaggagctgcgggagaggctcctgaaggctgaaagagctgccacgggctacagggatccggccacaggagacacgatcccgctgttccaggccatgcagaagcagctcatcgagaaggcggaggcactgaggctgctggaggtgcaggtggccacggggggtgtcatcgacccacagcaccaccaccggctcccactggaaacagcctacagacggggctgtctgcacaaggacatctatgcgctcatttccgaccagaagcacatgaggaaacggtttgtggacccgaacacgcaagagaaggtctcgtaccgagagctgcaggagaggtgccgcccacaagaggacacgggctgggtgctgttcccagtgaacaaggctgcacgggactccgagcacatcgatgacgagacgagaagggccctggaggcagagcaagtggaaatcacagtgggaaggttcagaggccagaaaccaacactgtgggcactactgaattccgaatacgtgacagaggagaagaagctccagctggtgaggatgtatagaacacacaccagacgggcactgcagacggtagcgcagctcatcttagagttgatcgagaagcaggaaaccagcaacaaacacctgtggttccaaggaattagacgacagatcacagcttctgaactcctcagctcagccataatcacggaggaaatgctccaggacctggaaacgggacggagcacgacgcaagagctcatggaggacgaccgcgtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggagcccgtgcccgcgggcgtggtgggcagcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggtttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaagcccccggggcccggccgcagctccaggacgccaggcgcggcccgcgggagccagggccagccgggcgaggggacggcgactcggggcgctcccagcgagagggccagggggagggcgagacccaggaggccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggtttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcggggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggtttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcggggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgagcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccaccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcggggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtgactgggcttcctccgtgcagttttctgcaactctggagaagttgaggcatacttgtgtgtctgggttgtttttttttttttttgtcattctttaattttgttgttttacccattcgttatctgtggaaaacgttttaagttgtcatgtgacagaaacttttcctttgtccatcgaggtgtttcataagttttttggtgtgttttctgggtcgtctatgtgtcatatggttttacttttctcccggaatt

SEQ ID NO: 494147 - DNA, 212 bp, Homo sapiens
  misc_feature (116)..(116): n is a, c, g, or t
  misc_feature (172)..(172): n is a, c, g, or t
  misc_feature (196)..(196): n is a, c, g, or t
ggacacagttgaggcaatgttaagagggaaattatacctctaaatgaccttattcaaaagctagggaatctcaagttaacaacctaacatcacaactaaaagaactggagaaccangagcaaacaaacctctctagaagacaagaatcaacctaagagttgaactgaagaanatacacacacacacacacacacanacacacacacacattc

SEQ ID NO: 494148 - DNA, 4589 bp, Homo sapiens
  misc_feature (194)..(194): n is a, c, g, or t
  misc_feature (196)..(197): n is a, c, g, or t
  misc_feature (206)..(206): n is a, c, g, or t
  misc_feature (224)..(224): n is a, c, g, or t
  misc_feature (1415)..(1415): n is a, c, g, or t
  misc_feature (1538)..(1538): n is a, c, g, or t
tccctttatgcgaccgccgggcctacttaggccatgcgccggggcctgctgagagccacaactgctgcgctcctgctggaggcgcaggcggccagtggctttctggtggaccccgtgcggaaccagcgcctgtatgtccacgaggccgtgaaggcgggcgtggtgggccccgagcttcacgagcagctgctgtntnncgagaaggncgtcaccggctacagagncccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttcttcgaccccaacacgcacgagaacctcacgtacctgcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggtggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggcctgcggctgctggatgcccagctggccaccggcggcatcgtggacccccgcctgggcttccaccttcccctggaggtggcttaccagcgtggctacctcaacaaggacacgcacgancagctgtcagagcccagcgaggtgcgcagctacgtggacccgtccaccgacgagcgcctcagctacacgcagctgctcaggcggtgccgtcgtgacgacggcaccggccagctgctcctgccnctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacggcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgccggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgtgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttaaaaaaaaaaa

SEQ ID NO: 494149 - DNA, 4544 bp, Homo sapiens
  misc_feature (194)..(194): n is a, c, g, or t
  misc_feature (196)..(197): n is a, c, g, or t
  misc_feature (206)..(206): n is a, c, g, or t
  misc_feature (224)..(224): n is a, c, g, or t
  misc_feature (1415)..(1415): n is a, c, g, or t
  misc_feature (1538)..(1538): n is a, c, g, or t
tccctttatgcgaccgccgggcctacttaggccatgcgccggggcctgctgagagccacaactgctgcgctcctgctggaggcgcaggcggccagtggctttctggtggaccccgtgcggaaccagcgcctgtatgtccacgaggccgtgaaggcgggcgtggtgggccccgagcttcacgagcagctgctgtntnncgagaaggncgtcaccggctacagagncccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttcttcgaccccaacacgcacgagaacctcacgtacctgcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggtggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggcctgcggctgctggatgcccagctggccaccggcggcatcgtggacccccgcctgggcttccaccttcccctggaggtggcttaccagcgtggctacctcaacaaggacacgcacgancagctgtcagagcccagcgaggtgcgcagctacgtggacccgtccaccgacgagcgcctcagctacacgcagctgctcaggcggtgccgtcgtgacgacggcaccggccagctgctcctgccnctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacggcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgccggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgtgcccaccccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttaaaaaaaaaaa

SEQ ID NO: 494150 - DNA, 938 bp, Homo sapiens
atggatactttgtaccgtgtcccgtgcttgatgtgctcgaatgtcccaactgaagctgaaaagaagccggtcctggttgcacatgcggtcggcatgactgtgtatgctctgagtggtggttgtcttactgcctcatcaccggaggcaataagtttatgattgtccattgttgaacctcaccaaggatgtcggttctatgactgaggcaacatgtggcatcagaggccatgtagcttgctttggactacagagtgaatggacagaggatatgatggacaggactggcatccagcttcgtatatacaagggaggtcttaggtttcataatcgctgggaccgatctgaatgcgaccaaagtatcccgaaaatctaatagattgcacgtatcttagggtgcattggatgcgtctgttgtgctatttgagttatttcatggcgtagagtatgcatgagagtgaaacttgcggtatattcggaatgggttagagtgcatttgattaagtagatcagtggatactggattgctcatgtcaatgaatgtttacaaaggtgtaccattcctgtaatatgaggatgtggggatggatgagagcgggaggaataggatatatctagtgaaacactgtatgtgtattgcacgctgggactagatgttcttcatgttgcttcgcagagacgacgttaatccgagaatttgttcctggtggccaatggtataccatgatgttgggtgcattccttggtggataattgagttttgcatattcaggttaaattgagtagtgttttcgaaaccctcaaggatgggaggacgtattagacatagaaacccaagatcgattgacgcgagagaaaaacaggggccaagaggtgaggtaaggagagagagaaaggggaagtaaaaagatgggagtatggaaagaattgagttttttgga

SEQ ID NO: 494151 - DNA, 4511 bp, Homo sapiens
  misc_feature (194)..(194): n is a, c, g, or t
  misc_feature (196)..(197): n is a, c, g, or t
  misc_feature (206)..(206): n is a, c, g, or t
  misc_feature (224)..(224): n is a, c, g, or t
  misc_feature (1415)..(1415): n is a, c, g, or t
  misc_feature (1538)..(1538): n is a, c, g, or t
tccctttatgcgaccgccgggcctacttaggccatgcgccggggcctgctgagagccacaactgctgcgctcctgctggaggcgcaggcggccagtggctttctggtggaccccgtgcggaaccagcgcctgtatgtccacgaggccgtgaaggcgggcgtggtgggccccgagcttcacgagcagctgctgtntnncgagaaggncgtcaccggctacagagncccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttcttcgaccccaacacgcacgagaacctcacgtacctgcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggtggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggcctgcggctgctggatgcccagctggccaccggcggcatcgtggacccccgcctgggcttccaccttcccctggaggtggcttaccagcgtggctacctcaacaaggacacgcacgancagctgtcagagcccagcgaggtgcgcagctacgtggacccgtccaccgacgagcgcctcagctacacgcagctgctcaggcggtgccgtcgtgacgacggcaccggccagctgctcctgccnctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacggcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgccggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgtgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttaaaaaaaaaaa

SEQ ID NO: 494152 - DNA, 5551 bp, Homo sapiens
  misc_feature (194)..(194): n is a, c, g, or t
  misc_feature (196)..(197): n is a, c, g, or t
  misc_feature (206)..(206): n is a, c, g, or t
  misc_feature (224)..(224): n is a, c, g, or t
  misc_feature (1415)..(1415): n is a, c, g, or t
  misc_feature (1538)..(1538): n is a, c, g, or t
tccctttatgcgaccgccgggcctacttaggccatgcgccggggcctgctgagagccacaactgctgcgctcctgctggaggcgcaggcggccagtggctttctggtggaccccgtgcggaaccagcgcctgtatgtccacgaggccgtgaaggcgggcgtggtgggccccgagcttcacgagcagctgctgtntnncgagaaggncgtcaccggctacagagncccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttcttcgaccccaacacgcacgagaacctcacgtacctgcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggtggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggcctgcggctgctggatgcccagctggccaccggcggcatcgtggacccccgcctgggcttccaccttcccctggaggtggcttaccagcgtggctacctcaacaaggacacgcacgancagctgtcagagcccagcgaggtgcgcagctacgtggacccgtccaccgacgagcgcctcagctacacgcagctgctcaggcggtgccgtcgtgacgacggcaccggccagctgctcctgccnctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacggcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgccggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgtgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttaaaaaaaaaaaaaaaaaaaaaaaaaaaaaaaaaaaaaaaaaaaaaaaaaaaaaaaaaaaaaaaaaaaaaaaaaaaaaacaaaaaacaaaacagaagaaaaaaaaaaaacaaaaaaagacggggggccgggctaccatcgaatcacccactcgcgggggcgcgcccacaacaatatcgacgcgacaccactgagtcgatgaggagaacgagggtggccccaacaaagaggagtggtaggtatatatcaacaagcgccgacgagacgccgcgtgctatgctaaaaaagaaacacagaatgtgaagcgaaagaacgggcgaacaagcaggaaaagtaatagaagagaagcgacaccacattattgggtggagcggagacgaccaagagagtgagtagcgacacacaccactctccagcaagaggaattatagaagcgactggagggagggaaaaaataaaaaacgataaggagaaagagactatgtaggggtagaaaccaccggaccaaatggttacaagtatgaacacaaggaaagttccgaagaagaaagatagtaaacgacagaagaaactttactcccccgccgtctcttttatactcaaccgagagagaagaaagcacacacaacagaaagaaaaaaacagagagaacgaaacgaaagaaagagaaaaaagaaagaaaaaacaaagaagaaagaaagaaaaaaagaaaagaagaaaaagaagaaagaaaaaacgaaagaaagaaaaaaggagaaaaacagaagacaaaagaaaaagaagaaaaagaacaaagggaacaagcaagaagcaagggaaaaaaaaagaagaggagagagacagagagaaaagagagacgagggaagacagaagagcaaaaggaaaaaagaacaaaaaaagaaaaaggagaaaaaaagaagaaagaaaagcagaaaaaaaaaaggagagaagaaggagagaaaaaagggagagaag

SEQ ID NO: 494153 - DNA, 4373 bp, Homo sapiens
  misc_feature (194)..(194): n is a, c, g, or t
  misc_feature (196)..(197): n is a, c, g, or t
  misc_feature (206)..(206): n is a, c, g, or t
  misc_feature (224)..(224): n is a, c, g, or t
  misc_feature (1415)..(1415): n is a, c, g, or t
  misc_feature (1538)..(1538): n is a, c, g, or t
tccctttatgcgaccgccgggcctacttaggccatgcgccggggcctgctgagagccacaactgctgcgctcctgctggaggcgcaggcggccagtggctttctggtggaccccgtgcggaaccagcgcctgtatgtccacgaggccgtgaaggcgggcgtggtgggccccgagcttcacgagcagctgctgtntnncgagaaggncgtcaccggctacagagncccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttcttcgaccccaacacgcacgagaacctcacgtacctgcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggtggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggcctgcggctgctggatgcccagctggccaccggcggcatcgtggacccccgcctgggcttccaccttcccctggaggtggcttaccagcgtggctacctcaacaaggacacgcacgancagctgtcagagcccagcgaggtgcgcagctacgtggacccgtccaccgacgagcgcctcagctacacgcagctgctcaggcggtgccgtcgtgacgacggcaccggccagctgctcctgccnctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacggcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgccggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgtgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggctgctgggaactgagactgtctctggtggtcacggcctctcgttgtgggcccactgggtgcggctgcgttttccatgagccccccttggccggacacagtgtgttccctttggcaacctgttagagaccttccccggttggtcc

SEQ ID NO: 494154 - DNA, 4329 bp, Homo sapiens
  misc_feature (194)..(194): n is a, c, g, or t
  misc_feature (196)..(197): n is a, c, g, or t
  misc_feature (206)..(206): n is a, c, g, or t
  misc_feature (224)..(224): n is a, c, g, or t
  misc_feature (1415)..(1415): n is a, c, g, or t
  misc_feature (1538)..(1538): n is a, c, g, or t
tccctttatgcgaccgccgggcctacttaggccatgcgccggggcctgctgagagccacaactgctgcgctcctgctggaggcgcaggcggccagtggctttctggtggaccccgtgcggaaccagcgcctgtatgtccacgaggccgtgaaggcgggcgtggtgggccccgagcttcacgagcagctgctgtntnncgagaaggncgtcaccggctacagagncccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttcttcgaccccaacacgcacgagaacctcacgtacctgcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggtggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggcctgcggctgctggatgcccagctggccaccggcggcatcgtggacccccgcctgggcttccaccttcccctggaggtggcttaccagcgtggctacctcaacaaggacacgcacgancagctgtcagagcccagcgaggtgcgcagctacgtggacccgtccaccgacgagcgcctcagctacacgcagctgctcaggcggtgccgtcgtgacgacggcaccggccagctgctcctgccnctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacggcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgccggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgtgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctgctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttaaaaaaaaaaa

SEQ ID NO: 494155 - DNA, 4118 bp, Homo sapiens
  misc_feature (194)..(194): n is a, c, g, or t
  misc_feature (196)..(197): n is a, c, g, or t
  misc_feature (206)..(206): n is a, c, g, or t
  misc_feature (224)..(224): n is a, c, g, or t
  misc_feature (1415)..(1415): n is a, c, g, or t
  misc_feature (1538)..(1538): n is a, c, g, or t
tccctttatgcgaccgccgggcctacttaggccatgcgccggggcctgctgagagccacaactgctgcgctcctgctggaggcgcaggcggccagtggctttctggtggaccccgtgcggaaccagcgcctgtatgtccacgaggccgtgaaggcgggcgtggtgggccccgagcttcacgagcagctgctgtntnncgagaaggncgtcaccggctacagagncccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttcttcgaccccaacacgcacgagaacctcacgtacctgcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggtggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggcctgcggctgctggatgcccagctggccaccggcggcatcgtggacccccgcctgggcttccaccttcccctggaggtggcttaccagcgtggctacctcaacaaggacacgcacgancagctgtcagagcccagcgaggtgcgcagctacgtggacccgtccaccgacgagcgcctcagctacacgcagctgctcaggcggtgccgtcgtgacgacggcaccggccagctgctcctgccnctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacggcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgccggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgtgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttaaaaaaaaaaa

SEQ ID NO: 494156 - DNA, 636 bp, Homo sapiens
caaaccctgaactatgcgcatggcttttcccgggacgaaaaaccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttaaaaaaaaaaa

SEQ ID NO: 494157 - DNA, 1116 bp, Homo sapiens
  misc_feature (194)..(194): n is a, c, g, or t
  misc_feature (196)..(197): n is a, c, g, or t
  misc_feature (206)..(206): n is a, c, g, or t
  misc_feature (224)..(224): n is a, c, g, or t
tccctttatgcgaccgccgggcctacttaggccatgcgccggggcctgctgagagccacaactgctgcgctcctgctggaggcgcaggcggccagtggctttctggtggaccccgtgcggaaccagcgcctgtatgtccacgaggccgtgaaggcgggcgtggtgggccccgagcttcacgagcagctgctgtntnncgagaaggncgtcaccggctacagagncccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttcttcgaccccaacacgcacgagaacctcacgtacctgcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggtggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcactgtttggactctgggcactgtttggactctgggcactgtttggactctgggcactgtttggactctgggcactgtttggactctgggcactgtttggactctgggcactgtttggactctgggcactgtttgaactctg

SEQ ID NO: 494158 - DNA, 784 bp, Homo sapiens
  misc_feature (326)..(326): n is a, c, g, or t
gccgtcgcgagcgtctctgggaccggaagtgcgggcgagctgcgtgtccccgggttctgacaggagcagcctgtgggcacctgcggcggtagttggaggcgggagagggtccgtagcctgcgccgtcctgccccgtccatgggtccttcctgtcggacctcggttctggcgggctgcggctgctcgacccgacctaagtgctgctgcactcaagcgcggccgattggtgcggtgactggagctactgtaggaggcgcatcgcactggattcttgggcgcgtggcttttcgccgcccgcatgaccccagaggcactgtacattgtcngtgacgaactgccagtggagtctccgagcccatgggtcggacgtgcagcaggtatttgctggtgctggatgaccctgtagcccggggcttttttagcccggagggagcttctgcccggaccaatccgcaaaggagcgtcgcgggagcgtctgccaagttgggccctgagcttgaagcgggacggatggcggtcagctaggagctggcaggtctacacggccagagtttcgtcccgcgaagactgccccttcccagagtgagacccacgaagcgctatactggtgtcgaggcaccaaacgtgtaccggcaatccttgcggtgccccgcggtgactggccagacaccggaagtcagcttgttgctacaccagtgcccctggtgggctctggactactaccaaacatgccaggactggtggggcctgcctggctggcacttggctggcccactttccgaga

SEQ ID NO: 494159 - DNA, 121 bp, Homo sapiens
cacaacacctccatctcatgcatcatccttaatgacatatcatatacgaaactatgcaatatatcagtatgctgtaatggtacgactcatcgaatcagtcaactgttctgtgtgaatgtat

SEQ ID NO: 494160 - DNA, 300 bp, Homo sapiens
taggctggagtgcagtggcgtgatctcactgcaccctccacctcccagattcaagtgattcttctgcctcagcttcccaagaagctgggattacaggtgcgtgccaccacatctagctaatttttgcatatttagcagagatggagtttcactgtgttggccaggctgatcttgatttcctgatctcaggtgatttgcccaccttggcctcccaaagtgctgggattataggcatgagccaccacgcccagccatttctcattgttaacacaaaggtaaaagcccttctgtcgtcttctc

SEQ ID NO: 494161 - DNA, 584 bp, Homo sapiens
ctcaccaaatggattatgggccatggctggtagttttagtgagtgctgtagggttaattcgaaaataggcagaattccattcctcccaaggtggccaaatttagctatactgatgtaattgtcctttacctgggtatggattccctggcaccccttcatgtccacatatgtagccaattttgtggaaacataaccatttggagcttctgtaattttgagccctgctctaaccaccagcctaatataaaattagtttggttttgccagtctaccaatgagctcctgccacaggactcccagccctttttcttttttcccctaactttagccatggaggatcttgggccctttatttttggggtttttttaaatcccgaagggatatagaaaccctttccgatttttcctctggtttggtcttgccgatggttttctatccaaaaccctttttttccctaccgatatttggtgccccggccgatactgctggattttggcctttttttttccggtcctttaaaactgccaaacccatttggttcctgggcccaactggctttaaattaattttcctgttttttgga

SEQ ID NO: 494162 - DNA, 308 bp, Homo sapiens
  misc_feature (32)..(32): n is a, c, g, or t
agtggtacaatgataatcttcattttacgatntgaatttcttggccgggcttggtggctcacgcctgtaaccccagcattttggaaggctgaggcaggaggatcacttgagcccaggagttggagaccagcctgggcaacatagtgagacccccatttctacaaaaaataaaaataaaaaatgagccgggtatggtggtgtgcacctgtggtcctggctacttgggaggctgaggtgggaggattgcttcagccagggaggtggaggctgcagtgagcctaggcaacagagagaggcttcatgtcaaa

SEQ ID NO: 494163 - DNA, 723 bp, Homo sapiens
gcgaatgggttgagacctcaggattgtctcgggagctgacataatgacacatgcctgcgatcagcctggggataggacaacagactacaccatccacgtttggttcattgctgccgaggcctatgctcgtttactataccagagctttatgggtagaatcccggcgctgcccacgagttctcttttacaagcaatcgatgtctgcgtcatacctgaggtccatgcatgtgaacgtagacttctgacatcgcactgcgtcaattccctctggatgctgccatcacttttgctccgtagcatccttgttgtaccccgaggtcactggtgcatggaggtgtaccatggtacctgtgcaaaggacccagcttcccagtagccattaagagaagaggcaggacgctagaacggccgtatcggtgatccatgaacgtaggtagcacgtcgtgaagctacggctatcgttgttccaacgcctagtcaactcttacacgataacgacctggccttggacgttgtgcccgcatgatgttggccttttgggtggtgccgccgaatggcacccgtgatgacgatacatgcgttggaggcgtggtggcgtcaaggcatccatgagctcagtgcccaagccgcgtggcgtcgtaatcgagagacctcagtgctactcaccgagtctgcttcgcattctcacgtgatgctctggtcccatatctggtaggacaagtg

SEQ ID NO: 494164 - DNA, 1064 bp, Homo sapiens
gctcctggatgggtcccgactgctgcaggaggtggtgatgagcctgtccaagtgctactcctccctgcctggactcgatgaacgctgagatccgcatccgctggctggagattgtggtccgaaagactaactatctgacctccacagggtgcggcgcttcctggagagccagatgtcacgcatgtacaccatcccgctgtacgagtacctcctgcaccggtgccctcaagtccttcgcgcttggaggtcttctaccagacgcagggccggctgcacaccaacctgcagcaatagccatccagcagatcctgtacccagggctagggctcccagcaaagagcccgactcagagcacaagcacggagctgggacaaggctggaaggaaaaaaaacagaatccggacgacaagaagggcccttgtcttgcttgtacggaccgagtgagcacacaaggaagtgacaatccatactactcagaggacgtcaaatgtggtcttgccataaggcacctgataggacggagcttgagccatcgaaacctatccaggacaacaccacaaatgttggcctaccctgaaggtcaaaggcactgagccctgcaactgcgaatatcggggccactggagccatatatgcttccatagcaagtgacctacaaagaacccattcaccaataggatatacccaatggggaaagggaagaaataggcgagacgatgaggaccatcccattaatactgcttacgcaagcagacagcatattacaattggtattctccccaatacaaaggcacacaataaaacagcaatacccattaacaaaaacaagtactacaaatctctcacctacacaactgacgaactaacctaccacccggaatcaaaacacgacacagtccacacctaagacatcgacaacaaaacaaaatataccgcaacataacaatagatacacaggtccagtcaactacaataaacactcatacgaacataaaccataaaatacgactccaccaaaacaacacacacaagcaacacacaacaacacaactaaaactctacct

SEQ ID NO: 494165 - DNA, 222 bp, Homo sapiens
gaagggcgaatcctaaacacatgcgtattactggtataaggagtataaatcacctgagctaaccatagcctattagaaggctaccgatgccaaatgatttaagcactgcttattacaattgtactggggctatatttaaccctcctacaaccgttaaagaactttgagctggccttcactatttccgacgtgctatacggataaacatttttgggtgcctca

SEQ ID NO: 494166 - DNA, 127 bp, Homo sapiens
gcaacgcgcgcggaggaggcaggaaccggagcgcgacagttagcttggttaggcaccatggcttgggatcaacaaccatcgaggccggtgaagcgcaagattccaggttcttgcagccagcaggcag

SEQ ID NO: 494167 - DNA, 327 bp, Homo sapiens
tggagccaagaggatggcggagctgtggctgtggccacggggcaaacagcataagcgcgggtgggttgtgttggaagaaacgggatggtaaaaactggcctaccgatggagagaggaaaggagaggcagaagaggggagaaaaacgagaaaagggtaaaagggctgagaaaggggagaatagaagaggattgcaacaaaaagccaagggcattaagtgtggatttctcctgaaggcaggagcgcataggctaaattagatctgagtcggacattggattaaaactggttgtagccttttattaaggggtagacacactttttctttt

SEQ ID NO: 494168 - DNA, 284 bp, Homo sapiens
  misc_feature (65)..(65): n is a, c, g, or t
  misc_feature (92)..(92): n is a, c, g, or t
  misc_feature (276)..(276): n is a, c, g, or t
  misc_feature (281)..(281): n is a, c, g, or t
ccaaggctcaactctgcagtttatactatatggcaacatttgccttctacgattgaggtatacancctattttcagggtgtttgtgtaggtnaaggcagtccattatgtcacacagcgcaggacatagcaagtgctcactattatatggcagctgagacagctatgtagataattcagattgagaaacaacccagtgtatcccaaattacccagacactgtctatatataatattctcttggagtaatcagtataggataacataagaacactggnctcanaat

SEQ ID NO: 494169 - DNA, 230 bp, Homo sapiens
  misc_feature (137)..(137): n is a, c, g, or t
gtactgatcgctaggaggcccctgtatcagttgctgctgggtggagcagtggtgttgtgttcagctggaggatgaatcagtgtcagaggtgtacactacttctgcgtctctgcagcttcgcacgccagcgagtgccnatgtgcttgtaggcacgcaggatgccatcagcgctgcgaatccccgggttatcgacgacagcagagcccgcaagctctccacagatcttaagc

SEQ ID NO: 494170 - DNA, 367 bp, Homo sapiens
aactcatccattccaaaatatgcccggtgctatacgcacagctagctcctagaccaaacatttagtactattagaccagcttcatacacaggttccacgagtcatgtcaacacagcgtgtaagctaacacatcaacacaaacaatgggtccacgtcctgcagatgcagccgactgcagaataactacctgctgtccgcaccgttccacagtataaatatgctgcaggagttcgcaatcctcagcaacatcttaatgcacaagccacaagttacaatgcaacagcctgctgtccatgtacaaggtcaggaacctttgactgcttccatgttggcatctgcccctcctcaagagcaaaagcaaatgtag

SEQ ID NO: 494171 - DNA, 310 bp, Homo sapiens
ccttgggctttttttttgggaggggggggggggggggggccccccaaaggggccctttcccacgccccccccccccccggggggccccccaagggggggccccccctttttttttcccccccctttggtaattagggggggccaggggtggggggggggacaaaccccggggcggcccggggggggttttcccctttttccccccccccgccctttgggggttttgggggggggggccccctcccgggggggggggggggggacccccccgggggggttccccccttgggaaaacccctgggttgggcca

SEQ ID NO: 494172 - DNA, 166 bp, Homo sapiens
  misc_feature (14)..(14): n is a, c, g, or t
caggcagaagaaanaaaatatgtatggatatatataacaatagaaatgtattctctctgttctggtggccagacatctgaaatcaaggtgtcatcagggctgtgctccctccagagattcaaggggtgggtccttctgtgcttcctccagctcttggctcttaccg

SEQ ID NO: 494173 - DNA, 326 bp, Homo sapiens
gggtatggcaggaccccggagggaggaaaggaaaaaggtggagcgaagaaaggaaacggagacccagaaaggagaggagagggagggaaccagcacgacaagagcagcgagggaccaacgccggggacgaggaacaaagacagcgacaagaaaagagaccgcggagacaaaccgaaagaagggagaccgccggaaaaaacggcagaaccgcgacagaaggaaaccaacaccgagggaaaccaaaaaagcgaccatacgagaaacgaagcccagaacccaccagcaaaacgcacgggagagaagggccacgaacaagacgccgcggc

SEQ ID NO: 494174 - DNA, 287 bp, Homo sapiens
  misc_feature (53)..(53): n is a, c, g, or t
  misc_feature (57)..(57): n is a, c, g, or t
  misc_feature (61)..(61): n is a, c, g, or t
  misc_feature (73)..(73): n is a, c, g, or t
  misc_feature (98)..(98): n is a, c, g, or t
  misc_feature (110)..(110): n is a, c, g, or t
  misc_feature (138)..(138): n is a, c, g, or t
  misc_feature (157)..(157): n is a, c, g, or t
  misc_feature (208)..(208): n is a, c, g, or t
  misc_feature (246)..(246): n is a, c, g, or t
  misc_feature (286)..(286): n is a, c, g, or t
gaagtttcgctcttgttgcccaggatggaggtgcaatggcatgatctcaaaanaganaganagaaagacaganatagaatagacactgttctaaagangattcacaaatnaccagtaagcacatgacaatatactcanatgtcactaatcattaggnaaatccaaatcagaactacagtgagttacaagatactgccttacacccgtnagtgtggctactgaaaacaaacaaaccaacaacaaggncaaaacccagaaataacaagttttgacaacaatgtggggna

SEQ ID NO: 494175 - DNA, 117 bp, Homo sapiens
  misc_feature (2)..(2): n is a, c, g, or t
  misc_feature (93)..(93): n is a, c, g, or t
  misc_feature (99)..(99): n is a, c, g, or t
tncattgaaggattggttattctagacttctctgactggcgtgttttggctttaattagatatttttgcttagactttttaaataatttaccnttcttnttttccccagtagtttgc

SEQ ID NO: 494176 - DNA, 212 bp, Homo sapiens
tcccttcgactgtggactcagagtggaactacgtgtttacacgtacggcaggcagccttgtgtatggaggcacacacgtccaagtctatcaggaagaaggggcactgggagctgcacagacagcaagcagcatgctcgatagaccacgaggatctgagtctgaattggagattacttacgaacaatgactccatggggtgataccttcgaag

SEQ ID NO: 494177 - DNA, 95 bp, Homo sapiens
gagtatatccacaaatgttcacttctaaaacgatattctttgaaataattattatttgagtagagataaagctttggcctgcattatattctctc

SEQ ID NO: 494178 - DNA, 266 bp, Homo sapiens
acacctgactggattgaaatgcagtgcaatgcaatacggtggaatacaattgaatggcagtgcagtgcagtgcaatgaaatgcaatgtaattccgaacaaatggaattcaatggcagtgcagtgcagtgcaacggattgccaaggaatgggaaggaattggcaattgaatggcactgcggtggcaatgcagtgaagtggaatgccatgcaattgcgttgcgtgcagtgtaatgccatgccatggaatggaatggattcgaatggaa

SEQ ID NO: 494179 - DNA, 271 bp, Homo sapiens
  misc_feature (46)..(46): n is a, c, g, or t
cacgatcccgacggatatatgttgttatgaggcttttgatactatnatgctatagtaattacggctatggaatatgctttatatcgaattagagatgaagaggttgggaggacattgctatgttggagctggttatgcatgttcaggttttcatggtggtcatttcgtacattttagcagggttgccttttcgtgcaacttaaaattacattgctaatttcttctcaccactaatattcaattacgagttcatattgatattggagcttat

SEQ ID NO: 494180 - DNA, 404 bp, Homo sapiens
cagatcacctgaggtcaggagttcgagaccagcctggtcaacacagcgaaaccccatctctactaaaaatacaaaaaattagccgggcgtggtgatgcatacctgtaatcccagctactcgggaggctgaggtaggaggataaacttcagcccgaaaggtcgaggctgcagtgagccatgaccacaccactgcactccagcctaggagtcagagcaagacctggtctcaaataaataaataaataaataaaaagccagcagctttttatagaaacttggcaagctaattttaaaaatcatatggagccagacatggtagcgtgtttgtgtagttgcagctactcaggagactgaggtaggaggatcacttgagcccaaaagttggaggccagcctaggcaacat

SEQ ID NO: 494181 - DNA, 332 bp, Homo sapiens
ccacaggtggcagttctcatctgatggtgcagatattggctttggggttttcctgaagaccaagatgggggaacggcagcgggctggggagatgacagaggtgctgcctagccagcgctacaatgcccacatggtaccagaggatggaagcctcacctgcacagaagctggagtctgtaagtttgccctgggaggttggagccacctatcccatggtttagggacagaaacaggggtagtattcaggcacatacagcctaggtcagtgccattcatccatacagtcactcattcagtccacactctcaagtgcaccttcggtgccctaggag

SEQ ID NO: 494182 - DNA, 482 bp, Homo sapiens
  misc_feature (156)..(156): n is a, c, g, or t
  misc_feature (163)..(163): n is a, c, g, or t
tcctttcaaggtccccgtgatcaacatcccaacgaaccctccgggccgaccatgtggtttggtccctgttcaacaccctcttcttgaactggggctgtgtggggttcatagcattcgcccactccgtgaagtctagggacaggaaaatggttggcnacgtgcncggggcccaggcctatgcctccccccccaagggcctgaacatttgggccctgattttgggcatcctcatgacccttggattcatcctgttactgggattcggctctgtggccgtctcccctattttgtttccgataatacaggaaaaacgggggttttagtaaccgcccctagcctgccacctttgccctcccctgtgcaatgctggccctgcccgctgggggtgttgcccccgcccccttggtcctgcccctaaaaacagccgtttatacccccccccccgttttcagggtccttccataaagggcccgggcttgtga

SEQ ID NO: 494183 - DNA, 751 bp, Homo sapiens
gatgtgtgcacagctatttggacaatgactacccatattcattagtcgttgggcattttgtaaattatcttataattgagctaattgtaatctttaagcagtaatattacacaacaaaaaccgtgtataattattattaaactaataatgttgtctctctggctagatattaaactccttgagggcagggactgctctggacctgtatgtaatggggtgcccagtgcctgatactgtgcctaacacatacggtggaggtcaaaatatatgttgaataaatcaatgtatgagtttgtccatgagggcaataaaggggaaaacgtaaggggaaaagcatccagagaatagttcccactggtttaggctagacaagcaatgtaccaatgttttggttgccccagagtccctagtacggagctatttcctacatcattcaccatcctgagcacagagaccttctgaagtcttattccattgttgcctttaacagcaaagaaaaaagaaacttggaagccagctccctggatgtactgtatatcttttgaaaacaaaaagtggtctttggtcatttcagagaaattttaaattcatggtaatatgaaaaagaactcattgtttaagaaaaatattttggccaggcacagtgctcatgcctgtaattccagcactttgggagccaaggcatgaggaacatttgagaccaggggttcaacactagcctgggcaacatagtgagacccccacttctaca

SEQ ID NO: 494184 - DNA, 312 bp, Homo sapiens
  misc_feature (14)..(14): n is a, c, g, or t
  misc_feature (78)..(78): n is a, c, g, or t
  misc_feature (84)..(84): n is a, c, g, or t
  misc_feature (92)..(92): n is a, c, g, or t
  misc_feature (105)..(105): n is a, c, g, or t
  misc_feature (138)..(138): n is a, c, g, or t
  misc_feature (149)..(149): n is a, c, g, or t
  misc_feature (155)..(155): n is a, c, g, or t
  misc_feature (175)..(175): n is a, c, g, or t
  misc_feature (180)..(180): n is a, c, g, or t
  misc_feature (191)..(191): n is a, c, g, or t
  misc_feature (203)..(203): n is a, c, g, or t
  misc_feature (208)..(208): n is a, c, g, or t
  misc_feature (213)..(213): n is a, c, g, or t
  misc_feature (243)..(243): n is a, c, g, or t
  misc_feature (245)..(246): n is a, c, g, or t
  misc_feature (249)..(250): n is a, c, g, or t
  misc_feature (260)..(260): n is a, c, g, or t
  misc_feature (263)..(263): n is a, c, g, or t
  misc_feature (273)..(273): n is a, c, g, or t
  misc_feature (276)..(277): n is a, c, g, or t
  misc_feature (279)..(280): n is a, c, g, or t
  misc_feature (282)..(282): n is a, c, g, or t
  misc_feature (284)..(284): n is a, c, g, or t
  misc_feature (291)..(292): n is a, c, g, or t
tatacgtcattggntaacaggccctccggggatcgacaggtgtgcattgtttgcgtattgctatatttcccgcaaatngccatnttttctangacaaaaagtcantttgtggtttcgggtctaccacaggcctagctnctcggcggggngtatcnatgtcgatatctgcgtttgngactntgggggtgggngttgggttcggnggggngctangtgctgctccatctatgaatggctccgatntnnggnntgggaccccnttngactgccccnganngnncngnggccccnnggcccccaagttgctgctta

SEQ ID NO: 494185 - DNA, 122 bp, Homo sapiens
caagtgatctgtatgattctgtagatcaaaacagttataggtcaacttggtatctagcatttgggaggttaagcaggtgtactgcttgaggccaggagttcaagacagcccaagcaaatagt

SEQ ID NO: 494186 - DNA, 205 bp, Homo sapiens
accaggatgggccctcgaccctgcagccctgcatcgaccctcattgagaagcccagcaggcccccgggcattctggccctgctggaccgaggcgtgctggttccccaaaagccaccgacaagagcttcgtggagacggtgattgcaggagcaggccacctaccccaagttccagaagccaagccagctgaggacaagctgtttct

SEQ ID NO: 494187 - DNA, 1245 bp, Homo sapiens
catgccgcctggttttttgttagcaggtcccatctgtttttgtcctccttctttttaggctctccctgttgggcgcctgttgtcctccttgtgtggggagtgttctttagttgctctcgcgggtcccctcttaggggccccccttttgtctctccccgaggcccgcagccgatcttattaatcggacattgttggcccttctgttttcggtgattcccaggaggccctggggaggacagttttcttgtgtccaggttctgtgcacaattgttggccacgtgggaacgcccctgcgtgagtggctccggtgttttagtcccccccccgggatattttggtccccagagggcgcctgttcgttagaggtttttggcgttctgggcccccctggggggccccctcccccattttgcgtggccccgtgtttccacttctcttggggacacgtttcctctgttcccccggttctccaggccaacccgttccccgggatccccccgggcgtttttttggtggttatcgggacccccccggggcttgtccccccccagcccgtttttctcccggatggccctatcttgtaatggtgtcacccgtaccggcgcccatgtgccccgtggtgtacaccacccgcggtttcttccctcttgccgctttatatgtggcaccattgccccatatcccatgccacaccccccaagagggagcctccccctcgcagatgggtttttgaatgttggtggtatatcgtggcttcgcggaaaatttttgccccatagcctgcgcccccatttctcccgtggaacacccccataggggaggtccataccctgtatcttggtgacattcttcaccagaagtatcccctggaagaagatattgtataaaagagaagaacccaggcttgcctgctgagaaagcgcccggggaccccagggaggaatttccagggtgatatggactgctctccccgtccctgagttccacctgcgtacctccacccctgaggttcccagacatggtcctgacaggtgtcaccaggtgccctctgggcctattccagcctattccctgactgaagactggagccgctccagcctgcccccggaagactggtctcccagctccccctgctccaggcccctgaatgggttaggagcccacccctgactggttttaagctgtttttgcataggctcttaacccaccctgggaaaatggttgatggaaaataaacccccgttt

SEQ ID NO: 494188 - DNA, 716 bp, Homo sapiens
cccagatactcagcgatgttctgagagcaggagaatcgcttgaacccggaacgtggaggttgcattgagctgagattgagccattgcactccagcctgggcaacaagagcaaaactccatctcacaaaaaaaaaaacaaaaaaccgacagattgcctgaagaacatgggataaatatattaaaacaaaagaggattaacatgtgacatcacagatatatgcaccggacaatggggacgaaccccaggaaacacatatacaagaaacacttggagaaactggagcgaacacaagacgaatattccattcataccccccagtggaaccagagcaagagatcagagagaacacaaatcgcaacacgccgtgagagtagaaagactgcaattcgcgcccctatactcaacaaaaacatccagaaatcatcgagtgacagacacacatacagctaatcacaccctagaacatcacgccatgagcgagacggaccacccaagcgccacccacagatggaaatacaacaagaagataaacccactggagcgacaccaaagagaatacatgatgaaccacaaccacaaacacaaatgcagagagacactacaaactaggggagaaaaaataaccagaacaatacaacaagaaactgcaagcaaataagagagagaaagaggggaaaaccagacgggcaccaccgctacagatcattacaaacct

SEQ ID NO: 494189 - DNA, 106 bp, Homo sapiens
cccaggaacgttgtgatgtggctgaacaacccagcactgctgattttgctgctggcactcttcagtcgcacgcgcagaactaatcgtccccttccccctccgcctt

SEQ ID NO: 494190 - DNA, 105 bp, Homo sapiens
gttctcttcctcaaaagcttaggtataaatgctcagaacagttatttaaaaataatgcaaacaaataaaacaaaaaaacctgccagcagatcctgctgaaatact

SEQ ID NO: 494191 - DNA, 421 bp, Homo sapiens
ccttttttaggggaaaaccccgccttttttttaaaccataattttaaaaaattttgggccaagaaaagggggaaatatttggggaaaaatttttttccccttttttccaattggatttccccaatgggatggttccccttgggccataggaatagggtttaatggggggggacttgggttttttaggcccggttttggggggggggccaaaatgggccccttaggggtgtgtttattgttaaaaaccaaaaggggattttggggggtttttctggggcccctaaggggaaagatttttgctttggggggttcccaaaaaggggctcctttttttccggggtttggggaaaatttttgggaaaagttttccgggccttcccgggttttggcgggcccaaattaaattttttggcccccctta

SEQ ID NO: 494192 - DNA, 627 bp, Homo sapiens
agcgggtgtgccgggagcgcccataggggggaggaggtcttcggaggcatgctctgaggctggcagtgtcccgtaggccgcatggataggcgagacgagatggtggaggaggcgggtggaaggttatgacctgcaagaaagaatgcccgtagaataactactgccttcagtgtttcacctcagcgctcgtgcgaaaagtcaggcgttcagcgcagaaatgagttgggaaggacaccaataagggctacctggacgaatgacggattagcgcacggggttgctgcacagatcactcgtacatccgtccacagacagacttatgatggggaacatatatggttcaccggaggaagacaggaaccaggagcggagggggggaatggttctttcctatcgtttggatgggcaagctaatcgcactaaaggactggggggcgtgagtataccttgttcgggaattggaatgggcctttgacaatgggtgccccaaaaggggcaaggtattaacctaggctttaaccagaaaggaactggggggggaacagctttcttcccaagggggttgaccgttattggtaggaccgggatgagcttggaatcggggcccatgccccagggatatatgcc

SEQ ID NO: 494193 - DNA, 285 bp, Homo sapiens
gatcattcctgtattaaactttcacatgccaaaaggtttcgtgccgttttatctgccatccgtgtttgacctgtttagggcagaggcaataagtcagaagtcttcaagttgccatagttccatgtgtgtcattggactggcttataaacagctgtcttggactctcccttccttaacactgactggtcatcactatcattagcgaaaaagcaacaaattgttcgttatcatccctttacacagataagctgactggtgggcttcaaataataaaaacatacacat

SEQ ID NO: 494194 - DNA, 175 bp, Homo sapiens
gcacgagagaataggagctagggtctacagaagtggagcacattgtaactggatgacaacagtggcccagcaaaaccacagaaacttaatgagaaacttaatttgctccccttggtttaatgactttttaatatttaaagatgtttgctaaacctctaatcctcaaaacaaaaat

SEQ ID NO: 494195 - DNA, 421 bp, Homo sapiens
acattctcctaagacactatctcgtctgcatatactagactgcaatggctgttaatgctcctttactgacttaccttagtttgaggttaaagagtcatgctttagtctcgtagcatatctaaatatatatttcttaatgacgtctaatattcatgtacattgatatacacatatgctatgtcctcagttatagagataatccacactaccaagagactgctgatctggattcatgtatatcctcagcgtcaagcctaggaaagtagagtccatagtaggttgcaaacagctgttctccataatattaggtgtgttagagtagcttatatgtacctctgtatacataccccattcatgtctgtgtctctctttcatttaaaaccttgagtaaccctgtcatagtacagtgagtggtgtatgt

SEQ ID NO: 494196 - DNA, 126 bp, Homo sapiens
ccgcaatgacccacccaccccaaacaaaaccaaaaccaaacagaacaaaacaaaccccatctgaaaccaaacctttggatgatgaagtttaaagagtcaataaatagaaacaccagatgactgcaa

SEQ ID NO: 494197 - DNA, 772 bp, Homo sapiens
ggcgacgcggcggctgcggggactggtgcggcggtgctgagagtgttgctggcggcgtgctgcgtgcgcagccccgggcgtgcgggtgggaagatggactaccatgatgggtgcctgcgtggagacccatgggtcggacccatatgtgagtcctgtctgtcagtgacctccttgatcggtcttcttgcttgcggtttctcgtgtgaagtgaggagcttcggggtgttggctgtggctgcgcggactcctcttgggatccgatgatggatcccacccggtgatcgggaatggggttacaatgcagtgaggcggaaaggctctcgccggggcacagaaagatccccatgggccgcaaggcgtgctgtcgcctgcaaaggcactgacccacgagcccactgcctccctccttcctgggtggagcaggggccttgccttcatctccaaggcccgggggctccggcatctcgacgcggcttctggcgacacgggcaaaagagagacaggaggctagtccgagccggagccagtgtgaccacactgttggcacttgactgtccccaagagcacatgcagtgagcctgtgtctctgaggccgtagttgggcgacgacgagacggacagtgatgtccaggcctgcgcccgggggccactggagacctgacccatcaaagcggagtgaaacgccaaagctcacctgaaaaacctgctgagacaggggccttgtgcaacgaggtccagctactccatacttcgccaaggtctcaggggacct

SEQ ID NO: 494198 - DNA, 161 bp, Homo sapiens
tgagaagctgtctccattcgttggagatctgcgacgaggtggaggactcctcctacgataatcatctcgagggcgacgaccccaatgagtggaggtgggccacgcatttctacattctttgttgcacccattacgacagattccatctcgttacacgtgca

SEQ ID NO: 494199 - DNA, 575 bp, Homo sapiens
  misc_feature (334)..(334): n is a, c, g, or t
cttactaatcccacatacactttctcacctcacctctctccaccctctctcttcttcttattccatttcactcttatctcttcctctctctcttcaacaaatccaccttcttttccctatactacttccctttttcctctttctccctctctactcctctcttatatatttatttctttctttctcataatcctaattcttttcctttctatcttccctaattacctcttttttctctttttctttttttcccctcctccctcttatctctttcttccctctctttcttcactcttctttctctctatttctctcctatcctcccactttcttntttcacattactacctttcttccctctcatttatttttccttaaaacccattctcccaacctctcatccttatattttcatattcctatctcttccttctctttatatacatatctcttccctcccatctcttttctatttttcttttattttttcttatcatctctcctaccatttatcactcttcacttcttcttcatccctctctcctattcctcctatattctcttctcctatttcg

SEQ ID NO: 494200 - DNA, 911 bp, Homo sapiens
  misc_feature (317)..(317): n is a, c, g, or t
tggttccaaggtttaaatcaagccttgttttttaaaattactttatccctgcttcttctcaaggggttctccctttgttttggcccttttctcctttttcctacttgggcagagattgggcttcccggtccgaggactcttttggcgggcttggctccagtttacgccatagtgatacccacctttgctggggtgaatgcctacgtggacagttgtggtcgccattatagcctttttccccgctgtgaaccccgtttcaagtgtctagataacaaatattttcttcccgtgtataaaccgtggacatacttgttgcnccaatttgtgcgtgaaccttatagtagtgtgctccaggttaacaaaccgtgaactctcatcatctccttatctcgagagtggcgcatgtggactccggcccgttgtgatacccttcagtgctcactacaggctctcttgtggggacaacagatgggagaagcgacatataaacgtcttctcctcttcagaatgtggtggagaaagggcgtcgcatttgtgaacagcgtccccttttgggagagactttttctggagcattagcgagatcgccggaagattcacaccaaaggggggtatcaaaaaaatctccaccatattggaggccgcgatctcccgcgtctttttcgatgtaggggcgagacgtgatgacacgagaagatatattgtctcccccaccacagagtgggggagagcgcacccacctatataggagataacactctggccgagcaaaggaaaacgcgcccgagcctcagggacaacgccaatattttcgcgcaaaacaagggggggactcaccagggctctcccaaaaggggccccgggaaaaacttggggcaacgaacccaatcggtaagaggtgggacaaaaag

SEQ ID NO: 494201 - DNA, 117 bp, Homo sapiens
cttttttccctttcccccttccctctccctctccttctacctctttttgagacagtctcactgagattgcaccactgcactacaccctgggtgacagagcgagactttgtctcacca

SEQ ID NO: 494202 - DNA, 490 bp, Homo sapiens
ttgggggtccaggggtgaaaagcttggtgaaggattttaaggacttcccattggctgaaggctggcaaatggagtttgccatcctctgactacagccattctgaggactggaaaggataccctgagaagtggcctattttatttctgctggaagctggatgcttcctgccctcgaaaatcagactccaagttcttcaactctgggactcggacctttgaacacagactgaaggctgcactgtcggcttccttacttttgaggctttgggacttggactgacttcctggatcctcagcttgcagatggcctattgtgggacctcaccttgtgatcacgtgagtcagtgctccttaacaaactcccctttgtatatacatctatcctactacttctgtcactctagagaaccttgacgaatacggttatgcatttttattaatgtaaattatgccttaattaccaataaataccttctcaacctccaaaaaa

SEQ ID NO: 494203 - DNA, 398 bp, Homo sapiens
ccggaagattggactctacaaaacatgtatggtgtcaatcaaaaagatgctatcttagtcagaagtcttgagcaaagtatgttctaacacaaacaaaaattaattctctgtatttcaaacaactcaaataagtttcctgtccccactgaatagctcatgaatttcattctaatgttcaatcaggtgtctttagcaatagttctcgtgtgtaaggttgtaaaaaatgtcacaaggaacatgctattaatgtaagtactcaaagttataactgattttaaaacgtttttacatacattaaaggtatccaagttgtatttccctagacaatcatcactttaatttgaattagaaaacacattcaagtgggggaaaaaatgagggggagtagtaaaacctag

SEQ ID NO: 494204 - DNA, 848 bp, Homo sapiens
  misc_feature (736)..(736): n is a, c, g, or t
  misc_feature (779)..(779): n is a, c, g, or t
  misc_feature (784)..(784): n is a, c, g, or t
gggcagagaaggcccggaggggctctgcgtctgtagtggcgctgcttgggcccgtggcggattgtaagctgctggttttgcggctgggaagagcggcgagagggttcggcatttttcgtcgggatccccgcgaaggatgagtgctgccatgagagtctcacccgcatggggtgaagcgttcagccttcctccagatgacgatctgggatctagcaattgggaggcagcgagacttgggtaatgaagagagaaaacgaaaagttcttgagacttatgggtgcaggaaatgaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaagcattattaacatgatgttggtaaatccagtggttcataactcccaaagctagtcttgtattaaagtaagccttgtgtacatgncgggggacggttttaggccgaccttgtttttattttaaaggcnttaanattaaaggtggggtcaagggggggacttgggggtataaattgggaaggttcacaaattgagtta

SEQ ID NO: 494205 - DNA, 415 bp, Homo sapiens
aaagaaccattcactgatcaagatactcagaacatgaacaggaaggtgaacaagtgatgaaatgcaaagggagcatcattgtgagatggctccaggaacaggacggacaaggtgcggccttaggactcaggccgactggggcagatgcttacacaccatccagactgaagaccgagtctggtccaatgctatcagcccattacatcagctctttagtgacagggacggcttgatgcgggcacttctcacccctgagaatctgggacctcaacagtgggcagctgatgacacacttgggcagtgcctttcccccaggggctggggtgctggatgtcatgtatgagtcccctttcacactgctgtcctgtggctatgacacctatgttcgctactgggacctccgcaccagcgtccg

SEQ ID NO: 494206 - DNA, 837 bp, Homo sapiens
gcacctttctggtaatcctggatctccagtggcactacctctaagagatgaagcagcgggtctcagaacatcccctgaggcccctgcgagagaacctttgagaaggacaacccctcagctaaggagccagtggtcccagagtaggtcacctgtgggccaataagcacaagggctggagtccggtcagggcctgcgcaagaccttccatcgttgcctgagcggctcttcagaattcataagagggtccagcactgtggaagtaaacaatctcgggtaccctcagacacatgtatgttttatcgaggagaaaaaaccaaaggaggtgatgggaggcttttcaagacgcgtgctccaaactcatcaactcctcccagctgctttaccaggagatatagtgagtgttgtgcctgaataaggagatccagagccagcagcggctggagagcctgtccgagacacccgggacctagctctccagctggcagcctcgcgaaggccctggtctcctccgttagtcgtacctgctgcggactctccatggacctccagcggcatcccgtctggcaggaaaatcacccgtggctgcgcaatgaggcaccgtgcttgctctccatgtacccgatgaagaccaagaacctgcaagaggtcatctctagagctgattgtggtcagaaggcctcctacatgcgcagtctaagcattgctgggatcatttccaacttttcaactttcctccggcccactttccaccagggcaccatggtttttctgtttcagggttttcgaagttggccagtccttccacctgggagacttgggcctttctcgagtgtgggg

SEQ ID NO: 494207 - DNA, 954 bp, Homo sapiens
  misc_feature (191)..(191): n is a, c, g, or t
  misc_feature (724)..(724): n is a, c, g, or t
  misc_feature (861)..(861): n is a, c, g, or t
actgaatgtatatgtttattagtgtagcgtttgactatgaagtttgtcctattctatagtatcttatacttaggagtcgtgaatagctattcagtgagacatgactcgtctgcttgtgtcatacttggtttttatactccagttgagctgtggctactaatacactatcacgaccacgttgatacacatgnatagaagctgcagatgggtcgtcgtgcgaagaagtctatacaagtgcgtccatttctcagtgtgtgtatgcacatgagagtggttcagtcgtaccctacttaattagcattgataatacatattacacgagcaattattatcatatcttgggatattttatgccaatggatattttaatacactcttgatgtcacctcacattttagactataagaatattatttgattcgtaatacctcacttctatgactcctcactttacacggtgctagcatcacataattcagcttagacatatgagcagtcccagtgcacaaatgtgcacatttcttgatgatgagtatttatttcggcagacgcagtaccgataacaatggatcacacgcacgagatagagtgtagattgatcatataatccatgtaatcattcgtctcataataatccacaccaagtgatgaccaaaccagcatagagaatcatgagacaattcattcatcaacgagacgaatggactagtatatccctgtaaantcacaatcgctacgagtagatctagtatgaactttagcaattgtccataattggctcgggctgcgatatcaggccagaagtctactacataatggtgcgaataccattaattacatgtataccattacagccgtaanttgagtttttagacaataaatagtccgcaagcttttccgcgcgaactcgataggcataattgtgtacacctgtctgggtctgcctagatttcc

SEQ ID NO: 494208 - DNA, 811 bp, Homo sapiens
  misc_feature (729)..(729): n is a, c, g, or t
gggcagagaaggcccggaggggctctgcgtctgtagtggcgctgcttgggcccgtggcggattgtaagctgctggttttgcggctgggaagagcggcgagagggttcggcatttttcgtcgggatccccgcgaaggatgagtgctgccatgagagtctcacccgcatggggtgaagcgttcagccttcctccagatgacgatctgggatctagcaattgggaggcagcgagacttgggtaatgaagagagaaaacgaaaagttcttgagacttatgggtgcaggaaatgaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaagcattattaacatgatgttggtaaatccagtggttcataactcccaaagctagtcttgtattaaagtaagccttatngtcacaatgcacagtggaggactgcttatagagcacagaccttagtattataatcttcaaaaaggcccttttaaataattac

SEQ ID NO: 494209 - DNA, 100 bp, Homo sapiens
cccttcctttgttcctggtgcacagcgtctgtgagcgcacagccagactctcccgttcacacagggtcatcctcaagatcgtcaatgtttatcagctcga

SEQ ID NO: 494210 - DNA, 1833 bp, Homo sapiens
  misc_feature (775)..(775): n is a, c, g, or t
  misc_feature (1418)..(1418): n is a, c, g, or t
ttgcgtggatcaatgcattgtgtgttttgctatgtccttgcgtattgctcgacgtgtgtctgcgcgtgtcgtcgtcgctcgtcccgtctcgggcgttcttcacttgcgtattatcctgccgatatcgttatcttctccgatctgctgctggtgggctgcgactctgtggtgtcctaagatatttcttggtggcccctttggggccctttcttccggggtctctacagatcggcgttgtctcttctgcgttggtgcccgtctgtgggtgacatgttatgcccgcgaccttttctgtggtcaccccacctggttgggcccgttgttttactccccgcgcctcccccttttgggggacccgcccccagagttgtgttgctcaaccacagggtgtttttcctgtgggtcctcgggacagacctgtgtccgccctctttcgcccctctgtattgccccgcgcccacgttcttttggggggcgcgcacacccaggcttggggggtgggtgtctcacaccccgccggtgggtctactatgcgtgcatttttggggtacacccccctcccgcggggacccaccacaatgtggggctattaatacccccccgcacgttttttgtcgtcgtgctgtaatttatccggccagtctttgctctgtctcggcccccacgctttgttgtggttggtggcgcacccaacccacgccgcgctgtttatggtgcccccccaccctccttcttttttgagcagagtgggttcgtttgggccccaccgcggagntgaatttatcgttctgtcgtgcgcgaagtgcctcccccacgagggagggagttgggatagaggctgggtccccctcacgggttatcccccctccccggggttgtccgtgttatacccccccctcggggcccactctcttctcgttcttctcctgggtgggaggacagcaccgcgatgatgggaagccatacacaaaataatcctctgtcgtgtcctctcccacacaccaaataataaaaaaacaattttttctatcttaaaatatgtcttttaataataggaatatatacatatccaataactcctctcatccccccctcatatgcgcttatctctctcgtgtatagatgtgttggtctatcaaggtgttgtatagaagaacacttctatcttattttataaccacacccactctctttttgtgaaactctctgtttcttatgaatatgaatgcacaccctgatggtgcgtttgtacagacacacacacacactctgttcactatgacactcgtgttctacacacacaaaaatatattgttcccccctataaatgtcccctctcatatattatataaatatagagactcgtctgtatatatctatatctttaaattattgtgaattttgtataaaacattctntctgtgcgccacaacacctccacagactccctaccaccacacttttgccctcatagggccctcatatgcccagcagcggtgtcacagcgagtctcacacaagacacatcctctctgccacgcgcggacacacagcgagagatttttctacatctccctctatttattctcttggggacccaccactacacatagagacatagatatattgtcgtagcacctcggtccgcgcaaccctcgggtaccaccgagactatagatatcagattctgcgctccacatatcctgcctccatcctgggccacatattgttgtaaactttgacacctggactattttggtgatacatttttttccacaaaaaaaagatttttttggggagagaaaataaacaaataaaaaataaaataaaataa

SEQ ID NO: 494211 - DNA, 519 bp, Homo sapiens
  misc_feature (260)..(260): n is a, c, g, or t
  misc_feature (365)..(365): n is a, c, g, or t
  misc_feature (379)..(379): n is a, c, g, or t
  misc_feature (405)..(406): n is a, c, g, or t
  misc_feature (431)..(431): n is a, c, g, or t
  misc_feature (500)..(500): n is a, c, g, or t
gggcagagaaggcccggaggggctctgcgtctgtagtggcgctgcttgggcccgtggcggattgtaagctgctggttttgcggctgggaagagcggcgagagggttcggcatttttcgtcgggatccccgcgaaggatgagtgctgccatgagagtctcacccgcatggggtgaagcgttcagcctccccagacgacgatgtaaatatatggcgatggctgaggttgaggctactgcctggagtagccggaaggtggttngagaggacgcgcctgagtggcctgcacgggagagcccaggaagaaaccagaagaatgagtggaaatgcctcccttaatctttatgaaggtcagaagtttgaagangcccacacgctganagccggagaactgcgtaagaaggggnntgaagaaggaaattctgaaaggtcnaggagtggagcttagtcaagggattctacgtcctttttggggggccattgctttctcgggctttgtacnccattatagagacggcgct

SEQ ID NO: 494212 - DNA, 282 bp, Homo sapiens
ccctgaacatccgtgtcacaaaacattagctggacatggtggtgcatgcatgtggtcccgactactcaggcggctgaggcaggaagatatcttgagcccacgaggtcaaggctgcagtgagccatgatcatgctactgtactccagcctgggcaacagaacaagaccctatctcaaaataaaaaaaggaagcgagaatgcagagtttcctctgtgatatcaagcacttcagggtggtagatgctgccatggtcgaacacctgctggaggacacgaatgtcca

SEQ ID NO: 494213 - DNA, 164 bp, Homo sapiens
tccagcactaagccccgtctgacgtgagaggatcccattcaggccaggaattcgagactggactgagcaacattgggagacctcgtctctactacaaaatcacaaataagaaaaattaacggcatggtggtgcgtgcctatagtcccaactactcaggaggcag

SEQ ID NO: 494214 - DNA, 731 bp, Homo sapiens
  misc_feature (22)..(22): n is a, c, g, or t
gggaaaagaccaatggagggtnacctacccttgagcagctttaatgggaagaataagctagagatgtttttctgtaactgctaaagcttgttatttattcctcctccaatccccaaatccacgacctttgaaaacaggaggtgtgtctgaaaaaacaaggcaaaaatgaccttaatcctgacaaggttgtaaggacatattatcaccctagggaacagtgtggcacttttagaaactgctgagggagatttacgtaaacttgtgattaggctgagagcctttcaaagcagggagtacatagtaggcactcagttaatgcagaataaacaggaagtggtgaggagccaactctttgctgacttgccattgttgctgggccgtgtcacttgctcctgaagtggctgcaagggttctgcctccactgaagcacacaagtgcccattctgtggagggaaagccaaaagccctttcctttggctttgcccatgtggcttcagggcttgaaatcctaagggatccagagtggcagtgcagtccagggtgtgctgggtcggcagtgaagatgaggaagaggatggagaagggggatggagagaggatagttcctggtagggcacacactttcactgccccccaaaaggcactgcaagcctgggtgggaggcttctgggggaaacggctggatggtggacagccctcctacatcctggtgtccagtggttcctcagtgt

SEQ ID NO: 494215 - DNA, 271 bp, Homo sapiens
  misc_feature (110)..(110): n is a, c, g, or t
  misc_feature (189)..(189): n is a, c, g, or t
  misc_feature (207)..(207): n is a, c, g, or t
  misc_feature (235)..(235): n is a, c, g, or t
ttgggcatggggtctgtaggggtgggcagcatcccggtggacgggctagcacctcctccatacagacagcaggctcttggggcggggaccagtgggggacacctgccacnccccgcccccccttcacacacacactgtaaacatcatggtgggccgcagcgctcagacggaacagaaaccctgtacacnccaaccccatgctcagcntaaaagtaaacatgggggcacacaccancccggcttccaggcctacatgaccccattgccgccg

SEQ ID NO: 494216 - DNA, 341 bp, Homo sapiens
cacgccggtatgtctagagtgcaagtgttataaaaaatagacaaaaccaccatcacaaaaaaaaaaattggcagcgaagagaaatgaagaaaaacggaagaaaaaaaaaaaaacgggaaaaaaggacccatcaaatttcccaccacacataaccgaggggggcattggcccggccgggttattggcggacaattcaaaacaagaggcttaagaacaaaccggaggggggagggggaccctcaaaagtcgcccggcgggcttgcaggcggggccggggcggccgtttaacaccgcggacagaggcaacgagcacacgcagcgagagagaccagagaatctag

SEQ ID NO: 494217 - DNA, 444 bp, Homo sapiens
agtgtctctggctgtggacaagagtacgggaaaagagaagaagatgactatcagtaagtgacaagggccgaagagcaaggaagacatggaaggtatggtccaggaaactgaaaagtacaaagctgacgatgagaagcagagggacacaggtgctcatccaggacatcactgtgcatctcctatgccttcaccagtgcaaagcgactgtggaaaatgagacaccttcgaggcaagcatcaacgatgaggacaaacaagaagcatctggaccagtgtaatgaaattatcaactggctagataagacatccagcactgctgagaaggaagaatttgaaacatcaacagaaagagctggcagagagttagcaaccccatcatcaccaagctgtaccagagtgcaggaggcatggcaggaggaatgcccgggggtaggaggtgggtacc

SEQ ID NO: 494218 - DNA, 181 bp, Homo sapiens
gggggtgaataggtgctgttccctctcttatgagcggaacgttgatctgtaagccacacctgctgtcatgggtgtaactacctcattcatgacctcccagaaatctgtctgatgagctagacttatgttgatgaaacgatgtacctgtcaggaattacaaaggaattagattcatgtgtta

SEQ ID NO: 494219 - DNA, 465 bp, Homo sapiens
  misc_feature (5)..(5): n is a, c, g, or t
  misc_feature (32)..(32): n is a, c, g, or t
  misc_feature (49)..(49): n is a, c, g, or t
  misc_feature (127)..(127): n is a, c, g, or t
  misc_feature (187)..(187): n is a, c, g, or t
  misc_feature (192)..(192): n is a, c, g, or t
  misc_feature (455)..(455): n is a, c, g, or t
tccgnccctaaccttattacacatttcccgcnaccaaaccccggactcncctacttactgaggagtcccagggtcctttaaagtggggaaaatggccatttagaaacccccggttaaatccatgagntccctattgatagttcccaattcaaatttaacattaaaaaatttccttaggcctgggaancaaantgttacgcctgtaatcccagcactttgggaggcccaaggtgggtagatcgcttgagctcaagagtttgagagcagccctgggaaacatagcaaaacctaatttctacaaaaaatacaaaaaattagttgggtgtggtggtgcacacctgtagtcccacctatgtgggagtttgaggtaggaggattgcttgagcccatgaggtctaggctgcagtgagtcgagatggcaccactgcactccagccttggtgacagaatgagantccatgtctc

SEQ ID NO: 494220 - DNA, 111 bp, Homo sapiens
attcgcggccgcgtcgacttttttttttctaacgcttaatacacttgatttttcttggataaaaacccaatgctgtggccacagctggagcctgagtccgttgcacggaaa

SEQ ID NO: 494221 - DNA, 400 bp, Homo sapiens
  misc_feature (336)..(336): n is a, c, g, or t
  misc_feature (344)..(344): n is a, c, g, or t
  misc_feature (375)..(375): n is a, c, g, or t
ctgcctcagcctcccgagtagctgggactacaggtgcccgccacaacgcccagctaatttttgtatttttagtagagacggggtttcaccgtgttagccagaatggtttcgatctcctgacctcgtgatccgccccgcctcagcctcccaaaggcatgagcaccgtactcggcctgcccaggctggtcttaaactcctgggcctcaggtgatcctactgcctcagcctcctgagtagctgggattacagacacagcccccgttcccagcttctagcatttcttaaggacaaaattggtgtgtaagtaacagggaaatttcacattatggctgttantcattctnttattattcacaggccatgtttaggaacaanttggggtttttcaaaacaaggcgtt

SEQ ID NO: 494222 - DNA, 240 bp, Homo sapiens
gtacctggcacggggtataaggatacattcctcctcatatccaggtagtgactgtaatcaagtttgactatcaggataaagctcatagagatatcatgattgactgcaacatatgtgccatggacattaatgttacacaaccatactagtatccttcttcctgaagagcaacagctcctgctccttggaggttgttgggaactgctttacctttggtacctacttcaacccccatatacg

SEQ ID NO: 494223 - DNA, 487 bp, Homo sapiens
tccagataaatatggaatagatagttactagttatgcacttagcaactccctaccagcacatctgggtaaatacagattactttaagtgctgttccttagtacttgtttatcattttgtttaaaaaaattctcaaggagtggggaagcttacattatagactccctggaaagtcttcctggtctgcatcggcactccgttatttgagggtaccatttctaggtagccattgaaggtagtgctccgtgagtcatcctttgagccttctcatgcctacagcagcgctaaggcagcaccttccagaaattctctaaagggttctgtcagattctagtgttggtcctaagactaatttgaactggtgcttctttagaactcagagtttacagagtattattggaaattggaaggaactagacgccgcagtctggagacacttactggctgtgaagtgtctttcagtgatgtggtgttcctgttaaccacaa

SEQ ID NO: 494224 - DNA, 460 bp, Homo sapiens
  misc_feature (8)..(8): n is a, c, g, or t
  misc_feature (103)..(103): n is a, c, g, or t
  misc_feature (119)..(119): n is a, c, g, or t
  misc_feature (143)..(144): n is a, c, g, or t
  misc_feature (146)..(146): n is a, c, g, or t
  misc_feature (237)..(237): n is a, c, g, or t
  misc_feature (264)..(264): n is a, c, g, or t
  misc_feature (269)..(269): n is a, c, g, or t
  misc_feature (301)..(301): n is a, c, g, or t
  misc_feature (305)..(305): n is a, c, g, or t
  misc_feature (330)..(330): n is a, c, g, or t
  misc_feature (341)..(341): n is a, c, g, or t
  misc_feature (378)..(378): n is a, c, g, or t
  misc_feature (395)..(395): n is a, c, g, or t
  misc_feature (397)..(397): n is a, c, g, or t
  misc_feature (405)..(405): n is a, c, g, or t
atataagnttagcaagagcacctttcaaagtcacagttccaatggtttttgtaaggtcaaccagaggcagagaacacaatcatggtggcttagcgtcaaaatnatgacaagttgtcaanctaatgttttttgttaaatataannancacccactctgcttctgtcctgtgaggaatggggggaagtagggagtcaagatttgatattaatgtagatcgcatgtgacacttgcgtggncagcagacaagggtccccacccatgcncaggnttggacaaaatggtggctatgttttttgtgcnaaanctcctcatctttgctatgtttagcntagatcttgangtgtctgatcctcccgggacatggaggaaccactggntcagcagcagcaccaanantaggttgnaccaatgtgcgtgtttttggggggtgcgaaaattttcctgagggtgaccccaatg

SEQ ID NO: 494225 - DNA, 220 bp, Homo sapiens
acacagaaaaccatggaacctgagtcatgtattatgcttccccatgtagacttgcagctgtctattaactctaccttttatcttcaaagatcaaggaaacatttattatgattacaaattcctgaactcacatctagtactcaagtcaaaccaatataactaggtatctaaatcaactgaactgacatgacatgcactcggaaaaatcaccctatatatc

SEQ ID NO: 494226 - DNA, 273 bp, Homo sapiens
  misc_feature (38)..(38): n is a, c, g, or t
cggtatctacaggactcctgctgctcctcttcactgcnatatttattgagcattgtatgctaggttaggcatgtggagtaggtgttcttgcctttggggagttgacattatgaaaggaattcttatgccatgtggactctgagccagtcccatggggaggcccaggctcacagaagctcgcaggagtgggtctgcacttctaggaaaagcacaagtaggggctgagagcccagcaggaaagcaggttggttttgagtttacagtgtaatttgg

SEQ ID NO: 494227 - DNA, 1071 bp, Homo sapiens
aaacaccaaatggcggatgacgcctggtgcagcggggtgggcccggggcctggtggccctgggatggggaaccgcggtggcttccgctggaggtttcggcagatggcatcctgtgggcctggggtcgctggcctgtgtgacctgtgtgtgccggtgtgcctgagtgcctgcggagctcgctgagagtgcaatggcctgaggatacggacgtggatgcccgtcaccaaagttgggccgcttggtcacaggaccatgaagatcaatgtccctgagaggagatctatctcttctccctgcccattaaggaatcagagatcattgatttcttcctgggggccatctctcaaggatgaggtttgaggattcatgccagttgcagaagcagaccctgttgccggccagcgcaccaggttcaaggcatttgtatgctatcaggggacttacaatgggccacgtcggtctagggtgttaccgtgctccatttgagtgtggaccaccgtcatcctgtggttggcatcatcctggccaagctctcacatcgtcccctgttgcgcaagagggctaactggggggaacaaagatcggcgaagcagcgcagaagtgtccctctgacaaggttgaccattgccggattgtgggctctgtgctgggtacgccctcatcccttgaagcaccagggtgacaactggccattcgggtcttcctgcacccgttgtttgccgtaagcggaatgcatggctccattgattgtgcatgggtagttcggatcggccgttgctttacaaccttcccaggcgccgtgggcgtggaaccttggcacaccccttggggcgagttttcggcacgagggtccaggcttttgtgaattgctcgcattttcttcaaggcaacccttagcagggcgttaaccttgtagccccccggagcccttcttggaaacgggacgaacttggtaattatccccaaggagttttgccgctactccgagtggagttacacgtggaaccacgtgtacggtacgaagaaccccgagacccaagaagtattccgggtgaagaggcgacattcaag

SEQ ID NO: 494228 - DNA, 493 bp, Homo sapiens
tctagctcggtaccccacaccacctgagtcagggggaagacctgacatatcactaagggtagaagactttagagttttagtgtgtaatgaaatcaatctaagcgaaccttgtgatgttgctgccagaaatatggaccatctctatagaaatatgctatgtttcaagaatgaaaatccactttggttaagtggtgaatccacttttgagaattcttttttttctaatatgagaagaatagagttggtcacttagaagaggatgacctgcatggaaaggtatctccaagcttgtgaaaaacaggcaaaggaaccataacgtttagcctggagaagaaatgatgcatcagggttccttttcaaataattgactagggttagagttgttctctgtgaccgaaaggggatgagaataggattgatgggtaaaaaatacagggagattcattttggctcactgtcatctaaaaagagaacaggctgacatggaaagagt

SEQ ID NO: 494229 - DNA, 294 bp, Homo sapiens
tttttttccctttttccccccccaaatttgggggggttaaagggcccccccccccaccgtttttggggtttggccggggcccccttcccggtttttaaaaacaaaattggggcttttccccccccggttttttttttaaaccgggcccccttttttttcccggggggggggggtttaacccggggaccaaacccccgggggcccccccggtttttttttccccccccaccccccggggggggggcccgtttttttttcctccccccccaggtaaattaattttttttttgggga

SEQ ID NO: 494230 - DNA, 183 bp, Homo sapiens
caaaggacgtccatactcagctgacactgcatgtgggcacttactgtgctcatgcccacacacacttgcacaacatgcagaaggccagcacagttggatccactctcactagagaagacagtcgagaatacgctggaaaacctgacgatgagcagctacacgatctgcctctatacaaagact

SEQ ID NO: 494231 - DNA, 409 bp, Homo sapiens
  misc_feature (173)..(173): n is a, c, g, or t
  misc_feature (178)..(178): n is a, c, g, or t
  misc_feature (182)..(182): n is a, c, g, or t
  misc_feature (196)..(196): n is a, c, g, or t
  misc_feature (201)..(201): n is a, c, g, or t
  misc_feature (207)..(207): n is a, c, g, or t
  misc_feature (222)..(222): n is a, c, g, or t
  misc_feature (264)..(264): n is a, c, g, or t
  misc_feature (270)..(270): n is a, c, g, or t
  misc_feature (279)..(279): n is a, c, g, or t
aggtggtggtggtggtggtgatttggggtagttatttgttaactatggaccagtgaacgtagtttacgatcttgaaatgaaacttagatttttctggggaaatgttcagatcagttttgtgaactgtaaatcaaaaaccttttctacgtttatttttatttctgcaaattagnaacanattnatgttttcactatnatttnggattnaactcttccatggtntatgagccaatataagaaaaaaatattttttgttccattgtnattttnaacaattgnaacttttaccaatgattgaacatgtttttattacagtatttaacattcccccaaagaataccctgcaaagtgtaaactttgtcccatatgtgatatactgttctgctacaataaagatcaaacctaaaaa

SEQ ID NO: 494232 - DNA, 338 bp, Homo sapiens
gggatattgggagcacttccatctcataggtggattcaaagatatcatagagtggttgaaagagttcatctaatgacctgtaatccaacacaagggagtttctagggtttcagaaacagggttttggcagccaaggttgcatcatgcagatgaagcctccaggtcagccaggcttcagagagaatagcatggtacatttgtcccatagtcagacttacaaggtgcccacactcttcagtaaaatctctctgggtcaggacagcagcacttcaaaaaggaatctctaacagacattcagcataatatcccacaaagaaccagctttgcaagcaggccat

SEQ ID NO: 494233 - DNA, 250 bp, Homo sapiens
tgaatcgagctcggtacgtgctagcggcattaagtgaacgcccctttgctcacaaagcaacgcttgcctttttctcacctagccgcctagtctccagagggcaaagagggtctgggttgcctcgggctccctgggccctgctcctttgctcgtggtttcctgagcttgaaacccactccgaacgggttctccttcgtggagaagcaggagttggcaggaaaatgccttcgttcacttaatgccgctagcg

SEQ ID NO: 494234 - DNA, 223 bp, Homo sapiens
tctgatacttggactattcgacaggtctatggccaaaaggtgtgttatgcacgaactcattcagtcaactatacagacgttcattctccctgcatttggcaggggtatacccaggatattatctaacgtatctaacaggtgtgttcatgacattagcagcacgagctatgagacatacctttagacattattacattgaaccggatagcttgccgggtaaggc

SEQ ID NO: 494235 - DNA, 328 bp, Homo sapiens
tttttttttttgagacagagtcttgcgctgtcaccgacaaagtgaattttaaggcacaggtattagtagagaaaatgaaaaaacaatcaatgactcggaaatttaagagaattttaaatttttatccacataattacatagcctcagaatatacaaagaaaaaatgacaaaacggccgggcatggtagctcacacctgtaatcccagcactttgggaagccgaggtgagtggatcacctgaggtcaggagttcgagaccaggagaccagtctgaccaacatggtgaaaccccgtctcacgaaatacaaaaaaattagctgtgcagtcg

SEQ ID NO: 494236 - DNA, 134 bp, Homo sapiens
aggtcagaccttcacctcccctaaccccaaacatagtccacttttaggaggagcaaatgtaggtcatgtttttgttggacttcttgttttttgtgacttcatgtgttccattgtccccgctgccatggaacaca

SEQ ID NO: 494237 - DNA, 150 bp, Homo sapiens
cttgaggatcccggatggttgtgacgcctgggacagctaccaagcttcttggttcaaagaagctcttgaggtgccgatctgccagacaccgatggcacgagatgagggtctgcagaatggaccaccacagcacccgcttggttggtgctc

SEQ ID NO: 494238 - DNA, 217 bp, Homo sapiens
aaaaaaaaacaaacaaaaaaaaaaaaagcaaaaaaaaaaaaaaaaaaaaacaaaaacagggaatagaaagatacctgatgacccaccctgctatcacaatggaaagacaatagcaccatagccgcgccagggcaatccaacacgaattccccctctggctgagaacacaagcccgctcgatcaaccaaataaaaatcacaaagcctagaaatagaca

SEQ ID NO: 494239 - DNA, 103 bp, Homo sapiens
ccgattatatagtggcagtgagcactgaaaacccagttttggccaggtccagtggctcacacctgcaatctctacatgtctggtaagccgaccagcctcagga

SEQ ID NO: 494240 - DNA, 808 bp, Homo sapiens
  misc_feature (144)..(144): n is a, c, g, or t
  misc_feature (217)..(217): n is a, c, g, or t
  misc_feature (249)..(249): n is a, c, g, or t
  misc_feature (268)..(268): n is a, c, g, or t
  misc_feature (299)..(299): n is a, c, g, or t
  misc_feature (316)..(316): n is a, c, g, or t
  misc_feature (338)..(338): n is a, c, g, or t
  misc_feature (355)..(355): n is a, c, g, or t
  misc_feature (360)..(360): n is a, c, g, or t
  misc_feature (377)..(377): n is a, c, g, or t
  misc_feature (383)..(383): n is a, c, g, or t
  misc_feature (395)..(395): n is a, c, g, or t
  misc_feature (402)..(402): n is a, c, g, or t
  misc_feature (438)..(438): n is a, c, g, or t
  misc_feature (536)..(536): n is a, c, g, or t
  misc_feature (538)..(538): n is a, c, g, or t
  misc_feature (544)..(544): n is a, c, g, or t
  misc_feature (569)..(569): n is a, c, g, or t
  misc_feature (581)..(581): n is a, c, g, or t
  misc_feature (583)..(583): n is a, c, g, or t
  misc_feature (585)..(585): n is a, c, g, or t
  misc_feature (587)..(587): n is a, c, g, or t
  misc_feature (589)..(589): n is a, c, g, or t
  misc_feature (604)..(604): n is a, c, g, or t
  misc_feature (606)..(606): n is a, c, g, or t
  misc_feature (630)..(630): n is a, c, g, or t
  misc_feature (635)..(635): n is a, c, g, or t
  misc_feature (651)..(651): n is a, c, g, or t
  misc_feature (657)..(657): n is a, c, g, or t
  misc_feature (660)..(660): n is a, c, g, or t
  misc_feature (696)..(696): n is a, c, g, or t
  misc_feature (702)..(702): n is a, c, g, or t
  misc_feature (709)..(709): n is a, c, g, or t
  misc_feature (721)..(721): n is a, c, g, or t
  misc_feature (726)..(726): n is a, c, g, or t
  misc_feature (729)..(729): n is a, c, g, or t
  misc_feature (733)..(733): n is a, c, g, or t
  misc_feature (736)..(736): n is a, c, g, or t
  misc_feature (795)..(795): n is a, c, g, or t
tagtgtacaaaaaggacactagatcttttaagaaaatatcaggaaactgaagacgcagatagatgcctttcaattgtaacattttggcaaaagtggaaagttcttgtaaacaccaaccccatggctcaaaatagtttttctccncagtacaacattaaaagaaaaaaaaatagtatcaataagttagaccatatttaatcagccagaactttgtccnccaacccccaaaacacaaaacttttcttagcntcataattccttaaaaggngaacaaataaacaacaaaaacaacaacaacnacaaaaaggcaaattcnactgacagccccctgggctggntcccagggcagaggggngggcngtcccgggctggggccncctganatcatcccaccncaccggngtctgcgcgggctgcctgcgggcgacacagccaggnccagctgactctgggggcctcctggggcctgcccggcccttccccggcccggcccggcccaaagagaaaaacaacaacagccattgaaacatgaaggntnagtttnctcggagctctgggaacccgggggncccaaaggagananantntngggcaggggtgggananactgtgggccccccacagtcagcnctttngaagctgttaggaggnaccccnccnccccccagtttagaaaaatagacatctgtttttttncatttntgttctncctgcctgactnctganggnagcngtnacccccatgtgatccctgggccctgagttacagccgccatccaccccccaccacctttncaagttatggctt

SEQ ID NO: 494241 - DNA, 315 bp, Homo sapiens
ccggtgcgtcgcgtaggccatatgatggatacgaggtgacagccggtctgtactccctcagcgcttacccataggagaagtaatgtgaactgatgtgcggagcaaacaggaaacttacccccaactctcactctagtatactaggaatcctttcctttggtactcttttaactaagagggaaataaataccatggtcagaccctcatttcacagactgaggaaccttagggcctacacaaggggcaagtggttggccaaaagtgtacaagtgggattgggaagctagcaaggggacatagaagctaggtctctta

SEQ ID NO: 494242 - DNA, 1490 bp, Homo sapiens
aaacaaaaaaaacagcaaaaaaacaaaaaaacaccaaacaaaaacaaccaaccccccactcacaacacatacacaaaacaagaccaaaaccactccgcacacacaccactctacgcgctacccgaagagccacaaaacgaagcgccgcccacacatatcagtaacagacctggcgcacgccacactccgatcctccagagccgtcgtccgcgcgcggccacgctcgtgcatgcgctagactccttcgtatagtggctcctgcgcccacttcgctctgtacttttgtgcgcgcgtccgtctctcctccctgggacgcagcacacggtcgcgtctgagatcagagtataactgtactctttggctggcttgtattcttgccgtcgcctcgcccgtgagtgctcgcccaggcgcgccccaaccaccccacctgcgcttctcttccgtgtccgtgttccgtcagcccgccccagcgcacctggcgccggccctcgcgcggcgcgcctctctactgcccctaccaccatacatggcaaggccgggcgtagagtcaggctcaggcagacacctcagccccaccccggagctggacgcggcgccacgcgccagcgcgcagaagcaaagccaccccaccacgcgcgcaaagcggcgagcaccccccccccacacgcgcgggaccggaggcgcgcacgcgccggcgccgcgcggcgcacgcacgcgccaccgcccgcagcggcgacgcccgcaacaacccccaggcccaaccaccgcacccagccccagagccccacgcggacacgcgagcgcgctaaagcagtccacacaagagcggcacacccgcgcccccgacagcgccgcagcggcgacagcagccgccacccggagaccgcgcccggcacgcggcccacccagggcccgcagccagccgcgccaccggcgcaggggcacacccgggccacccgcggcgcccgcccggatccgcccgggccgccccctgcaccacggcacgcccgccacgcgggcccggccgtcgcgcccgcgcgacgcccgcgacgcgccggtcgcgcaccgacccgagccggcgccgggcaggctccccgggccgcgccggcgcgccggaagcagcggccccggacgcgccgcctgtgggtggggagccgccacccggcagcgcgcgcgccggcgcgccgagacccgtgcggccgccgcgcgagaccatgcgctccggtcgggcggagtgggccgaccgccgccggggaggccgacgacgccgggccaccggggccgagcccggccgcggccgcgctcgggggcgtcccgcggtcgggcggcccccgccccccgccgccccgcggccgccgcggaccacgaacgacgggcggacaacgccccggaccgcggcagccggggcggccgggcggtaccggcggtggaccgcgccgccgcgcggatccaccacaagtccagacgggcgggcgcgacggcgcccgata

SEQ ID NO: 494243 - DNA, 507 bp, Homo sapiens
tgatggctaaaccttcctgacaatgtcacagggccagcctcctgccctttgcaaagcactggatcctcaaagaataatttacactccagaaaatggaatccatactgggtgggttctatcacgtgtagccttgggggatgagacctgggaagaccgatgtgaatacatgcaggacggggcatccggtgtctgccagctgccacctgctccggacctgggccaccggctctgctgcctcagcctcttcacttgctccattttaatcacagctcactcatcagccttctttggagaatgctggggactgagtggcaaggtagggagactccgggctttaccttaagtggacgtatgttggaacagtaacttcgccccctaataatgataataataacagcaactgaggaagagctggggttcacagagcacctgctctgcaaacagcctgcaggatctttcggtgaaagttgtgaaacatggacatttaggtgctccataagtgttagc

SEQ ID NO: 494244 - DNA, 363 bp, Homo sapiens
aagcagttaatacagactcagcagatcgcgtagacatttgctgcatgggtaaattagagaatagaaatttgcccctggagatgcacacacctcatgctagcctcacgaaagtggaataagccttcgaaaagaactggtcctagaagcttgtatctagatatcagcactggattgtagaactggtcggctgatatggaccttgtatggaagtacaacgtgtcccccttggtatgggtaaaataccctgtacatatcttggagtacaacctttagtacgtgtggctaggccacttcgtggcctaaggtaagaacgtgcttgtggaagacaagtctgtggctgggagcgtctgtataaactgcttg

SEQ ID NO: 494245 - DNA, 182 bp, Homo sapiens
gggggtttttttcccccaaaaaaccccttttttttagggggggttccaaaggggggccccccagggggggagggggtttttttggggttttttttttggtttttcaaaaaggggggcccccccccccccgggtttttttttttggcctttacccccttgaataaagggggggttttttttta

SEQ ID NO: 494246 - DNA, 374 bp, Homo sapiens
  misc_feature (9)..(9): n is a, c, g, or t
  misc_feature (39)..(39): n is a, c, g, or t
  misc_feature (65)..(65): n is a, c, g, or t
  misc_feature (91)..(91): n is a, c, g, or t
  misc_feature (321)..(321): n is a, c, g, or t
  misc_feature (369)..(370): n is a, c, g, or t
gttttttanacggagtctcgctttgtcgcgctactgcantccaccctgggtgacagagcaagacnccatctcaaaaaaaaaaaaaaaaaanaaaaaatttgttagcttacaaaaatgtaatctatagaaaacctttcagagctgggtaaagtggatcacaccttggcttgggcccaggagttggagaccaatgagacccagactctactaaacaaaaaccagcctggtgtggtggcacacacctgtggtccaacctgctcggaaggctgaggcgggaagattgcttgagcccaggagttcgaagcttcagtgagctatgantcgtgccactgcacttcagcctgggttacagtgagaccctgcctcaanngatc

SEQ ID NO: 494247 - DNA, 99 bp, Homo sapiens
tcaggcactgaatgcctggtcagtgcacaagcctggagctgctggtcagcgctgcatggctcttatcaacagcagtccttgatgggagaagccaagaag

SEQ ID NO: 494248 - DNA, 234 bp, Homo sapiens
atctacgggtccctttccatttcttcctcccctttcatttactcacttactactggttgaccatcctcaaaggctgtatggcctctgcatggaatcttgcgcaaggttatggaaaattattgagcccactcttttcatgatcactgttcgctgtgtgtcccgagggcactaactcagagtgtcctttgaccccttcatcagtgtgtcacccggccaattctgtgcccatttcaa

SEQ ID NO: 494249 - DNA, 716 bp, Homo sapiens
  misc_feature (1)..(1): n is a, c, g, or t
  misc_feature (93)..(93): n is a, c, g, or t
  misc_feature (121)..(121): n is a, c, g, or t
  misc_feature (134)..(134): n is a, c, g, or t
  misc_feature (160)..(160): n is a, c, g, or t
  misc_feature (194)..(194): n is a, c, g, or t
  misc_feature (285)..(285): n is a, c, g, or t
  misc_feature (327)..(327): n is a, c, g, or t
  misc_feature (329)..(329): n is a, c, g, or t
  misc_feature (360)..(360): n is a, c, g, or t
  misc_feature (419)..(419): n is a, c, g, or t
  misc_feature (691)..(691): n is a, c, g, or t
nttagatcgtatcacatcatagatacatggtagatatacatcagatgattagtaatagatgatgagtatagcaatatagcattcaataggacntagcatccaggctttggatctgtgtacnatcctggtgatcnaaggatgctgtaagattaatgatccntgatactttcagcttgacatctagagccctttcntcagcctcttgttccatatttctcactatcctgctgtcctttgatctagtgtaatcaccttgcacgttactcacctatttaaaatgtgcanattcatctcccagcagcagcgagatgaattccgtgtgtgtgngngtgtgtgtatgtgtgtgcttgttgcccgagnggagttgagggatctaaatgagcatccagagctgctgaagataagaagcccaaacatanagttggggacagatgtgacaatggagtgatgctcaggctgagctgaatcagcacatctggcaggcagccaccctcatttaaagcagttccttccaacccgctggtgacaggagccctgctccagaactggggagatctgaggctggggtggctggcagaggtaatcggcagcccactgttccctgctttgccagcaccctaaggctccctcctacctaagccagggctgagcctcagagcagccaagaaagcctgatccagccccagggcanaatcagaccacagggcagctcgtgc

SEQ ID NO: 494250 - DNA, 144 bp, Homo sapiens
ccccgactagccgacagggtagctggcggaggcttgaggcttggaggaggcacctgggggagggacatctcagctgagaccccactgggggactaggaatgagccaggctaaggaaggaggagggtctgtcgggctagtcgggg

SEQ ID NO: 494251 - DNA, 1414 bp, Homo sapiens
caacagagacaagatacacacgagcagcaggtccagctagtcaaacgagcgagatagagagaacaataacgacacgagaaacaagacaaaagataaaacacacatctaacgcacgaccaccgcacagagaaccgtcgcgaacataacacactatttacaaccacaacaaccactcatcaaaacaaaacacacaaacagaaacaaaaaacaatacacataacacaaaacaacaacaaacagcaaacaaaacagcaaaacataatataaaaacataaacaacaaaaaaaaaacacaaaaaaataaacacaaaagacagcagatcacaaaaggctaaaaagaagacgaaaagcaagcaacacgaacacaggaagagatgaaaaataaaccaaagaagaaaagataaaaaagacaaagaagaatgaaaagacaactaaaaaaatgagaaaaaagatacgaagcgcagaaacaaaatactaagcgaaacacgaaacaagaccaaagaacaagcgtggatcagagaagcgaacaaagcagaagagaacgatgctaacgaaacaccgagaagaatgacacaaaatgaaaaagaaagagagcagcaagaacagcaagagcacaagagcaagacagacgaacaagaaaagacggagagaaagcgagagagaacagaaaaaagagaaaagaagtgagagaggagagaggaaagccaacaaggaggaacagagaacaagagaggagagaacgagagggaggaagaggagaagaggagaggagagtaaggaggaggacaagaggagaagagaagaaaacaaaagcgacgagagaagaagtaaagaagagcacagaaaagcatcaaagacacagcaaacgaagagaggaaggagacagaaaaacgagagaacgaagcaaagaaaagagaacacgcaacacaggaacagaaagagcacaaacgagacaaagaagagagagccacaagaaaaggagacagaaagtcgaggaggaagagaagacgagaaaaggaagacagtggcgcagagacaaaaaaggacaacaaaatacacgcttacaaacaaatcgactacaacacaaaagaaacaacaaaacatcatcataaataatataagagtaaaatcaaactaaaacaatacaacaaaaacgaacacatcatcaacgcaacactacaacatccaaaatacatcaatcaacaaaaaatcaaaaagaaacaacaaataaaaacaaagcatcatacaacaacaaaataaaaaaaacacagcatacatcaacacgagacccacaccctcaaatacaaaaacataaactactaatctaaacaacaaattattataactatatgacaaaaaaaaatatatacaattataacaataataaaacatatacaaaaagacacaaacgaaag

SEQ ID NO: 494252 - DNA, 649 bp, Homo sapiens
aagtaccagctcctccctgactcctattagctcgctagaggtattgctttcttccctactctttatagctgagatgtagctagaaagcacttccctgtatacactttcttgccttccatgcacccttctctaataaagcttccagctacatcagaacaatcttttacttgcaatgactgactgtcgtccatcccatagtcctctacttagtaaacttaacagcattaaatagaaatctgtcttcttctggagcaccaatcttcccttggcttccaggatagcccagcctcctcctccttacaggtctggtgatatacactcgattcttgtctgccagtgaatcagttactaatactggcagtgtccaaatacctcttcttacccaccccctaccgtctccaaggttggtttcaacgcccttcctatggctatgctatgagaatgacataggctagtaataggatctgctcatttaataatggtgaggatataatgagtacatatatggcacgtacttaaagtaatgccaggcaaaatgatagtttgccccttgagtcgatagctgtagtaacgatttgtggatgaaactgaatgcatcagacatactatgtatcaggactatacattccatatcatctaatgcctcaat

SEQ ID NO: 494253 - DNA, 1090 bp, Homo sapiens
gggcgccgggcagcggcctacaaccttggtccagcacggcatcaccaacctgtgcgtcatcggcggggatggcagccttacaggtgccaacatcttccgcagcgagtggaggcagcctgctggaggagctggtggcggaaggtacgatctcagagactacagcccggacctacgtcgcaactgaacatcgcgggcctagtgggctcatcgataacgacttctgcgtgcaccgacatgaccatcggccacggactcggccctccaccgaatcatggaggtcatcgatgccatcaccagacactgacccagagccaccagaggaccttcgtgactggaagtgatgggacggacaatgcgtggtacctggcgcatggatatctgcactggcctccaagggaccgagtggactgtatcatcccccgaggctccagaccgaggacgggatgggagaaactccatgctgtgagaggctgggtgacgactcggagaccagggaatcccgactgaacatcatcatcatcgatgagggtgcccatggaccgcaaggggaagaagccatctcgatccaagactacgtgaagggacctgggaggctcaagaggactgggacattcgagcaaaccgtgtacaatgtagctggggccaacgtgcagagggggagaggacagcacaatctgcctacgacaccggatacgtgagacagaccagatggggcaatgggcagagccgggacgaattgggcagcatggataggcaacgaccccacggcgcttgaacaacggccggaggacctggacggtcggagcagaaccaatcatacaaggggcaaccccatgtagacgaagcagggatggacacactacaagggaagcgcggcagacaagaattcaccacaagggaaaggatgcccacgaaaacgacgccagtgtgaaagtaacaaggaagggatcggaaggacagagcaataccaagcagaatcagagggagggaggaggaactagaagaaaacaacatcaggacaccataaaaagaggcaacaatgggccgcaaacggcaaagacacaccaaagggagaaaagacgaagcgaac

SEQ ID NO: 494254 - DNA, 786 bp, Homo sapiens
  misc_feature (662)..(662): n is a, c, g, or t
  misc_feature (744)..(744): n is a, c, g, or t
cctggccgaacgtggttattttgtcagggtgaggacgcgtgcccatgacacagcctcaggaagtcctgatgacctgtgcccaaggtggtcagggcacaacttggttttatacactttagggagacacaagacattaatcaatacagtaagaagtacactggttttgtccataaaggtggggagaacttgaagcagggaggggtcttccaggtcacaagtaggtgagagacttatagttgcattcttttgagtttctaattagcttttacaaaggagccaatcagaatatgcatttacctcagtgagcagagggatgactttgaatagaatgggaagcaggtttgctctgagcagtttccagcttgaattttccttttagcttagtgattttgggggcccaagatattttcctttcacttagtctatacatacgtctcatacctccctcttaagaactagcagccaggtgcagtggctcaggcctgtaatcccagaactttgggagggtggggtgggcagatcatgaggtcaagagattgagaccatcctggccaacatggtgaaaccccgtctctactaaaaaatacaaaaaattagccaggtgtggtggtgtgtgcctgtagtcccagctactagggaggctgaggcaggggattcacttngacccaggaggtggaggttgtagtgagctgaaatcgcaccactgcactccagcctggtgacagaacaagactccatcaaggnttgacctggccattgtcacctctgaatgtccacccaaccagc

SEQ ID NO: 494255 - DNA, 106 bp, Homo sapiens
tctctttgacccagtctttcttggtctgtctccagcgctttccgcatccaggcgatgatgtttgactaaagaaagttcagcatcatggagagggttacgagctcga

SEQ ID NO: 494256 - DNA, 176 bp, Homo sapiens
tatcccttacagctggaccccacacagcatgacgcatcaagaagaagatcagatgctgaagctggacaaggagaacgccatcgaccgcgccgagcaggctgaacgcgacaagaagcaagctgaggaccgctgcagcagttggaggaggagcagcaggccctccagaagaagctgaa

SEQ ID NO: 494257 - DNA, 838 bp, Homo sapiens
ggagtacgcgcgaagccttgccatgggaatcgtgatgactgtggtggggcctttacgatgggtaccattgtggtggtatctttcaagcaatcaaaggttttcggcaattctccagtgggatgtaaaccacagactacagagggagttgacagcttattaaaaccgagggctccacagtaaggaggtagcttgcagttggggagggctgttttccatgcattgactgtagtatggttcaagtcagaggaaaggaagatccctgaactccattcacaagtggtgccttaaggggagccatactggagcaagaaaatggaccagtgccatggttgggtcagccgcaatgtgtggcatgctcctagctttaatggagggagctggtatctgtgtgacaagattgtgcctctgcacagttctcccaatggtcctcagtttgcagaggacccctcccagtgtgcttcaactcagttaccttcctcacctttgggggactatcgaccaatatcagtaggacttcttctcctagtcatttctttaacaggaaccgaagtggtggttcgagaagggattcagaagatcacgttacagtctgtgttaaaaccctaggtgggacaggttatggccatggctataagagaccttggccttgttctatttaagggacagggggaggggcaaggataacgtattttccctgatgttgggtccaacaatgtgcacgtaggaaaacgtaggtgagatggcccagggacagggtgttaatctgggatccgggggtggtcaacaagggggctttaaagagagggggccaacaatttctcaattatccgtagttatg

SEQ ID NO: 494258 - DNA, 696 bp, Homo sapiens
  misc_feature (2)..(2): n is a, c, g, or t
  misc_feature (121)..(121): n is a, c, g, or t
  misc_feature (159)..(159): n is a, c, g, or t
  misc_feature (161)..(161): n is a, c, g, or t
  misc_feature (196)..(196): n is a, c, g, or t
  misc_feature (213)..(213): n is a, c, g, or t
  misc_feature (216)..(217): n is a, c, g, or t
  misc_feature (236)..(236): n is a, c, g, or t
  misc_feature (285)..(285): n is a, c, g, or t
  misc_feature (322)..(322): n is a, c, g, or t
  misc_feature (374)..(374): n is a, c, g, or t
  misc_feature (387)..(387): n is a, c, g, or t
  misc_feature (430)..(430): n is a, c, g, or t
  misc_feature (475)..(475): n is a, c, g, or t
  misc_feature (550)..(550): n is a, c, g, or t
  misc_feature (579)..(579): n is a, c, g, or t
  misc_feature (614)..(614): n is a, c, g, or t
  misc_feature (630)..(630): n is a, c, g, or t
  misc_feature (678)..(678): n is a, c, g, or t
gnagaaaaagtttaatgaactaatcgtttcttgatttttatacaaagtgatagatcatgcacatttttttcagtttttaaatattttgctaagtgcaaatactagattcctctctccagtnttaaggcaagtgagagggggctgtgggtggggagcgtnangccctgcggcaagccctgcagggcagagagagggngcgagcggcctcagggntgnntgtggtctgaactgctctntgggcactggcacggccccttgctggctggtctgaagacccccagtgcntctgtgcccaatggggtgactggtccaggcaggagcncgaggttcaggccctgcctctggacagaggggcctggagaaccagggtgggngcgcacggcagcnctgtggtcccccgtgcctggctcggggaggatcctcaggaatnagggaccctccaaggaaagagggcgcggctccttccccaccagcncagtttggccagaacagctggcactcctcttaaatgacccacccctggggtttggccttaggagaaacatcactntgggctccccctcccctgccagggttgangccagcccctgtttagggctgtatctgcagccgcngcctgccccctttgtnctgcctggggctcttgctggagccacgtgccttgggtacagggcaganggagccgaggctccaggg

SEQ ID NO: 494259 - DNA, 326 bp, Homo sapiens
cgcagactcagcggggactttctcggagcgactgtggtggttacatggttagagaccatggactatgtaaactgttgtattgcttctgtgtgagtgtcttagcaaaataaagttgtcaacatgttgctgtttttatgctataaaaacctggttttcagaatgagtatgactttagaataattttgacatattttgtagcagaattttttttttaaggcttcaaattttgtaatgaagctcctttatttttaaggcatccaacatgttctggaagctggaaaccttgaatttgtgttttttgttgaataaagttacagttctaagca

SEQ ID NO: 494260 - DNA, 472 bp, Homo sapiens
acgcgtccgcccacgcgtccggtttttttaacttttatttttattttgagataattgtagatttacatgcagttgaaataatacagagattccatgtgcccttcacccaatttcccccagtggtaacatcttgcaaaactatagcacaatatcacaactgggatactgacatcgatagctgtgatatagaacatttccatcatcacaaggatccctcatgtttctcacagccacgcccaattctctcccatcctcaccccctccttaacacagccaccactaatctgttctccatttctataattatgtcacttcaagaacgttatataaatggaatcttttggtacaaaacctttttaaattggcctttttcattcagcataattctctggaattataagttgctgcctgtacccatagtttgttcttttttattgctgagtagcactcacggtatgaatgtactatggtt

SEQ ID NO: 494261 - DNA, 464 bp, Homo sapiens
  misc_feature (264)..(264): n is a, c, g, or t
gcacccagtccaaaactaagacaccatatagggcaacattcacaggttccaggggtcagggcctgatatccttgggggtcatcagcagcctaccacaggggtatcatgacccatattacagatggggagctgagggccaggaggtgaaacatcaaccaagttcccagcaccacatctgcctgcctgtgtctgcctggcttgctacaaggcttctgtgactgaccttttacagcacctttctgggcagaaggctcagacccagtncctgacctgacacacatgagtcatgagaccagagccagcttcatagatgtgtgacccgtgccgtcacaggggccctgtgctcagaagctgccatgcttggtttggtgccttgctgtcgccaccttgaaattcctgataattttgattttcatttgcactagacccacaaattatgtaactgtcctacatgtgaactgaca

SEQ ID NO: 494262 - DNA, 799 bp, Homo sapiens
  misc_feature (19)..(19): n is a, c, g, or t
  misc_feature (63)..(63): n is a, c, g, or t
  misc_feature (65)..(65): n is a, c, g, or t
  misc_feature (82)..(82): n is a, c, g, or t
  misc_feature (106)..(106): n is a, c, g, or t
  misc_feature (109)..(109): n is a, c, g, or t
  misc_feature (113)..(113): n is a, c, g, or t
  misc_feature (118)..(118): n is a, c, g, or t
  misc_feature (122)..(123): n is a, c, g, or t
  misc_feature (126)..(126): n is a, c, g, or t
  misc_feature (129)..(129): n is a, c, g, or t
  misc_feature (134)..(134): n is a, c, g, or t
  misc_feature (139)..(139): n is a, c, g, or t
  misc_feature (153)..(153): n is a, c, g, or t
  misc_feature (181)..(181): n is a, c, g, or t
  misc_feature (185)..(185): n is a, c, g, or t
  misc_feature (252)..(252): n is a, c, g, or t
  misc_feature (264)..(264): n is a, c, g, or t
  misc_feature (279)..(279): n is a, c, g, or t
  misc_feature (296)..(296): n is a, c, g, or t
  misc_feature (321)..(321): n is a, c, g, or t
  misc_feature (326)..(326): n is a, c, g, or t
  misc_feature (356)..(356): n is a, c, g, or t
  misc_feature (783)..(783): n is a, c, g, or t
accttacataaattaagantgaatacatttacaggggtaaatgggaaggggttccaactcaangnaagtgacagcccagggngttctggccaaagacatcagctanganaggnaactnggtnntanggnttggnctttncaaccctgacaganccgcaagataaaacaactggtttttgcnagcntctagagaaatcccagaacactcagccctgacacgttaataccaaggggaacagttaacttcaatanaaggtcaaaatnagcaacaagttctanaatccagtgctgatatnagatacaagcttcaaggacaatttnttttngaaggcttattccagtttcgtgaggctagnatgaggtgtgtgcatttgccaggggaaaatttctattctcaattaacccatgcagcaaatgctacgcatctgctgagtccgtttagaagcatttgcggtggaggatggaggggcccgactcgtcgtactcctgcttgctaatccacatctgctggaaggtggacagtgaggccaggatggagccaccgatccacaccgagtacttgcgctctgggggtgcgatgatcttgatcttcatggtgctgggcgccagggcggtgatctccttctgcatcctgtcggcaatgcccggatacatggtggtgccgcccgacagcaccgtgttggcgtacaggtctttgcggatgtccacgtcacacttcatgatggagttgaaggtggtctcgtggatgccgcaagattccatacccaggaaggaaggctgganagcgcctccggacacc

SEQ ID NO: 494263 - DNA, 405 bp, Homo sapiens
  misc_feature (264)..(264): n is a, c, g, or t
gcacccagtccaaaactaagacaccatatagggcaacattcacaggttccaggggtcagggcctgatatccttgggggtcatcagcagcctaccacaggggtatcatgacccatattacagatggggagctgagggccaggaggtgaaacatcaaccaagttcccagcaccacatctgcctgcctgtgtctgcctggcttgctacaaggcttctgtgactgaccttttacagcacctttctgggcagaaggctcagacccagtncctgacctgacacacatgagtcatgatcttaacgtcacaggggcctgtgctcagaagctgccattactgaaatctgataattttgattttcatttgcactagacccacaaattatgtaactgtcctacatgtgaactgaca

SEQ ID NO: 494264 - DNA, 885 bp, Homo sapiens
  misc_feature (23)..(23): n is a, c, g, or t
  misc_feature (62)..(63): n is a, c, g, or t
  misc_feature (65)..(66): n is a, c, g, or t
  misc_feature (68)..(68): n is a, c, g, or t
  misc_feature (71)..(71): n is a, c, g, or t
  misc_feature (76)..(76): n is a, c, g, or t
  misc_feature (79)..(79): n is a, c, g, or t
  misc_feature (85)..(86): n is a, c, g, or t
  misc_feature (94)..(94): n is a, c, g, or t
  misc_feature (107)..(107): n is a, c, g, or t
  misc_feature (111)..(111): n is a, c, g, or t
  misc_feature (120)..(120): n is a, c, g, or t
  misc_feature (129)..(129): n is a, c, g, or t
  misc_feature (171)..(171): n is a, c, g, or t
  misc_feature (198)..(198): n is a, c, g, or t
  misc_feature (315)..(315): n is a, c, g, or t
  misc_feature (370)..(370): n is a, c, g, or t
  misc_feature (420)..(420): n is a, c, g, or t
  misc_feature (423)..(423): n is a, c, g, or t
  misc_feature (432)..(432): n is a, c, g, or t
  misc_feature (449)..(449): n is a, c, g, or t
  misc_feature (453)..(453): n is a, c, g, or t
  misc_feature (461)..(461): n is a, c, g, or t
  misc_feature (470)..(470): n is a, c, g, or t
  misc_feature (475)..(475): n is a, c, g, or t
  misc_feature (479)..(479): n is a, c, g, or t
  misc_feature (505)..(506): n is a, c, g, or t
  misc_feature (511)..(511): n is a, c, g, or t
  misc_feature (530)..(530): n is a, c, g, or t
  misc_feature (536)..(536): n is a, c, g, or t
  misc_feature (843)..(843): n is a, c, g, or t
agaaaaagaggtatataaaatgnggtcatgaagaaccaagccaatctcacctttctttaaanncnnanganaaggntcnttttgnntgtgtggngcagaggcagggntggngcgacaggnttttggggnggtgtgggcgcaggggtttgctcagctcacagctagcgcggngggcagagcaacccttcggcccaagcnatcctcgcagcttgcacagaagcttcctgaacctaagggatccgttcccagctctccttaaattcccagtccccaccctgggcctctctccctaacgatcttgtcgctttgggagcncctgaagtgaaccctgaaatactccctccgtcaactctgggctcagacctttgcncttctctgtgttacaaggaaatttcggtcaagagggtgggaacaggtggnttnagaccgtgnagcgaaagcgcactgcnaggnaagtgttnaggcaaatnttatntctncttattcagtctgagcgggacctaannttctnaccaccgagcaatcctgcntatgcnggacatgcatcttgggcgactccggatggaggtgggatgagggagggcggggcagataccaggaggtctgggccttagtagggaatggacgtgtgttcttatgaaggctgcaggcaccgggcacagctcctggcccagctgcccctcagtggtacacaggaagcagggcccaggaaaactgagatggcaaaataggcccgggctctggaaagcaacgtgaggtcatgcagatctcactaggcagacctcgtcgcgtggaagagaaatgccaggaaaaggggtcactgcaggaggcacctcggatctnatggcaggcaggaccttgcatcaaaatgacttttctttagaa

SEQ ID NO: 494265 - DNA, 324 bp, Homo sapiens
tctactacaaatctgcctacattgttataccctggatgtacgtgcaatgttcgcgaagaagcctcccctttacccttcctcgcagtagccagaatagtcaggggtaaggtgggtcgactcctttcaggtctctgggatacagtgctgactactggtacataggagctaggcttgcaagccccagttgcggcgacataaagcaatcagagtcaaattatctagagtagcgcaaaagccctttggagggagctcctccatcttagttttcctaggatctcaaggaaaaacccgagggaagaaagtcagtgggggaccagcgaactg

SEQ ID NO: 494266 - DNA, 288 bp, Homo sapiens
aaaaagcccggggggcccccccccccccgggggccccggggggggggggggccccgggggaatttttttcccttttttggggccccaaaaagcttgtttttccccgggccccgggtgggttttttttcccttatgggggggggggggggagcccccaaaccaaagccggggtttggggcccctggtatttttgggggggtttttttgctttttcccccctgggtttttttttttgggtttttttttttcccccccccccccctgggttttttttttggggggccccca

SEQ ID NO: 494267 - DNA, 324 bp, Homo sapiens
tcggcactaggactttccagattcttccagcaacccaacagccacccgtttcctcactctcccaatgcagtacccaaactctctggacacacacactcctcattcacactcagaccagaagctttcagatgcactgatacccactcttactgctctgaagacccatgaccaggatggttagcgatggaaaacatgatggcccctgcctagaatcagaggagatgcaggtgctttagaacaacatggtgtcattgctatatgactcaaaatcgtgtgggtgaacgttcatgcctctcacaagtgtgttggtggatggttcactga

SEQ ID NO: 494268 - DNA, 376 bp, Homo sapiens
agtaggtgagcaccatgaggtgaggtctgtgtgtttgtttttgtttcggtttttagcgtttatttggatggtttggtatagttacgactaaggtgacttcaactcctaataatctatggcaagttgtggtctcttaagcctcattagtttcatagcgaagacatatactagcaaactaccagggagatcccttacccggcactcaagagagacgcgcccgcaacccttcagaaggaggaccaccaaccggaggactcgataataaatcgacccacagataccacgtaatgacacaccccgctcctcgcgaggacctcccagaaagcgaatccggtaccccagactcaacctaagcacccgcggataccagtcgccc

SEQ ID NO: 494269 - DNA, 1032 bp, Homo sapiens
ggaaggcttgcacaggctgaaagctttgtttctcgtgcctgctgtaacaagggactgagcacagacacacggatgagtggggtcatttccagatattcaggtcacagcagaagcaggcaaaatggatccccacgttgcagctatgaggacgtgagtacactattctctttgtgatggcctatcgctgctctctaggtggtgctccatctgaagattcaagcgttattgcaatgagactgcgagacctgccatgccaatttgctagactctcaaaaccaaagcctgagtgatctagtagtatttaggcgaggagccaggaaaagctctggttctgaatgaggtatacttaggcaagtcagaaagtttgacagatgttcatgtccagagtatactgggccgcacgaagctcttgatatcgcgacaggtgggaccgctgagacttcagcaagtcttcagattcaatggcacgaagggactgtgatcaagtgtatcagtccgatcagagaaaatgccctagcaggaagtgatgtcgcatctcgagccagatgcaattcgtgaactgtacagttgcttgctagaacttcagtcaactgtgaacatagtaccgaattgtctcactagtaacaggaaacatggtgtaccataagattctgactctgctgcagtctatagcagcggtctaccccaggaactctgaagacagatgcagtcggatgcgcgtaaggaacgcacaggacattcaacctattcgagctatggactgactaatttagtgccacgaaaactctccaagcatcaatgggttcacacgaaagctggtacgaacgtagggccattcaggcttggtacagggtttgcattcgccccctgtcattgtttaccgaaggcaactagtggaccccagtcatttcttggataatttccggggcatccatctggactaacgcaatggcgggcttttatcatccgggcaaccgtgtttctccataataagaaggctttggaggaaaccccttcgcaaccttcccccac

SEQ ID NO: 494270 - DNA, 654 bp, Homo sapiens
tttgctagatgacatgatcacctagaaaatatgaaagaatgaccaaaaaaaaaaaaatcaatgaatccaggagctgattttttgaaaagatcagcaaaacagactgctagccagactaataaagaaaagggtattcaattaggaaaaggggaagtcaacttgtctgtttgcagatgacatgattgtatatttagataacccaattgtctcagcccaaaatctcctaacactgataaaaacttcagcaaagtctcaggagacaaaatcaatgtgccaaaatcacaagcattcctatacaccaataacagacagagggccaaatcatgagtgaactcctattcacaattgctacaaagagaataaaatacctaggaatacaacttacatgggatgtgaaggaccttttcaaggataactacaaaccactgctcaaggaaataagagaggacacaaatggaaaaacattccatgctcacggataggaagaatcgatatcgtgaaaatggccatactgcccaaagtaactgatagattcaatgctattcccatcaagctaccattgactctcttcacagaattagccaagacaatcctaagcgaacagaacaaagctggaggttatcatgttacctggcttctaactatactacaagg

SEQ ID NO: 494271 - DNA, 386 bp, Homo sapiens
ataaagagaaatcaatttgtttttgtgggtttttttgctagcctgtacagggagttaatacgtagcataaaaagaatgtcagggagctctctgagtctgaatcttttctgattctgagggctgccagattcagaagtagctctttgttcaactaagctctttattcctctaaagaaaaaaaaaaaaggaatgttatttttggatttttaggaggtccttaaagtgccaatccatacattgaaaaagaaattttgagtttaaatttaaaatatttaaaaacgttaagaacatcatgttcttaacgttttttaaatattttaaaacgttaagaacatgatgttatatcataagatcaaagtaatgtaacataggatagagatgtaatg

SEQ ID NO: 494272 - DNA, 840 bp, Homo sapiens
  misc_feature (33)..(33): n is a, c, g, or t
tttagaactgggttttaagacaactgctatggncagaaggtaaatgggaatggccttatgaaggtaacatgatggcctaataagaaaatgaattgttggccacagagttgaatttaattggagttagatagttcagaatgtagcacttgccctataaatgaattcagattggtcctatttatataatattagaattaatatattatcatgtaagtgggaatttatttgttaagtggactctcaaattttagaactttgtgtgaaatatctcccagaaaacacaaaaggtttcaaggtatcacccaaagctagggaatcaacaaagtactttattaatgcaagaccacaatttaagccccaggcaggaatccaacagtaacatttttcctttaggttaagcagtaattttttgaatggtcatttttaatgggtctcacacatgcatattgtaatatcattcatgttgaggttttcaacaaagaaccaattttgttaatataatgtacaaaaatagtgggttcattttctgaattcagtctttgaaataaaaactcctgtggtttgggcggtgttcctgaagtgtatggggtgattcacccccaagctaatttttaaaagtcatttttgaagtggggaagtctcatgagagattgttgacgtttgtatttactccaagagtcatgattcaaactagtttacattattagcagttagggtctaattaatgggaaagggtgtggggtaaattcggaaattttcttaagattataaatatgggctaatggtaaagattaacaggttatggccaacattagttgaaagcgctttacggggcagaga

SEQ ID NO: 494273 - DNA, 226 bp, Homo sapiens
gactgatcacgccgccgagtagctgaactacagggccgcacacgcccggctatctttgtatttttagtagagacggggtttcacaatattggccaagctgatcttgaactcctgacctcgtgatccaacctcctcggcctcccaaagtgctgggattacaggcgtaagccaacgcgcgcgatccaagggttttctgttttctgtttatttgtttaagctttacttc

SEQ ID NO: 494274 - DNA, 906 bp, Homo sapiens
acgcccctatcttttgtccgacctataatgtttgctgtccgccccgaaattcccgggtttcccccattccgcgggtgcacctgcgcctatacaacgatgttgcagcgtttaaggatccacgatcccaactcgtgtgtcctccggggtttccacaactgctgttcccgcgcaggtgccccccaagttgtgttctctgtggcggatgcgcgcagtgttcgaccccgcctgttggtgggccccaggatacgtgactctgtctccaccttggtgggactcccacggctcccctgagacccgccttggtggccccgtcgcccaatcctggtctcgcccgcaaattgggggctccctcattatgaggaccgccctatgtgcccccccccccctctctgagaggctgcctgagcaaggtttactccctgacgcttccctttgtgctaggaggctggttggttgtccccacggtctctccacttcccgacgcttccccgagtgtgacgctctcctctgatgggccactctttctgcgcgtcgtggcccggctgcactacgtacgccacttcagtcactcatgcgggccctctctctcattgccctgctcacacgcgaacaggcgccgctctttttaagacacacgcgctccttcgccactgctgtataggcattccccagttgatacagtgccttcacctcctgggctccacaccaccgtaggggtgtcgcaccacctgagcaatcatcatcaaggggagcccacattttgttgtatcattgcttgtgcacacagcgccggtgaagttggaacccccccacgggtcaagacaagacatgtaaaaatgcaatcgcctacttatcattgtcaaaaaacacccctttgtgactcctttccgccccccacaaagacaa

SEQ ID NO: 494275 - DNA, 270 bp, Homo sapiens
tctaatggcactaaatgagaatgacctacatcctcccaatcagacgccaagatgatcacagtaggattcagaacgtctcagctaacaacaacagtagcaagtagcagaaattcaactgaaatggagcaaagaaaggtgaaggtaaaacgataccaaaagtcccctaatgccatctactaactgcaagaaaagcttccacagtttaactcaatatcatggacacggcgtactgcaggtgagttgagcagatgttagcaggaagagaggcat

SEQ ID NO: 494276 - DNA, 382 bp, Homo sapiens
  misc_feature (9)..(9): n is a, c, g, or t
  misc_feature (11)..(11): n is a, c, g, or t
  misc_feature (269)..(269): n is a, c, g, or t
  misc_feature (349)..(349): n is a, c, g, or t
cctcaagtnanccacccacctcagccttcccaaaatcctgggattaccaggcgcgagccaccacgtccaactttataaagaaaagaggtttaattgactcagttccacaggctgtacaggaagcaccactggggaggcctcaggaaaattacaatcacggtcgaaaatgaaggggaagtgagcacgtctttcatggctggagaaggaggaaaagatagcggggggagatgccacacacttttaaacaactggatatcagccaggcgcangtgtcacgcctgtaatcccagcactttgggaggccaaggtgggtggatcacctgaggtcaggagttcaagaccagcctgncaatatggcgaaaccccatctctactaaaaata

SEQ ID NO: 494277 - DNA, 112 bp, Homo sapiens
attcatattggcggtgagcatcgcactccagcggtgaaacaagagtgagactccacctcaaaaaaaaaaaattaaagaaatagggttgggccgcaagggttcaccgcatttg

SEQ ID NO: 494278 - DNA, 245 bp, Homo sapiens
aggctccagtcttaacgatatattggaggtcagcacggtagctcacgtagtcgacgagaacttgtacagtgcaggcatgcaccgcagtggtaaatacacgtcgaccaggatccatcttaacgatatttggtggtcagcacggatctcaagtatcgacggaacttgtatagggaggcatgcaccgcagtggtgaatacacgtcgagctgcatgacatagcatagcatactcgggtactgaaggata

SEQ ID NO: 494279 - DNA, 1532 bp, Homo sapiens
tttgatatgattctatttattataagtcaaatagatataattcattatgagaatgaaatgaattattgttaatagttatgagattaacataaacaatcatcgtcgtgtattgccagaaaagttattaagatggtagcagttgttctcgtgtctctagcacatcccccttcagagaaactttcaaatagaaaatgaaactgggcatctctgctatgcaaatattggtggctgttgtcatattcctgcaacagcccttgacagtgggctgggctgggtgctgttctcactttaaatccggggagctgaggcttggaggaataaagggaacagccccaggacttgaacagagcccttgggtcacccatgtctctactgtagcttctaggccgtttcccctggggatccaatgtgtttcctgttgtccccaatcttttaaatttttttccattattagagttagtaccagcagccagggtggaactgcaattcgtgaagattgcattggcttgctttaaaagaatggtatctgtacgggtcccttaaccattcgaggggcaccatcgggcttgtgggtcatgctgggaagtggcccggctgcctgtgacagtttctcagccaggcagggactcttttccacacgatgacactggaactgaatgccacactccttctccttggaagaaaaaattgtgtgtaggacaaggactcaggacatgggtgtggaagaatctctgtggtacgagcccagcctggaagaactcttaggctgcgtggacgctgcccggccacggtgacggagctgttccaatgcctgcttcccgagacaggcccatgaaatcatgcaggcttgagcccggcttctagaaggagcacgcctctggccagggtggctggtggaaaccagtcctggccaagggagccccggccaggctgccaggtaggcagcaggcggcagggggttaatgtggggagcgggcaggggtggggtgggaagccagctggggaaatgggggctgcagggcccagccgacaggcacagacacagggggctctgtctgcttgcccgctgcctggcactgtgactaaccgcccactaatgtgagtctgaagtcagcccttgtgtcgtccctggggttctgggagcacagcgaaaaccctttccagcagcccccctcattctggaacctgcagccccaacatccattctttcagctctcagggttgctgggggctgatgagccagtggaagtatccctttccctggccaggaagggccaccagcaaaaaagaagcagaaaaccagtctcccctactctgggtggggaagtggggggcacaggagcctactaaacctacgtgaccgccgtggtagctgctccacacgcagcaaaggagccattgaaatggggagaggccaaatcgaatatggaaaaaatggcaaaatatcccgttcacagtttcatacgagcaacacactgaaataggattttggaaatttatattagattaaaatgaattttagtactaaagtg

SEQ ID NO: 494280 - DNA, 328 bp, Homo sapiens
  misc_feature (160)..(160): n is a, c, g, or t
  misc_feature (316)..(316): n is a, c, g, or t
gtcgacatcaagctggccagggtcaccaaggtaatgagcgggacaggttctcagggacagtgcacgcaggtcgcgtggaattcatggacgacacgagccgatccatcatccgcaatgtaaaagggccccgtgcgcgaaggcgacagtgctcacccttttnggagtcagagcgagaagcccggaggttgcgctgagcttggctgctcgctgggtcttggatgtcgggttcgaccacttggccgatgggaatggtccgtcaaatctgctcttttttttgtccgcacacgtaactgagatgctctttaaatagagcgtntgtgtttcaagt

SEQ ID NO: 494281 - DNA, 865 bp, Homo sapiens
ggccggtctctctgaggggttgtgggtgccgatctctctgaggggctgggtggtgctgctctctccgagcgggtggaatgccgttgtctctagatgggtgggggtgccgctctacattggctccatatcatgtgacgtttatggtactggtgtatggtctctcttcattctttacggtgctcagtattttgaacgtcgcttatcaacacgggaaaggcctcttggccggtcaccacgtacggacgcatgaccggtcatcgtcgtggtgaggctgatatgctcacatgattactgactaggtagagagggaaaatcctaagacagaggaactccagagatgagtgtctggagcgcttcagttcaggctttaaaggccaggacgggccacacgtggctggctggctcgttccagtggcggcacgtccttgggcgtctctcatgtctgcagctcaagggctggcacttttttacaagtataacacaatgggttgttattgttctattgtttatcatggtagcaggtgatcttgtggtctgctgtggacattcggggtgagtcctgttgctgcgctgtgtagcggatgttgagaatacgggtgcgttcctccgtgaatgtggtgtgcccgatggcgttgggggaattgtacagcgtggaccaatgctctacctgtagcgtgcaatagccgtggtaaacacctgtccttacgaaaacggcctcgtttgctttatggggggaagaacagaaacagattgatagcggggggctctctgtcaaacatggtttttgagctctagcaccagcacataatcagtcggcgagattgccgccacaaatatggggcactcgaggggacaccaaggccca

SEQ ID NO: 494282 - DNA, 538 bp, Homo sapiens
cagcgagtatgctgtcgcagtcagacagtgtcacgttatgctgcagtaacaaacagtcctaaaggctatatggatatacaacagcaaaggtgtattacttgctcatgccgcttgcccatttcaatgtctgtgctctcatccatgccatgttcactctgggacctgggctggccaaaccacccccgtctgagacattgccagtctcatggtggtagagggtgacagatggcataaccaccagctggctcttgaagcttctttccagagacgatgtgcgtcccttccacccaaattttattggccaaagcaagtcacaaggtcgccctggatataaaatactatcagagagaggcactgccagtcagacatcaagcgtgatatcagcgagacaggaaggtatgatctacccaagggagagcaagcaaatattttcaacaataacacaaatctaccacagctgggatcccagcaggggtatggtttatgcaaatcaagatcccatcaagcaggatcagacccctggtggggccttgtgtgc

SEQ ID NO: 494283 - DNA, 565 bp, Homo sapiens
  misc_feature (465)..(465): n is a, c, g, or t
  misc_feature (470)..(470): n is a, c, g, or t
actagtccacggttggctagttacatcagatataatgggggtataggcattgcataaatatacccattccacatgggagaaattggccaaaacaaagaggttacagggcctatgcaagtccaaaatccagcggggcagccaaatcttaacactctgaaatgatcttctttgactccatgtctcacatcctgatgcaagaactgggcgcccatagccttgggcagctccacccctttggctttgcagggtacagcccctctcctggctgctttcatgggctggcattgagtgtcttttctaggtgtacagcacaagctgttagtgtatctaccattctggggtctggagaacagtgcccctcttctcacagctccactaggcagcaccccattggggactcagtgtgcaggctccaactccacattccccttctgcactggcatagcagaggttctccatgaaggncctgnccctacagcaaacttcttcttggacattcaggcatttccatacatcccatgaaattgagacagaagtttccaaacctcggggcttgagttctgtg

SEQ ID NO: 494284 - DNA, 302 bp, Homo sapiens
cagaggctgcggccggggggcacgtgttatcatcaggggagagatagtcctgcggtctgctccccgtcatcgctgtatccccaacgccgcccgatgtgtccccgtgtgtctcctgcccgccgcgccggattaagagccgtgtcaggaagaggaaacctgcaccgagacaaagcagggggagcaccaggcacaagcccctccccacactccccaggcacaggcgggcacccggcctcaccatccagggtcagccggtcctcccgcacgccgcccgccacattcctgcacatcaccgtcttcac

SEQ ID NO: 494285 - DNA, 249 bp, Homo sapiens
tgtatcatgcttatatgatagaatgggatccttaaatgtcccattaatccaagggcataagaaaaaaggggactaagattccccttggccatttaaaaaaatatagaaggtagatataaaccccggcctagtgaccattacgataaatattagtggtccactcgtggatcagttccaactaaatggatggggaaaaatataacatcctaacattactaaaggaaagctggagtggttacctattacggg

SEQ ID NO: 494286 - DNA, 484 bp, Homo sapiens
gggaacaagtcatttggtgaaaggtcacgagggcacacaggcccagggaagactggagatttatgctactattatagagactcttcccctcccccatacctgaccaccgatagcaacaggctccagtataatgagagtaacgacagcgggaagtatggcaagattcagactctattggagaaagagttcttttttggtggtataaaatttattttatgttttaagttttctgtagagatggggatctctctatgtggcccaggctagtctcgaactcctaggctcagacaattctcccagctggacatctcatagtgctgagatcacaggcgtgagccacagtgctcagccaaggagttcttaaagaagcccaaagacaaatggagagaccataacagggacacctgaggaatctgaacagtcggtcacctagaagtacagtgaagatgaaacacagcccaagttggagccagaataacaaaaa

SEQ ID NO: 494287 - DNA, 191 bp, Homo sapiens
gggccgcggtagtcgaacaaaggagcaggggctgctcgccggagtggacccgccacccacgctcccggggtcgctgcgcaagcgggctctcgtctacttgccaccatgaccgccaagcggctacaggccgaggcggtgcgagatccagttcggccgtcagtcaactgcgagcaatcaagtaccatgagcgg

SEQ ID NO: 494288 - DNA, 460 bp, Homo sapiens
atatataaatacacagacacacatatatacaaacacacgcattcattttcgtccacagttcctggctcataactcccacagcccttgttacactcttttgttaacattgggtgtgtcaggcctcaggagacaatcactctaacctcctgcccttccttttacctgcccaagacaggactctaatcttccctacctttctgatggtgggtcataaaactcattccagagacggtcccaccccatatcctgctagaaggaatgctgctgtcatgaagcttccataaaaaccaaggggactggattcagagagcttccagataactgaacatacagaggttctagaagggtggtgcgcccagggagggcacaggaagctccatgcccttccttcatacctcaccctatgcatctctttatctgtatcttttataatatcctttataataaaccagtaaatgta

SEQ ID NO: 494289 - DNA, 279 bp, Homo sapiens
atattgcccctaggctgggaacaagggagatctctctcaaaaaaaattttttgagaaaaagagtaaagctgggccaggtgcaatggtcacgcctataaccccagcactttgggagttggaggcaggagactcgcttgaggccaagagtttgagactaacctgggcaacaaagcaagacctctgctgttataaaaaatgaaaaaattagccaggcatggtactgcgagcctgtaatcccagctactctggaggctgaggtaggaagactgcttgaggcta

SEQ ID NO: 494290 - DNA, 660 bp, Homo sapiens
  misc_feature (629)..(629): n is a, c, g, or t
ctgcacaatctggatacacagattagcacttcctagggggataagaatgcatcttcatacataaaaacacacacaccaagcaaaaaacaccaccactacagcaagatgacactaatgagcaatggactttttttccaggaggaaaagttttaatttattcaaagaaatagcataaaaatccccgtacataattcttaatctttcaaataccttctcagatgctttccctccacccaaccaggagagaagtgttccatactttttccacactatgccaggctcctctcttctctttcacatttccccacttaggtgggcccagggagaagctcatttggcttgaaagccaaggtgttactcacaaataaccattccaatcgacttgcaaagatacaattcattaagtgctatgcacgaaaagtgaaagctatgaagagagattattttaaggagacttatatggcgaaagtgagagcaagcctttctgaggagtgaggttaaacattgatcctaaaggtgttgaaaggtgggccagccaagataatggacaaacactaactgggctcacaagatgcacaaagcccagtgtgtttaaccactaaactttaccttttaaaaatatgcgacgngcacgtcacaggggtacacccgtgcacaggg

SEQ ID NO: 494291 - DNA, 431 bp, Homo sapiens
gaatttctggctggtattacttttagaagcacagagtctccctacctttctgtcataaccagcctcttgtgttaaggttcttaaggaataacttgtgctggctgatgagctcataattttgacttcaatatgatctttttatagtctcttccctatttgtgaatgtttttcttttctttcatactcctacaacattttgttcttgtatccattcaggtgaaatctatccttaattctctgagtggagaagaattagagactctaaaagttgaattagagcaactcaaagaaacattttctctagcagaattttgtgaagaagaggaagaagagaaaaaaggtaatatgaaaatttagtatctgagtggagaggatgcagtgtgtttgtatgcagtgcattgcccttgaaataaattatttactcttattaa

SEQ ID NO: 494292 - DNA, 228 bp, Homo sapiens
ctgtgctgccatgccacacaagccaacagccctgaggatgctctgtggctccattttcagctgcatggagaacaggcacagtcagttctcagatatgctgctggtgggcatggcccactcacctgcaactttcagtgtcaccactctcactggcgctgggcctactatgccatttgttggcctgcacatcgacgcctggacagggctaccgagcgtcgaacttccgta

SEQ ID NO: 494293 - DNA, 177 bp, Homo sapiens
tgaagatctttattactatgctgcctcagtaaaggctggctatcaaagttctgtactaaagtctggaggtgattagcattaagccatgggacaagctactaccttcttcctgacccctgttcccagggagccattacggagaggcttgaatctatcactgcccaaatccctgcgaaa

SEQ ID NO: 494294 - DNA, 217 bp, Homo sapiens
tggccccaactgggcccttggaagtacaaatttaaggaaaaaccccccccccccgtaaaggaattattttcctgttgttccaattttgtggggtttttattcaacgggggtaaaaccaaggttctgggggacaggggggtcccttagccccctgtgtttttccaaaccctttcccaaactttaaacttggaattaaaaaaaaattttttaaccccca

SEQ ID NO: 494295 - DNA, 470 bp, Homo sapiens
cttgagcatagggtgatggtagtcattctctgtagggagatcctctccactgggaaggcgcgtaacatgccttttaatggcatggtctctgctactgcaacctgtgtggctccaaggtggttcgggagtttccagaattaattgtatacatgttttgtttgtttgtttttgtttttgttttgagacggagttttgctcttgtcgcccaggctggatcgcaatggctcactgcaacctccgcctccctgcctcagcctcccgagtagctggtatttcaggcgcccgccaccacaccgggtaattttggtatttttagtagagacagggtttcaccatgttggccaggatggtctctatctcttgacctcgtggtccacctgcgtaggcctcccaaagtgctgggattacaggcctgagccactgcgcccagttttctcctaactccattttacaagcaaagatcaaggtta

SEQ ID NO: 494296 - DNA, 206 bp, Homo sapiens
atagggcgcctccccgtccctcggggccgcggtgagcaggaaagacaacacgttcacagaaagggagctgagtgaatcttaccagatggggctgcctggtctggggatagttgctcgtctgacccaggcatggtgtttgggaagccgctggacaatattctactatgtaagcactccactccccagccctcccctccccatctgcg

SEQ ID NO: 494297 - DNA, 110 bp, Homo sapiens
agtggcgctagtgtgcatggcatattgcagcacattctggcttgcattgtgtgtatgccagctggtccaatgtcgtgcccaactgagctcccccaccaggtctgccagct

SEQ ID NO: 494298 - DNA, 195 bp, Homo sapiens
aatttggttggccccttccccccggggggggtttgggtaatttttcccctttggatccctttccccccccaggggggaacccttgggtttttaaggttcttgggggggggtttttccgcccccttttttttttaacccggtttgggttggcccttttgggggttttccaaatttccctttaatttttttccccca

SEQ ID NO: 494299 - DNA, 154 bp, Homo sapiens
tatatgcttaacaggtgttttgaaataccatgctcagcccaacacagaccaattaatacaatctcagtgggtgggcctgacactgtgcttttttgagttcctaggtgatcgtatgtgcaggtggagttgagaaccactaatgatgagatacagc

SEQ ID NO: 494300 - DNA, 240 bp, Homo sapiens
gagactccatagaataagtaattcatctttcactgcctcacagtgatgcagtgacatcttctgtttctcccacatcctcttgatgttgctgatctgactcctgtgcgtgcacagcctgtccagagttccacttcacggtccagggtgacgtgttgctcttggtggaataagagctccgtgcttgtctcatctgtgatatatgtcaggacagttctttctcagagtcagctcctgttctcc

SEQ ID NO: 494301 - DNA, 498 bp, Homo sapiens
  misc_feature (1)..(1): n is a, c, g, or t
nttaacagttcatatgacaaatacccgaatcaacaagcgccttatattgtctaatttcagatccgaaagtaccatttgtgcttgagcctcagcctccattataagagtctatgtgataacaaagtgtggtcatagtccagcccctccatatgtagctcgcgcataattctaaatgaatggcacagatattaatccgaaggtctctgttatttaaagtctgtaacttgttcccaataaggtttctctttcacagtctggggcctaacgttggggagaagccaccctctcctgaaatcccatctttctgtttccttatgtagcccctatgatctgattaattgtcaatcagatgatcaaaagcctcttgaacaaagatgagaatcttggccacatccgtgtggtcacattaataccgtgcacgagtgcacatgctcagtaatttaggctctgcgctgtggaatgaggtctgtttttgagtctcatataaaaacacaacat

SEQ ID NO: 494302 - DNA, 865 bp, Homo sapiens
ctgcactctctgcctagcgtgctcgcaacgctcattgctttccttccctccctcggtcttccttcgtcacgctgtaatggtgattgtggcgctcgcgacagacagggaggcggaggcagaggacacttgtcatggccgcctctaaatcctgtgtgaggcagcaggttggtcagcagccgctgtacctgagctcctgggagtgtgtgtgtggtgcgtgcggctgaggactagcagggcccgggcactggggagggctagccgcgatgggcagcttggcttctgtgcggtctggtggcaccccctgctgcttgggcagcgggtgccatatacctgtggagtcaggcagcaacggcgccgggaggccagaggccggggcgacgccagcggcctgaagcgcaacagcgaacggacagaccccggaggccagggccagtgcggccccgggcagcgggacacccatgaaggtcccggtgctcactatggacatgaacctctcttgcatcacgagccacaagcagccaagactacaaggcgacatcaatatcaaacaacgcagtgaacacaatatgaacaagcctattcagtggctatagctgaggctatcagcttgttgccctagagaagaagaatgtagaccttgcgtacaatagtatcagaaacagagcttgctgcccttgtgcaaccaaggttggccacacacacgtgggcacacgcacacgttggcgcccacccggacttggtaccaaacacgcctggtgggcacccgttgacgccaccaaattagtggttcacaccggcctcgtcagttcaggaccggtgccaacacaggcccccagttgagccacgcttagcacagagtcaggac

SEQ ID NO: 494303 - DNA, 474 bp, Homo sapiens
  misc_feature (8)..(8): n is a, c, g, or t
  misc_feature (96)..(96): n is a, c, g, or t
  misc_feature (208)..(209): n is a, c, g, or t
ccctaacngcctggaatccataccgctggcccccataaaacctagtgtccagtaaattgggaaaaggtttgaaacccccatacagagtatgttccncctggaccacaaaagaccttaaaataaaaaactcctgatgaagaacctccagggaccacaaagaaggcaccctgtagacacgggggccctcccttgaaggtagagggtgggnnggagggagaggatcagaaaaaatagctattgggtgctaggcttacttcttgggtgatgaaataacgtgtacaaacctccccgacacgagtttacctatataacaaagctgaacatgtgcctctgaatctaaaatacaagtttagtaaaaagcaaagttgtattagaagtcagtaagactaggtgtggtgactcatgcctgtaaccccagccctttggaagaccgattcaggaggatcacttgagcccaggagttcaagaccagac

SEQ ID NO: 494304 - DNA, 201 bp, Homo sapiens
  misc_feature (40)..(40): n is a, c, g, or t
  misc_feature (94)..(94): n is a, c, g, or t
ccccccccccccctccggcccttgcggtgaaaccccctcnccccctcccccagggtttttaagtttcccgtttggttggtggggaggtttccangggcccccccccccccccctttccccaggggtgggaagggaaaatttttttcccagggcaaaaaatttttaaaaaaacgggggttttgccctttttttaaaccccca

SEQ ID NO: 494305 - DNA, 154 bp, Homo sapiens
tcacatacacggcccgcagagagtcctggggcacaggaagcaggacaggtcagcctgggtccggggttgggctccatgtgggtcattcataaccgaggttggggtcacgtaccgggatgatgacccacactttctccaggagggatgaggatgg

SEQ ID NO: 494306 - DNA, 952 bp, Homo sapiens
ctacagcttttccatgtaacattagtcttggttctgaacacttctctaacaggcacaatggtcacattttttgcacaatttattccttaattccctctgtggcagctaaaatgggctcttcaccaagtttaaacacaaaatttcatcataacaaaaatactactaaatataactactgtttccatgtcccatgatcccctctcttcctccccaacctgaaaaaacatgagttcctattttttcctgggcagcagggggggatcgcattagcaaccaccacaatgtagtgttgtccaatttcaaacatttggcgcatatggcattttctaacttaggaaagccacaagtgttctggggcccatcatgacatttgggtacgcattaacctggtaccgtttggtgcttccaaatcacttttgggttttcaagaatttcttgatactcttatagcctgccttcacttttgatcctttattctttctattgtgccaggtgcacacagattaccttcctgttttagccttctgtcttgtccacaacattcttacttggtggccatgtacttggcaaaaggccgcatgaaccttactgggtccacctcagggctcaaagggcacccgtggtccctatggaggcgatccccaagacaaaatcctaaaacaaaaatacgcggcaccacatctccctaagggcagacaccgggtaatcaccctttaaaacgtccatacccacagagggggcaaagaacgggcggaaaaaacgtcccatttacccaacactctccacagggggggggagaaaaaccacacacgtgacaacaatcacccgtggtggagacaaacacacgcggtaaccaagcggctggtaacagagccaccccaaacaagacgtagtgagcgagagcgcccacagcgcccgcaggcgacaccaagcacctgagcgagctgttccc

SEQ ID NO: 494307 - DNA, 174 bp, Homo sapiens
tggtctaaaatgtgttgtgttgaaaggacagctgatcacaggcatggaccaggctctgtagggatgtgcgtaaacagagacgtttcgtgaagattcccccaaagcttgacatacggaaatgaaggagtttctggtgtgatcccccccaattcagtgcttcattttgatgtactt

SEQ ID NO: 494308 - DNA, 285 bp, Homo sapiens
tctcctacctgtagtcccagctacctgggagactgaggcaggagaatcgcttgaacccgggaggcagaggttgcagtgagccaagattgcaccactactctccagcctggggacagaatgagactccgtcaaaaaaaaaaaggaattaaggagggagagagttgaaggaaaggaaggacaaaaggaaggaaggagagaaggaaggaaggagaaggaaaggaaaaatttcatagattttgataggacattagagaatttttaaaacattgttcatgaccagtaaag

SEQ ID NO: 494309 - DNA, 404 bp, Homo sapiens
attcgcggccgcgtcgactttattttttttttttctggagacagagtcttgctctgtcacccaggctggagtgcagtggtgtgatctcggctcactgcaacctccacctcttgggttcaaacgattctcctgcctcagcctcctgagtagctgggattacaggcacgcgccaccacgcccggctaattttcgtatttttagtagagatggggtttcaccatgttggccaggctggtcttgaactcctgaccttaggtgatccgcccgccctggcatcccaaagtgctgggattacaggtgtgagccactgtaccctgcctggtatgtagaattttctaacaaatagtttagtggtcgacgcggccgcgaatttaatagtagtagtcgacccgggaaattctggc

SEQ ID NO: 494310 - DNA, 177 bp, Homo sapiens
gatggtgatctcgttgtactgcgtgctagcttgggcatgggggcctccacggtcagtgtgcccggaggggacggggagtagtaaacttgggtggcgtccacaccggggggcagcgtgtatttccgcgtgaaggcaccggagatatagccatgctcgtcctgccgctcctcgtgcttg

SEQ ID NO: 494311 - DNA, 2399 bp, Homo sapiens
  misc_feature (2364)..(2364): n is a, c, g, or t
actaactctacctttctggcttcagggggaggagagttagatcatgcatttgtccgatccatctctgttcacaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgtcaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaanaaaaaataaattgacagcagagaggaacacacact

SEQ ID NO: 494312 - DNA, 462 bp, Homo sapiens
gtagaaggaagggctttattcagctgggagcattggcaagctactgccttaaaatccgagctccccgagtgcacaatttctgtcgcttttaagagctcacaacactaaaatttcacatgaaagggtcgtgattgatttgagcaagcaaggtgtacgtgacgggctgcatgcaccgatggtcagagagaaacagaacagggcagggagtttcacaatgttcttctatagaatgtctggaatctatgaataacatcggtttctaagtcatgagttgatttttaactactaggtttaggccaggcaggcccaggtccagttttgggcctggcgctgggctgcctgtctttgatttcacttccttttttttaaaaaaaacaaaacaaaacaggtactgagtataaaacaatatgagagggtctctctcttccctcgctttaactttcggagggctgaaattctttc

SEQ ID NO: 494313 - DNA, 988 bp, Homo sapiens
  misc_feature (953)..(953): n is a, c, g, or t
gacttggaggaagaagagtgctcattgcaagctgttggctggaacctcacctggcctagcagtgtcctggagcaatgtggccccgtcctcggcctgtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaanaaaaaataaattgacagcagagaggaacacacact

SEQ ID NO: 494314 - DNA, 701 bp, Homo sapiens
  misc_feature (666)..(666): n is a, c, g, or t
atctcagcgcaataatgaacacgcccggtcggacgaactgagctgattctagagatcgaggatagtgccaagatgggagatgtctcgtacggctacagttactggtatctcagtcacacagtgatgtccggagattcggagcggcgatatctggatctaagtctccgctccgatgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaanaaaaaataaattgacagcagagaggaacacacact

SEQ ID NO: 494315 - DNA, 163 bp, Homo sapiens
aggcatgaaatgctaaggttttaaaatatgtcatggattggaagaatggcattgataaagaacaaagttcagttatggaaagagaaacacagaaggaagagacacaataatcagtcattatgtattcatgtgagaagtcagacagtaagatttgacggggaaa

SEQ ID NO: 494316 - DNA, 454 bp, Homo sapiens
  misc_feature (419)..(419): n is a, c, g, or t
tctgattggtcagcctagacgaggcagcttatgttaatttgcacaaaagtacagcagtactagcagttgccctgtcactgttttcttttcagggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaanaaaaaataaattgacagcagagaggaacacacact

SEQ ID NO: 494317 - DNA, 1209 bp, Homo sapiens
aagcacaatcaagaactgacatctcagtccgttagctgcagaagaataaatgcaatctattagaaaaacaattggacatacatgcgaaatatgataaagcatgccgaaactggacgaggacatctgtcttacgcacgaacaccaagtttcccctacgaacagacgaaacgacaaccctgactcaaacagcatgttcagagccaaccttgaacacaattggatcttcttgacacaggacgtataaccaaacttaccacaactgcaggcccattgccacgaaaaacaaaactgcaacgagtatggaacgcaacaactaccattgaacgacagaaccacggacacacggacaaacgacactgacaacggctacacgggcacgctcgacgctgcgacagcacctcggctcctacgcacaaccaacacctacgacctttacctccttcacgaaacgactacaacgggaccaaaccactaccccgaaggactggctatacgcccaacagatgcccacaggcaaagcgaaaacttccacacaacacacacaaacggcaaacgctccaaaaacagaacacaacccccaagacacacaaacaggcggaacgaatcggcacaccgcgcaagcccaaggggagaaagcacacaacgagagagatgccgcaacggagggcccaacaaacaacagatggcgaagcgggaaagagataacacacaccgcgggaggcacgaccctaaacgagaccacgacacacagcgctcaccaacaaaacaagcgggagcaccccccagcattaacaaacaacacatcgggagcgacctggcgagcacgggctcacaacataaaaccaaacacaaacaccaccatgaggcagaaacagaaaaagagacacaaccaggctcacacagacaggacacaccagaaacaaaacaaacagacaaaccgctacgacagaaaggatataaaaccactcaaaaaccagatccagccaacagcaaaaaaacgggggaagtaggggacgaaacaggaacgaacttccgcacacacgaacagtcaaacaaacaaataaacagcaaacccgggtacaacgcaagctacaacccagatacaagaagaacaaaatccaccagagcgaaagacacagcccccgacgggcaacaacaataacggacctggcaaagaccaaaccaaaacgaggcaacaacacaaagata

SEQ ID NO: 494318 - DNA, 599 bp, Homo sapiens
attgtgggaagctttgttcttttgctctttgcaataaatcttgctactgctcattctttgggtccacactgcctttatgagctgtaacactcaccgtgaacgtctgcagcttcactcctgaagccatcgagaccacgaacccactgggaggaaaaaacaactccagacacaccgccttaagaactgtaacactcaccacgaaggtctgcagcttcactcctgagccagcgagaccacaatcccaccagaaggaagaaagtccaaacacatccgaacatcagaaggaacaaactccagacacgctgcctttaagaactgtaacactcaccgcgagggtcagcggcttcattcttgaagtcagtgagaccaagaacccaccaattccggacgcagtaggatgatggttatcagagggtaggaaggggtagcagtggtgggaggtagagatggttaatgagtatcaaaatatagttatatacaatggaataagatttagtatttgatactagatctagttttggctactacaacaatgtgattactgacggaagagagagaccttctcatgtcgttttatactcagtacctgttttaagaag

SEQ ID NO: 494319 - DNA, 2290 bp, Homo sapiens
  misc_feature (2255)..(2255): n is a, c, g, or t
gagactaactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgtcaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaanaaaaaataaattgacagcagagaggaacacacact

SEQ ID NO: 494320 - DNA, 1107 bp, Homo sapiens
gttagaaagcctgatattgcctgactcggtaacagctcagagcaggtcagaactggggacagtctgggccgtccttactgcctgcattgatcgctctgtaatgccagcactgtctctggaggaaccactgagcgaggtgaatgaaggacgagggactcgtgtgtgctaggaagaactcagagcctgtggagagcccccattcactagaagcactgagagcatgcggtcccctcgtcagggttctgaatttcctgctgggtgttcacaatagatgctatgtgtatcttataactctatcttagctttattcccgcgcagcgttctcatgagcaccggtgggagtaagatcttgcattctcttgaacagttgttggagggcttgcgcaatctatctttgtgttggccttgatctagcgcattgagccatcaaagcccccggtcctatagccatccgttctttagacaccttgcacacccagagttcagggtacttgtgtggggaacactttgcagcggtgaatgagaagggcacgcgtccaacgggggaggggtatgacccccaagcaaaggagaccgagaattgacccccgtaaaccaaaaggtttggccgtggccctttcttccagggagtttggcccaaagaccattatttgattatttgacgccggttatgtaccccaataaggcatggaagcctcccgcccttgatatgatccttggaacccacacgttgggggcccccttggttcatctgggtggaagttcttatggaccgatatcccagaatacccaatgtcaccccttatacccacggactggcgccgttatgtcctcttaagccaaatgagcaatggcggcatgtctccatggaagttacagccagaccaatgtaagtctaaagccttgtgcggtcttataccctgtgttccctacctttgtgcgcaacacaaacgagcgcgggttctagattaaaaacttcgagtttctaacgccaaggcaagccaacagaccttttgggactaccggctgcccagattctttacctgtgcgcctacgaagtcaaaagtctaagtgggcccgcagtcgaaggaattggtaagttcacat

SEQ ID NO: 494321 - DNA, 1418 bp, Homo sapiens
  misc_feature (1383)..(1383): n is a, c, g, or t
actaactctacctttctggcttcagggggaggagagttagatcatgcatttgtccgatccatctctgttcacaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaanaaaaaataaattgacagcagagaggaacacacact

SEQ ID NO: 494322 - DNA, 337 bp, Homo sapiens
  misc_feature (39)..(39): n is a, c, g, or t
  misc_feature (43)..(43): n is a, c, g, or t
  misc_feature (66)..(66): n is a, c, g, or t
  misc_feature (110)..(110): n is a, c, g, or t
  misc_feature (113)..(113): n is a, c, g, or t
  misc_feature (129)..(129): n is a, c, g, or t
  misc_feature (133)..(133): n is a, c, g, or t
  misc_feature (140)..(140): n is a, c, g, or t
  misc_feature (161)..(161): n is a, c, g, or t
  misc_feature (163)..(163): n is a, c, g, or t
  misc_feature (175)..(175): n is a, c, g, or t
  misc_feature (177)..(177): n is a, c, g, or t
  misc_feature (217)..(217): n is a, c, g, or t
  misc_feature (228)..(228): n is a, c, g, or t
  misc_feature (242)..(242): n is a, c, g, or t
  misc_feature (275)..(275): n is a, c, g, or t
  misc_feature (280)..(280): n is a, c, g, or t
  misc_feature (291)..(291): n is a, c, g, or t
  misc_feature (300)..(300): n is a, c, g, or t
  misc_feature (304)..(304): n is a, c, g, or t
aaaaaaattggctacattgaccataattaaagttaaaantttnccaatgatgtacagttttatggntaaagttgctgtggttggttgcattacatgacacagaaaactgnccnctacctcacgtgaaanaaanattttanatggttttactaaaaataagncncatgtatctggncncctagtttacaaattttgaattatatttattgaaacatgncatactgtgcnctgagcttataccncaattgtattttgtgctgttttccattttcatnccttntaaataacttntataaattntggntcaaatactaaataaaaacttttaatgccaatt

SEQ ID NO: 494323 - DNA, 2045 bp, Homo sapiens
  misc_feature (2010)..(2010): n is a, c, g, or t
gagactaactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgtcaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcaagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaanaaaaaataaattgacagcagagaggaacacacact

SEQ ID NO: 494324 - DNA, 1810 bp, Homo sapiens
gagactaactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgtcaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacggtacgtcctggccagtgggggacagaaccagagcactgcctggttcaagtttcagctctatcacttcctagttatagaagctttggggagttatttagcctggctgtgcctcagtttcatcaactgtaaagtggagaaataatagtacctactccacaggtgtattgagaggattgaatgagttaatgtgttgaagtgattaggacagtgactgcacacagtaagtgctcaataaacatcagcttcaaataaagaaagcaattcatggtgatagttctccattttacagatgggaaaagtagggccatagtagggattgtctcagccagtaggcatcagcattgggttcagaaactagtctatttgtctccagtggtcctggaaggcaaggtctgtatccttaatgtacagagaatcaggacctcacctacagaggcctcctcaaatgaaacccagaggtaaatgtttgtgtgagcagagcattatctcctgccacctccctcattaccagaggaagaaagaaagagaaagagaggaagaaagaaagagaaggaaggaaag

SEQ ID NO: 494325 - DNA, 128 bp, Homo sapiens
agtgactctagcaggatcctttgtcatccccttcgtgggcggggtccaggagggctggaggttaattttgggagcgttccctgggagtagtgttctggggatcagtgctcctctgggccgggcccgaa

SEQ ID NO: 494326 - DNA, 392 bp, Homo sapiens
aggcctttttggggggggccgggccccgggaccgccccggccggccggaatttttggcccggtttttttatagcccaaaaaaaaggatatccccttttttttggaacaaaaaagaaccggcccccccctttggggggtgtggccccgggggcccccttttttaaaaggccggtcccttttaaaaaagggggcccataaaaaaattcccccctttgccggcccggtggggagggggccgggggtttttttttttgggggccttttttaaggaaaaaaataataccccaaaggatcttggggggggggttgtaatggccccctggaacctttttacttttggaaggtcttccgtttcttttaaccctttttttaaaaagggttttaaaattcca

SEQ ID NO: 494327 - DNA, 338 bp, Homo sapiens
  misc_feature (12)..(12): n is a, c, g, or t
  misc_feature (124)..(124): n is a, c, g, or t
  misc_feature (168)..(168): n is a, c, g, or t
  misc_feature (338)..(338): n is a, c, g, or t
tttccaatgaanattcccaacctagatgcaaaagaggcatgagtaacccttgggcaaacaacataacaggattgatttaaaaccccacataataatgagttcctattaagcttatgatccctgnccaggtgttggtcgtcacgcctgtaatcccagcactttgggagncggaggtgagtggattacctgaggtcaggagttcgaaaccagcctggccaacatggcaaaaccctgtctctattaaaaaagtacagaaaattagctgggtgtggtggtgcgcgcctgtaatcccactactctgtaggctgagacaggagaattgcttgcttgagccccan

SEQ ID NO: 494328 - DNA, 252 bp, Homo sapiens
  misc_feature (235)..(235): n is a, c, g, or t
cctggggttcaaaggcatctgcatctgttgagctagcccagaaggagaatctgtgatgcggatgacgtgaaggggtggagcgacccggatatggaagcatctttgcacaatttttacatgtacttattggcacaaattcgggcagcctccagggcttcagaggacagctgctcaaattcatctgacaccatgtggccataaagcggaaactcatccacttttaccttctctccgncccaggtcaaaaatgcg

SEQ ID NO: 494329 - DNA, 505 bp, Homo sapiens
gtctcagttcatcgctcaggctggagtgcagttgttgtgatcatggctcactatagccttgatctcctgggctcaggtggtcctcccacctcagcctcccaaatagctgggaccacaggtgcataccaccacaccagctcatttttttttgtattttttgtagacacgaggttttgccatgttgcccatgctagtctcgaacccctgggctcaagcaatccacctgccttggcctcccaaagtgctgggattatagtgaggtatctcactcagcctcaagctaattatttaaaaggcaaatgatcctatgtaatggaaaatgaatctgtggtattgttattctcattctgcagtattacttgccaatcttactactgaaaatagaacttttcttttgaaattctgattaatttgaggtgagattaaacattaatccaggcttactttgtattttcagtaacagcatggagttggtacagtactttacagagtgaaatattattta

SEQ ID NO: 494330 - DNA, 259 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (167)..(167): n is a, c, g, or t
  misc_feature (194)..(194): n is a, c, g, or t
  misc_feature (222)..(222): n is a, c, g, or t
ccaattngncntgccgggggattcctccagtttttccactaatgtcttaaaaaatctcagagatgggctcttgctgaatattgcccaggttagtcttgaattcctgcctcaggtgatcttcttgcctcggcctcccaaagtgctgggattacggcatgagccactgngcctggctacattctggatattaagcntttgttaaatatgatttcttttcctttnaggcagatgatgctttttcttctctctttttaaaatt

SEQ ID NO: 494331 - DNA, 404 bp, Homo sapiens
  misc_feature (134)..(134): n is a, c, g, or t
  misc_feature (152)..(152): n is a, c, g, or t
  misc_feature (202)..(202): n is a, c, g, or t
  misc_feature (214)..(214): n is a, c, g, or t
  misc_feature (354)..(354): n is a, c, g, or t
  misc_feature (365)..(365): n is a, c, g, or t
gcgctgtgccctgggcttgtgtgggctgccagcagctgtcccataaaggacctgatcgctggtgccagactgggattggggctgggtggaaactgctcttgggtcccccatggacgcacataggtctggaccangacgtggggaggccacanggtctctagagctgttatagggactcccagggacaccgagcttcttttcnatcctcctccangcactgtgacgccttggtgatgcggtggcggtgccaagtgccggcgcagctggcaaggcatccctcctccatgattgatgggcacccagagagcccagagctgctgtgagactgggtctgggacacttaggccagagggngattcttcctngttggggctgcaacagagccaggcagttccacagaggca

SEQ ID NO: 494332 - DNA, 250 bp, Homo sapiens
aggttgggagtttgagaccagcctgaccaatatggagaaaccccgtctctactaaaaatacaaaaaattagccgggcatggtggtgcatgcctgtaatcccagctactccggaggctgaggcaggagaatcacttgaacccgggaggcagaggttgtggtgagccaagatcacaccattgcactccagcctggacaggtaatgtctgtcaaaaaataaataaataaagtcaaaagtatgaaaaagttaaa

SEQ ID NO: 494333 - DNA, 498 bp, Homo sapiens
  misc_feature (117)..(117): n is a, c, g, or t
  misc_feature (200)..(200): n is a, c, g, or t
gcaagctctgagtagctaggaattacaggcgcacaccaccacacccggctaatttttatatttgatcctttttatatttttagtagagatggggtttcaccatgtaggccaggctgntcttgaactcctgacctcaggtgatccacacacctgagcctcccaaagtgctgggattacagatgtgagccagcgcacccggncaaaaaattatttttagatttgacaaataaaaatcgtatatatttatggtgtgcaacatgatgtttggaagtatgtatacatggtgggatggctaaatcaaactatgtgtgcattaccttacatacttatcattggttggtagtgagaacacttaaaatctactctcagcaatttcgagtatacaatacatagctatggtagtcacctgggtgtaggataggaggcctgttgaacttattccttctgtctaacagaaactcggtgtccctttgacccatcatctccccactcccctat

SEQ ID NO: 494334 - DNA, 1311 bp, Homo sapiens
tggaaaatgaaatgtttcccatcataggggattctaaagcacgttctccacgttatgcggggtgcaagcgtggagtgctcttgtgggcaataagtgtggtaaccacgttgtgggcagtggaatagcacacagggtgtgggtgctctttcaaaaaggccaaccaaaataggccctcacgtgtgccctccgtgcaaagccaccgaatagcgtgcgccctctgggaaagccgcagaactctgtggtttataaagtgctccgtggagccaatttctcgtcgccaccagaagcccgtggaagagggaaagtttgtgcaaatctcagaagagttctcagtgtggcacttcgtgatataagcgctctctaagttctccacgggagaggcgcgccacacaagagtttcacccagaggggcctgtgtgatacagaagaagtagagagggtctatcttctctatcacaccccccctctccagagagtcagagagagggcggcacactctctgtgtgccagaaacgcgagggtcttttgtgtgggtgacgcccttatgtgtggggtctctccccgtggagaggggtgggacgtgttatacaacacacaccacgggtggcgccagataatatttaggcgggcggggccacaagtgtcgttgtgtcttttgtgtgtgacaacgagaaacgctcctgatgaggtggtaccacagaagagaagacaactctctctcatgttaaaaatgataacaccccccgcgtctttatctccctcctgatgccgggagtggtggggaggagcgcccttccgagagagaagaactggccgagaacagaacggtggcgacgcgaccagctctaggggccgtgttatagagaggagtaggagaccacgaacaggacagggggcgaacagcacactcaaagagtcccacccacgaggaagagtctcttattgtgtattatatattctatcgtagctactattactacttgcctacacatctatattccccacacagagttgtgattctaagagagcggcaacatcccaccacgacgaagaagcaaccagcggggcatcgcgggaccaacaaagcagcttcatctcacccaaggaacagacagacggcgggcgacacaaaatgctcgtcgccccaccatataaaaaaaggaggaaggccccctccagctgagcagtgctgggctgtgtgcgacgcacgcctctctaatatacgcccccactagaaccaagaagggagggcatactgcggggaagacacctaccagggagagggggaacaccaccccctagagactgaag

SEQ ID NO: 494335 - DNA, 239 bp, Homo sapiens
tctttaaggtcataggtttgttagtttaccaacccaaaatttgtaatagtggaacccgggccccaaaatataagcagcttgaaactggctttcccaatcttgaaatttggccccaagtgttttatatatgcagatttaatgtaaaatccagaacttggactccctcgttaaaattatttatgtgtaacattcaaatgtgggcattaaatatgcttccccagtaaaatttgaaaaactga

SEQ ID NO: 494336 - DNA, 99 bp, Homo sapiens
gccagcaccaaccagacatctatgtacctctgtgccagcagtatgggacagggggcttccactgaagctttctttggacaaggcaccagactcacagtt

SEQ ID NO: 494337 - DNA, 505 bp, Homo sapiens
tggttactctagcggatccctgaaaaggtagctgttactgctgcatgttaggtaactggccgtcacttcatacaagtcataacttttccttatgaagttatgatcttcaagtgagagatggagggactgcttctgcccaagattacatgtatgtaatctaggacttcgactgtcactagatatgtttcaactatcattaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccctaactgtctcagctgggtttttttttaatgatttcttctggaaaggtgatagttttagtgtttccatgccttctttggtccatgttcattataactggtgactgtcgcatta

SEQ ID NO: 494338 - DNA, 485 bp, Homo sapiens
ccatgctccgggagaagatggagtacagtgccagctgcagtgcgtgcctgtgccctgcatccccaacaatgcccccgcctgagtacccctggtccaatggaagagtgtgatgcaatggggctctgagtgcagtgaccaatgccagccttcctccctgccatgtgccatgagccagggtgcttgagtgcatgtgtgccagccaatggccatcagcatgtctctggactgaccctgccgtgctgtcaactggtggtgcctctctcgtgcccatccatctctggtgaaccctgacctgactagtgtgaatgtgagctgggtcaaaaaatgatgcctgtgaaggagatgacctgtgtcttgaaatgttttccctgtgaagacagcattatagatgagacgatgatgatgatcagtgaatctagcagaatgcagaatgatgtgcatggcctggatgtgcacagaatgagtgcctgctgatgttggcagca

SEQ ID NO: 494339 - DNA, 914 bp, Homo sapiens
  misc_feature (340)..(340): n is a, c, g, or t
gtgagcttgcgagaccttctaatgggagcgtcagcctggaatggggctctgaaagtcccggagggtcccctattgatggcggagggagacgcggctggcggaccggagcctccatggcgggaggatgagatctgggttgatggagaatcttcggcaagacggctctacgcctgaattaccgaaaaggttctctcttgatgactactcgctgtgcgaccgacaggatctttcctctctttcgccacacaagatcctggtggatccacggaccttggaatcagaactgaggcttggtcagccgtggcgttgcaggccgttgtgtgagccgcagtgtcacccntggggtctgctgccggtgggtgttctagtctcgcgggaaagatgtgagcttgtcgcggtaggtggtgaaccgtcaccttgcaggcgagagctctcctgtgacttaccggacccttctgcgcaggccgtaacgtacacgaggctcaacgcggaaagcaaaacgttgcttgatatctttcgtacgcgtcaaacacgtgcctatcgtagtaggagtagattcgacgagctttaccttcccggagcgtagggtcgggggcttccttcccagagcggcgcgcgatagcctcgggagggttgcgtacctctgccttttttacgctcgattgcggagagagcccaccaccggacgtctctgagggaaacgccatttcggaaacgcacgaacagccttgcgcatgctggcccttcgagggtccttacgctttttacccctgattttcgtccttgggtccttggtcctattaattccttgggcttttcctttgggttgcgaatccccctaacctttggtttcccctttgtcgggatcattccactttaatggaatcccgaaggttattcccacgaaggcccct

SEQ ID NO: 494340 - DNA, 166 bp, Homo sapiens
actctagctcggtacccctctgggcactgtttggactctgagcactgtttggactctgggcactgtttgggctctgggcactgtttggactctgggcactgtttggactctgggcactgtttggactctgagcactgtttggactctgggcactgtttgggctctg

SEQ ID NO: 494341 - DNA, 111 bp, Homo sapiens
  misc_feature (46)..(46): n is a, c, g, or t
  misc_feature (51)..(51): n is a, c, g, or t
  misc_feature (58)..(58): n is a, c, g, or t
  misc_feature (68)..(68): n is a, c, g, or t
aaacccacccatgtcaatgtgtctgttgtcatggacggtaggtggnacggncacctgnctactgtagnccgcccgcctgtccccacccctgaataaactccatgctccccc

SEQ ID NO: 494342 - DNA, 283 bp, Homo sapiens
acgggtggcgagtgggcacagaggtgtagataagtcaggttggaggggatgtgaagccttcatgtgtccaggatcagtgacgtgcacgtgacactcactgaagaattgcatgctgaggtcacgaggttgctctcgggagcccgggctcgtcgggtcctagcccatgaagcaagctcggccccacttcaaatccaaattttctgcggggcttcaccagaagtcggttgaacaatagatgtcgcacgatgggcaccgtgctccgacttatgggggtgtcgatctc

SEQ ID NO: 494343 - DNA, 194 bp, Homo sapiens
acgcagtgggcatttcagctgtgcatgaatttcagtatatcagtagctccttttaagtgtataatcaaaacagtgcttcaaagaacaataacggtaataattataaggagaggtcaagagggtacagggtctgttaatacattcacaacaagaatgaatgaattgggtcaaatatcaaataagtagatgcaatt

SEQ ID NO: 494344 - DNA, 373 bp, Homo sapiens
  misc_feature (87)..(87): n is a, c, g, or t
cttacacgcaatctttgtcttcgctgggtattgctttgcccttgcctgtgatctttgtggacccttatcaggagatttctgatttgnccgtgtctgtttcctcagaagcatgtgatctttgttctccttttgccctttgaagcatgtgatctttgtgacctactccctgttcttgcacctccctccccttttgaaatccttaataaaacttgctggctttaaggctcaggtgggcatcatggtcctaccgatacgtgatgtcacccccagcagcccagctgtaaaattcctctttgtactctttctctttatttctcagctggctgacacttaaggaaaatagaaagaacctatgttgagattgcggtgtttg

SEQ ID NO: 494345 - DNA, 172 bp, Homo sapiens
cacagttggtgggctagtaatttaggctgtgggatattcccatcagaacaatgctgctttaagaggagaaaagtcccgactcgttattagcatacatctgcatacacatctctagggcgcgcgcgcgctcacatacactcacattcactcacacacccccacactcttcatc

SEQ ID NO: 494346 - DNA, 334 bp, Homo sapiens
  misc_feature (22)..(22): n is a, c, g, or t
  misc_feature (114)..(114): n is a, c, g, or t
  misc_feature (121)..(121): n is a, c, g, or t
  misc_feature (159)..(159): n is a, c, g, or t
  misc_feature (165)..(165): n is a, c, g, or t
  misc_feature (264)..(264): n is a, c, g, or t
  misc_feature (306)..(306): n is a, c, g, or t
tagggggccaattatggtaggnagcattgcagggtcagaggtctgagttcggaatttgagctggggcaggtccctgttgagaggcacttctggtctgaagatagctccattgancccctgnagttcaggtgtagtgcctataggaccaagctcacagcnatggtnaggggcgcctgctagggccacggccaggaggcattccccgaagccttgctcccctggtgcagcagggctgtgggaggtggtgacattgaggccagcttntttcaccagaagcttagcgttcaccaaagttcaaatccagcnatagcttggaagcctctataaaaggagg

SEQ ID NO: 494347 - DNA, 135 bp, Homo sapiens
tgccctgggtgaattacacccttccccgattcaagggccagctgagagtcacgggagctgcgaaccggacgtttccaaggcatggccctctctcgggacgaacccattccacctgtgcgtgttgttgccggtagc

SEQ ID NO: 494348 - DNA, 133 bp, Homo sapiens
cagccccagtcttgtttttagcagcattcacccgtgtctgttcactgaccaaagaagaagagtttgtcaaggttaacagttgggcaaaagctctggttcctctttaagtggtaatgcttcataccaactttcc

SEQ ID NO: 494349 - DNA, 445 bp, Homo sapiens
gcagggattacaggtgcatgtcaccccgcttggctaatttttgtatttttagtagggacagtgtttcaccatgttggccaggctggtcttgaactcctgacctcaggtgatctgcctgcctcggcctcccaaagtgctgggattacaggcgtgagccaccgtgcctggcctttttgtttttttttttttttttttaacaaaaacaactccagtttgattctggacatgggtcgaccgcggcccgtaattttagtcgtgtagtcggcccccgggaatttcgggccggttccttggagggcgttccagggttttccttttagtgggggccgtttaagaggtttgggggaaatcatgggcccaaggcggggttctcgggggggaaatgtgttttccgtttacaaattccccccaaaatatcggggccggggagcttataggtggtaag

SEQ ID NO: 494350 - DNA, 645 bp, Homo sapiens
  misc_feature (261)..(261): n is a, c, g, or t
gggtgcggtggctcatgcctgtaatcccagcactttgggaggctgaggcggtcagatcacaaggtcaggagttcgagatcagcctggccaatgcagtgaaaccccgtctctactaaaaacacaaaaaaattacccgggtgtggtggcgagcaactgtagtcccagctacctgggaggctgaggcggaacaattgcttgaacccgggaggcggtggcggaggctgcagtgagccgagatagtgccactgcaccccagcttgngcaacagggcaagactctgtctcaaaaaaaaatcccagcactttgcgaggccgaggtgggcagatcacgaggtcaggagatcgagaccatcctggctaacacggtgaaaccccacctctactaacaatacaaaaaattagccggccgtggtgttggccgcctgtagtcccacctactcccgggaggctgacgcaggagaatggtgtaaacttaggaggccggagcttgcagtgagcacagaattgcgccattgccctccaagcctggccgacagaagtgagactttatcataacaacaaaaagggaaaacacggaaatggttttacatttccttcctttggatttttataggataggccggttgggcattcctttcgctttgct

SEQ ID NO: 494351 - DNA, 105 bp, Homo sapiens
cggctgcggcacgggagattgtgaatgaaggggggcgagcggactgtgaagtattaagggagcaaagctgcccgccgcgggccaggcgctctaggtaaacaagaa

SEQ ID NO: 494352 - DNA, 840 bp, Homo sapiens
  misc_feature (13)..(13): n is a, c, g, or t
  misc_feature (95)..(95): n is a, c, g, or t
  misc_feature (119)..(119): n is a, c, g, or t
  misc_feature (122)..(122): n is a, c, g, or t
  misc_feature (160)..(160): n is a, c, g, or t
  misc_feature (174)..(175): n is a, c, g, or t
  misc_feature (182)..(182): n is a, c, g, or t
  misc_feature (185)..(185): n is a, c, g, or t
  misc_feature (198)..(199): n is a, c, g, or t
  misc_feature (211)..(211): n is a, c, g, or t
  misc_feature (219)..(219): n is a, c, g, or t
  misc_feature (221)..(221): n is a, c, g, or t
  misc_feature (301)..(301): n is a, c, g, or t
  misc_feature (369)..(369): n is a, c, g, or t
  misc_feature (393)..(393): n is a, c, g, or t
  misc_feature (396)..(396): n is a, c, g, or t
  misc_feature (443)..(443): n is a, c, g, or t
  misc_feature (487)..(487): n is a, c, g, or t
  misc_feature (589)..(590): n is a, c, g, or t
  misc_feature (836)..(836): n is a, c, g, or t
ttctatgcaaaantatgccttcccactgcttaaatgatatatgatatgatacacaaaccagttttcaaatagtaaagccagtcatcttgcaattntcagacataggtaaaaccctatcnganaccttacacacacacacacacacacacacatgtgtgcncgccaatgacaaannggggttnggnctctcctaaaatnngagcatgggggnccttggtngngggggggggggggcactgtgtcacccctccctacaatccaggtagtttcctttaatccaatagcaaatctgggcatattnggggggggtgattctgacagccacgttgaaatcctgtggggaaccattcatgtgcacccactggtgcnctgggagggtgccaatggtttttnggncccacttctgctgctgtgtcttccacatcctcacatagaccccaganccgctggcccctggctgggcatcgcattgctggtagagcaagtnataggtctcgtctttgacgtcacagaagcgatacaccaaattgcctggtcggtcattgtcataaccagagaagtgaattctgccccctggcagctgcttagnnggagggctcaccccaatcttcataaattttctcttgtggggctttttgagttccaggagggcataatcataatccatgccgatgtcattggcattgcccttgatccaacccttgggcacatgggtgcgtttcacccggatccactgaaatttcatctgctcgggcatggctgaagtggagtcgttggcccctcgaacaccatctttaaacttgggctttaggaagcccctcgcagcttctgggttncttt

SEQ ID NO: 494353 - DNA, 295 bp, Homo sapiens
aactcctaagattcagtgctccttcccagtgccatgcgtccagaatgctatcgttatgggaaatgtgtacccacaggtgggaagatacatggtatgcaaggttcaggtgcttttggctacctcagttccctcatcatcattatgctaataggcagctctgtatccagcacctacttcactagccaggcaaggtcatatgaagtgctcaagcccaggacctattacatcataagctctcaataactgatgcatacttatacagagatttaccttcttaacagagcttagacaagga

SEQ ID NO: 494354 - DNA, 114 bp, Homo sapiens
agcgatcccctgaaacttcccggggcctcactgtcaacccaacacaggcatgctcataaggaaaggttaaaaaaagtaaaaggaactcggcaaatcttaccccgggaagttcca

SEQ ID NO: 494355 - DNA, 870 bp, Homo sapiens
gggcgacggggtaggggttggcgctcaggcggcgacatggcgtatcacggcctcactgtgcctctcatgtgatgagcgtgtctggggctcgtccggttcttggtgcctgcttcatccctaagggtcctaaccggggagttatcattaccatgttgttgacctgtcagtttgtgctatctcttttgctgatgtgcaattctggcccaaatcaaccctctctttgaccgcacttgacaaatggacaccatctgtatctgaagtatcatgtgccttgaggaagaagacatgcctctacagtgctcagtctttgaggtcaccgagaagagaatgccttctagatgcaaaatcacttcaaaacagaccattttcttgattgcctgtttgtggccattagctgccttaaaagtgttaacagcaccatttgaaatgccttattctacaatgcagcgtgttttccttggcttttgtgcacttgtgaattacgtgcctccataactgaatgtgccgattccacaaaaagattatgtactcttctgagatagaagatgtgtctctgagagatagtttatctctcttggattttgtggattgaagatgggtcctgccttctcacgtgggaatcagtgaggtgtttaggaactggtgcaagaaacagaatccagggggggtcaggcaggggaaacccggtagggggagagcattaacgaatggaccaataattcggtgggtttctttgcacttgaaaaatttctttaaaaaaaaaaaaatttgggctgccgagattaaacgtgggggcgcggagaagtagttcaacagggtaggggtacaaacgggggtgaagtgtgtgttcattccgtgggcgagagaaga

SEQ ID NO: 494356 - DNA, 355 bp, Homo sapiens
gaaagaccccatgcagacgtgactgtctttaaagcttcagtaatgttcacagaagcattaaacaattgttacgactcttctggctgagaattctaggagtccatataggtgacagcttataggaagggacatgggagctttcaaatgtggcattggaatcctgactatgtccccaaattggtgactgaggctttcgcaaggatactgctcattatacgtgcccagatatccatctgtacaataggtgtttacatgaggattgtatgcacggtactagccttgccttgtggggcgacttgtccgagttactgagctactgatctattatttcaggtgcgctgatatgttacttgcg

SEQ ID NO: 494357 - DNA, 116 bp, Homo sapiens
  misc_feature (2)..(2): n is a, c, g, or t
tnttagaccagttcaggtgaagaaagacctggaaacttctgttaactatagctcagtaggggctaaaagcgtgttaatcggcataaaaaggcaatgagatcttagggcacacagca

SEQ ID NO: 494358 - DNA, 882 bp, Homo sapiens
  misc_feature (44)..(44): n is a, c, g, or t
  misc_feature (79)..(79): n is a, c, g, or t
  misc_feature (82)..(82): n is a, c, g, or t
  misc_feature (89)..(89): n is a, c, g, or t
  misc_feature (115)..(115): n is a, c, g, or t
  misc_feature (127)..(127): n is a, c, g, or t
ccaacacacaactcttactgatccactttatacattactaccgnctcccgcgttgacgccatcaatacaatattcctcntgngttaaanatctcgcacgcacagcgagctatggngcgaagtagagnaacagtcagtgtattcttattcgtccggtaacaatctacatagatgcgactcggaaaaatcaatttaacgattacactagcaagaaagaaagttgtcgtgggtctctaattaatagatttaccctttatagaacatattttcctttagatcaaggcaaaaatatcaggagcttttttacacacctactaaaaaagttattatgttagctgaaacaaaaatgccagaaggataatattgattcctcacatctttaacttagtattttacctagcattccaaaacccaaatggatacaacatgtttaattaaatttcacaatgctaaggctctaacagataactatgagcatataagaacaatggcctggatcaatctagttctttacttaatcaattcaaattctgttccgctataaaggtgtgggactatgtatcatctatatctttgctatatctaaagaacatgataagattttaatgtctttatcgcgaagaatatgaattaggaagaaaagaaattgaagtacggaaagcagaatagaagagtagtatattcgggcagcggatagtgataaatttacctaccaagaacacaactctctactattagacacccactccatctgctcataataaataattaggtataattctatgttacgagtgtttgcttataattaaactctcaattatcaaagaatcaaatccatataatacgcatgagtatatacggtattttataaactacaataatt

SEQ ID NO: 494359 - DNA, 929 bp, Homo sapiens
  misc_feature (2)..(2): n is a, c, g, or t
cnctgggagtagctggactgtgtcgttgtgtctcacatcactgcgcaagcgagtgctctttgtactattttcgcctaagtggtccgccgcgggtgctccgccccccgtgtcgtgttgtctctgtttttgggggcctccccctcattttgggctgggctattacttcccttgtgagggtattctctgctaccccccgagggtcctcccctccccggccaaagggtggttttcggcctttcacagcgatccctcttctccgggcccccccggttcacacaataccgcgtgccccgcgagacacgagcgtgtcctctacccccccttggggggtctcccggacatcccaaagaggctcccgcggagccccaccaaatccctcgggccacccccgtgccccacaacgagtatcggggcaatgcccaaggggaccactcactcttggcgttcttttccaaatcaacaaggacatatctgtctttgatcatccactcggcgtcatcctccttattcttccgaggagggttgccgcacggccctttcctccgtgctttcccggggggcactctgcatgcgagatacccccttggagggctcccccctcacggaggcgtcaccatcatgcagcgcacgacccccgtcatgttccaaccacgatatgaattcttatttcccccgcgaggaagttcttccttccctggtcataatcaaaaccgcacccatcccgcggcctcttctcttcacgcacacgaataggcatagggttgtgtaatccccttccttctatgctctcgcactacgatggaagttattttcatagaaattaacataccacaacagtcttttttatacacgccttgttaaaaataacacaacaaaaaacacccaatgttaaaaaaaagcggcccttccccctagagaaccacaaaaca

SEQ ID NO: 494360 - DNA, 584 bp, Homo sapiens
  misc_feature (17)..(17): n is a, c, g, or t
  misc_feature (211)..(211): n is a, c, g, or t
ctgctcagtcgttcttnggggagaaccgtctgcgcagcatggggctagcagcctggtggagttcaggaaaggggggatctaggcatacatacatacatacagaggaaggtatgagaagggacccccgtttgaatttcccagtcgccccatttgcaggaaggtggaggccacagcttgtgccctcccactcaccagccccatctcctttcanacatgcctgcacttgctctccctgcagccagcatccctcacggctaccatttccccctggccagtgaagaagcactaagaggcagacgctacaaccatggcggcaagaggcctggtccaaagacaagagttcaggtccccactaagaagctctatgacttggccaggtgcggtggctcacacctgtaatcccagcactttgggaggccaaggcaggtcaagagatcgagaccatcctggccaacatggtaaaaccccgtctctactaaaaatacaaaaaattacttgggcgtggtggcgcactcccgtagtcccagctacttgagaagctgagatgggaggatggcttgagcctgggaggcggaggttgcagt

SEQ ID NO: 494361 - DNA, 879 bp, Homo sapiens
ccgacccggttgttgcggaagcccccttcttggggggtacaaacccgcttgtccccggcccaccccggtgtggttgaaacagcatgggggcattgaatgaagaatttgcggctcagaatctccttaggggaaaaggcgtaacggccccccggtgtcgtcgggctacctcgactcccccacagttttcggtaggtacctaggatataaaccgtctgcacaccctctgtgaagagactcaatcaaaggcggaagaccaccctttgttaccacaccccgcaaatcgacttggcgctctgtctcccccgcgcccgctaataacacctggggaaagagaaactcactttcggcttgtccaactacaatccccccccttccctttataagaaaaacattggggttctatatacttttattgaggccgcctaaccttgttctactctttccatcagaaggagctaaaaaagcctttttgttatccgcgatatgatttccccttctgaggaattctccctgatccttgcgcctgctagcctcctcgctctatagatgcccccgtctttcgggcgatcgagacccactccaacgcgtaacaagagaatctccttgagagcgtcctcggtacatcttaagggcagagttagcacgcccattacagtcatgctagggcgcacgagcccggggccccccgctactaattaggtgggaggacaaagttctcccaccgatgtttgattctatgccgtggtaattgtacaacgcgtgtacggtctatggtgagtgcggcacaacccgacaggccattgctcaaagttgtttgggacgttacgaggccttctcccctcccacgggctctcccattccaccagcccaataaaaaca

SEQ ID NO: 494362 - DNA, 225 bp, Homo sapiens
gaggctgaagcaggagaatcgcttgaacctcggaggcggaggttgcaatgagccgagatcgtgccactgcactgcagcctgggcaacgaagcaagactctgtctcaaaaaaaaaaaaaaaaatcgaaaagagggccttccagctttattttgctaaaagtagtctttacggggcccggggggttttgtaaacacggcagttccgatttactagactaaacctagc

SEQ ID NO: 494363 - DNA, 312 bp, Homo sapiens
tctagaggacgtaattctgcacccacagctgtccagtgagaagtatgcatgtttccacgtcccccggtcaggaccacccgctcgttatggcagaagagctctttgatccagcgagccatgccagtgttcactgacatcaggtacgctgggaagtggcgccggtgggacacagtccagtcggtgggggagttggaagcagtggtagtccccagtggccaggtagatgacacagtgatagagctcattcccttcccgggtgaccagctggttcttgcaggagtcacacgacgcggcttgtgggtggcagacatt

SEQ ID NO: 494364 - DNA, 469 bp, Homo sapiens
aagttgattgccattcaaattggtgtctcctatatacaacacatcatttctctgtagccactttcaagacttttccttttagttttcaaaaggttccattaagatgtgtcttagcaggtcaggcacggtggctcatgcctgtaatcccagcattttgggaggccgaggtgggtggatcagttgaggtcaggagtttgagaccagcctggccagcatggtgaaaccccatctctactgaaaatacggaggttagctgggtatggtggcacatgcctgtagtacaagctacttgagaggctgaggcaggagaatggtttgaacctgggaggtagaggttgcagtgagccaacattgcgttattgcactccagcctgggtgacagagcaagactctgtctcaaaaaaaaaaactcaaaatgtacaaacgaggggattcccaaggttttcccggggcccgaaaattaggggtt

SEQ ID NO: 494365 - DNA, 503 bp, Homo sapiens
  misc_feature (1)..(1): n is a, c, g, or t
  misc_feature (314)..(314): n is a, c, g, or t
  misc_feature (320)..(320): n is a, c, g, or t
  misc_feature (326)..(326): n is a, c, g, or t
  misc_feature (337)..(337): n is a, c, g, or t
  misc_feature (340)..(340): n is a, c, g, or t
  misc_feature (368)..(368): n is a, c, g, or t
  misc_feature (370)..(370): n is a, c, g, or t
  misc_feature (422)..(422): n is a, c, g, or t
  misc_feature (425)..(425): n is a, c, g, or t
  misc_feature (469)..(469): n is a, c, g, or t
nttctgggggggaggaaaggggcagttgagtaagacggctaaggggactgggaagcctgaggtggtgggggctctgccttaggcctcctcttcggcctcctcaccggaatcctcctcctcttctgcggtggcatcctggttctgctgttactcagagacgaggtcgttcatgttgctctcagcctcggtgaactccatctcgtccatgccctcgcctgtgttccagtgggggagggccttccggcgggacatggcagtgaactgctccgggatgcgcttgaagagctcctgggtggctgtgcttttgccattgnaggtgnctgccntcttgaggccncgnggtggggtgtcacagacggctgtcttgncnttgttgggggtccattccacaaagtagctgctgttcttgttctgcccgtttngcntctgctcatcgccctccttcatggacatccgcccccggcggacngcagccacggtgaggtatcggccgtggcgggggt

SEQ ID NO: 494366 - DNA, 486 bp, Homo sapiens
caggtctggttgcccatcgggccgagcggatattcgtagcgcttcgagccgtcggtgaactcgcgcacggtctcgggcttgcccatcgtgccgcgcacgtcggcctcggtcgattcgccgaccttcagccccttgagcagcagcggcgcgggcttgatcgcggtgaagaagtccctgatgcgttgcacgtcgagattgccttgcttgtcatcgcagccggtcagcgccagcgcggcggccagcatcgtcacgggaagcagccggaaacgaaaaatcatcggaagaaatgcgcgtggagaaaacacgcggcaaggatacctgcgcagcgccaaaagcgcgagacgggcgcgcggcccgtctcgtgttcaatgcgtcgtttcggtttccgtttcggcgtcgggcacgcggctcgccggctgcggcgcacgcggcacggccggcggcgcgccgatgcggcggcgcgtgcgcacgagttcggccaactgc

SEQ ID NO: 494367 - DNA, 488 bp, Homo sapiens
  misc_feature (279)..(279): n is a, c, g, or t
  misc_feature (303)..(303): n is a, c, g, or t
  misc_feature (454)..(454): n is a, c, g, or t
  misc_feature (470)..(470): n is a, c, g, or t
  misc_feature (480)..(480): n is a, c, g, or t
aggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggcgtgtttccgacttcctagcccccaagcccaggattactgtatgtgaggcaagctacctttctgggcaacctagcatccgaccagatcngtcaaatgtggaatgtaggcactngaccaatgcccaggagaaattcctacagagacaagagacgggctcgaaccagacgctacttccagcaagcggtgcccatctaccgtggcccacttcggctcaccaccatgagcccagagaccacccctcttaggcagctgtttgcttctcnctacacaaatggctgnccacctgaanaccctcac

SEQ ID NO: 494368 - DNA, 705 bp, Homo sapiens
gcggtgcggtggtgactgtgctacgagcctggctggtgggtgtgctgccgagccccggccctggccctggccctcgctgtgcctcccagtgctcctgcaccccttgattgcttgctgctgtggtgcttgatgccctgcttcggcctggtgactgatgtgttgaatgtatattccttgtgtgccatgatgctgtgctcctgtgatgttcctgtgtgaccaatgtgttctgcctgccttcttggcatgctggtaccctgacatccactatatgcaacacattgtcgttgactgtgaatgacatatgtacacctgggatgtgtgaccccttgaccatgaaacttgcttgtccctggctgactccatgacacaatgaccaacatggatgccactgcttgtgtgcctgatgctgactaatttccttgccaatgtttgctcactctgtgtgtactgtccttggatgtgactctatattgtgtgacccacatgaatcagaccatgactaccttcacctgtgaacatcaaccacgccctggctgatggtgtgtggagtgaactgatgtgtttacttgtgtgaactctgacaacagtggcttggactgaacatcctgccgtgcgaagccttgggtctcctctagcttatatggttgtctccagagctgtccaggactttggtcttgcccggttcaaaagccacgtgaccaagac

SEQ ID NO: 494369 - DNA, 507 bp, Homo sapiens
  misc_feature (56)..(56): n is a, c, g, or t
ggagttccagttagctagatcggccactgcactcctgcgtgggtgacagagtgagnctcatctcaaaaaaaaaaacaaaaacaacaacaacaacaacaaaaaacaaccagagaaatagcacttgttaactacaattgtgactctaggtaaacttgggccttaatatggttagacaagaagggttttaggtaacttgcctttttagatcctatttaggcttattagtctatattctacattcttgcacgatggaaattactagagaagtgggataattctttgttgtggggaaaataaaatttgttgtgaaaatatactgtattttaaaatatttagaaagattataaataactggagaaaagataatttcatatactaatatgatggaattagcctagcagatgttaaaaatcctttctgaaaattataatctaaaattatttgggaaattacaatggaactgaataatctgtacgttggtatattaaagccatttttatattgtga

SEQ ID NO: 494370 - DNA, 465 bp, Homo sapiens
  misc_feature (171)..(171): n is a, c, g, or t
ggtggacacggtggacgtactcccggggccggttggcccccggcagagggtgctgtgcaacatcgaggccgacacctactggtgcatgagcaagctgctggatggcattcaggaatgaaaaaggagaaacgtagaagcctagttgtgcggttggagaactggtaaccttcngtattcctactttgcgccctggggtcccaaggacgtaccgtcgctgacttactttgttcctcgcaacaggagctacacactgtgcccactagagatatattctggcccaagcacccatactttgtcactttcccctcctttactaatatttgtcatacattgttattctttctgctagatctattcggctttgttgcccccttagagaaaggattgaatcattaagtgtaaaacgtgtataaagtttcaaatgtcgcttctctgatggtgagtacccgacggtgccattgaaaa

SEQ ID NO: 494371 - DNA, 103 bp, Homo sapiens
tgcaacacgccgagagaccacaccgtctcaaaaaaaacacagaacagcacaaaaaaaaggaatggatagagcccatgctgcattcctccaatgctgggacaaa

SEQ ID NO: 494372 - DNA, 137 bp, Homo sapiens
tgtctggcattccatttactcttttatgcacgtctagttttcagaattgctctatcgccagctgcagtggcatgcacctgtagtcccacctacttgggaggatccagtggcgcgggggctttgtatgattatgggcg

SEQ ID NO: 494373 - DNA, 907 bp, Homo sapiens
gacagtcacatcaatatatagaacttaccatcaccagccgaagttgatagaaactatagttcagaattaccctcctttaaaaaagtaagagactattgtttcttttaattcggtatgaataaaagaagtttttggaacaagactcttaaacagttgtttagacatgattagtcaaacatactttgttaagtccgtgagtgcttacaggtagttgttaaaataaattttagggccgggcatggtggctcgctcacacctataatcctaggatctgggggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgctttgagcccaggagagtgaggctgcagtgagctgagattacgccactgactctagcctgggcaaggtgagaccctgctcaaaaaaaaataaaaataaaataaaacactttaattagaatctatttttacctattttctaaaattatttaaatgcttagcaggaagcataaggaaaagccatcggctccaatacttatgatgacagaaggagcaattgaggcttggctttcctctcttaatagggtgtccgagaataaagaaatcaactgggtgatgaatcatggaagatttgattcccttcggaaaggcagatttctatagtagcatgtaccaaaatagtcgggggtaaggagaataaagttaagggaagaggactggaatgttttgggaaagtgacatgttaaaccgttaaggaaggggaagagattaaaaaaacaggtgggctttcactttgtttattttggtgctttttt

SEQ ID NO: 494374 - DNA, 396 bp, Homo sapiens
  misc_feature (204)..(204): n is a, c, g, or t
ttttcaaaaagttccaattctaaaaacccaaaatggtggtttttagaacctatttgagggattccaccaaaccctttaatgttaaaataaaatttaaccaaaaaccctgtaaagccggttttgcttcccccttgattttttccaatttaaaatttatattaggggtctataaagggataaaaatggattttggccaatttgttncttaataaaaaaaagacccgttttctttggaagtttgttttaatgcccaaaggggatatgaattccaaaaaattttagccgccaaaatggttttgctataaaatgagaagtctccctgaaaaaggtttttttttgctcctttttttaaaaaagggctctttaaatctgtttaaataaaattggccctttgga

SEQ ID NO: 494375 - DNA, 114 bp, Homo sapiens
gattcagttacagtcagggacgggccgacggactgtgtcgggcgatgggcacgggcatttcttacgtttatagctagtctgtttgcattctgattgggaacactgggatcattt

SEQ ID NO: 494376 - DNA, 842 bp, Homo sapiens
  misc_feature (6)..(6): n is a, c, g, or t
gctctncctcccccctgttataaagaaaaaaatagaatagaaaaaaggaagcgaaacagtataggactgccactcaatataaacagttgtaacgctctcttatgtatctgtgattactaataatacctgtgtgtaagattgtcgccctctttaagttctttaccccgcgtggtttgcactgtcttccacaccgtctctgttgaacaaaacgaggattttcccccttttacccctctcctccccttgttaatatcgccccgtggtcgaggacacaccttgggggttatttcaagcggccctttttaattgctgatcattcccctgctgtttaaaatccccccctccctccaagatatgtccggagacgttcatcatgttcaaaacgtgtgctgtctcattagaacacaggttgccgcaatcaagcacacgtgtccacccgcgggaactcgtgcccaaagttatctgtaaaccctgggccggttcccccagcaggatggtagctcccgggggggagccgccgagcccatattcctcgcgccaataaataagcggggaagatgtcttatacacgggcccgcaccaatagagcagaattactcggtaaatggccaccagcacgggtgcaaagtgttagacaggcgggcatgtgccagccataaacacacgtggcgcccgcaaatgggtggccccacaagagccccggtggagccgccacgtttccttgtaataaaacctagaagaccccacgtacatggacgccactgaaaatcttatccacacagtaaaccgcattttttcagccttagtggggccccaaaaaaaccccttttgttcgacaaaac

SEQ ID NO: 494377 - DNA, 592 bp, Homo sapiens
  misc_feature (395)..(395): n is a, c, g, or t
  misc_feature (409)..(409): n is a, c, g, or t
  misc_feature (426)..(426): n is a, c, g, or t
gtgctgtgtccaaatcgcacacttctctgtttaggccatctacgtggctttacatctccttcgtgaagtcaaacgtggaatcagaacacctgcacgttctgtctgatgcgctgctcattgtagctcttggccaggaccaaaaccccacgctgtagctagtagcgcatggcaatcaggcctgaggtacgcttgtgctttttttgccaaggcacaaaggactgggtcctccaagagcaccgggaagttcgggtccacccatggatccttctcggtgggatcccagaagcactataggcaaccagaacaatgtctatttgacttgcaaaaatccagcagattaactctggttgaagtaaggatgacattccacctggttgcagacaggcttgtacttnagccctggcttgtngaggatcatctccagcngcctgtggttgaagtaggacagcccgatgtgacttgggcgaatcctgcatcttttgacatttatcattggcttcccttggggcacaaagatccactgtgtcatctagtatttgtccattttcatctttagggatcacttcctccacctgggtttacagacactgga

SEQ ID NO: 494378 - DNA, 1447 bp, Homo sapiens
aagcgtggtatcaacgcagagtggctattatggccgggagaaacagacctgctcaatacttttcaaggacgcattcacctttgcccaacacaaccacatgcacagcacaagcacacacacaacatcacacagtggcaagctcaacattcaagcagctaaaccaggcagccaagcaagcaaaaccaacacagttcagcacagcaagcatgctgcacaatggacaatcgtctagcacagcacaccagcattggcatcgcttgcttcgcaaaatcttttccggagtgcatcttcagcatgcatctaggcaccttggtcagcagcacagcatttcaccaccaatcactctttcctcgaacatccatggggtgcacacatcacacacagtgggcatcagcaacttccgtcccagcagggcagccaacacagcaggggggcatcaaattcttcatttgcaaacagcacataataggctctaagggtaaaggcctattggcgcgtcaaaagccccaacaggaatgccaacaatcaaatcgggtcaaatcctttaacgaatttccaaaggcaaacacagagaaagttgcactttgagggaaaagttaacgtcagcaagcggcaggccaggttgggcacaccacatgaaagccaacttggcagaggaaaaaaagtcacactcagcaaacagaaccccagacaaaggcaacatcccccgctaacaacccaaagatgtggacaacgttgccaaccaccacgcgttccggcttcaggcattttctaccaaccggcgggcaccaccacgggcacacaccggggcgtcacaacttcacaacggctctggcgcccccaaggacccctgtggggggttcctccggcgtacacacaggggccaccacacagttacccaagtcgcttcgccaggggggccacacggaaacagcgcggacaccaatttgggccttaaggttgcactgcgcaacggcacacccactggccatctcgaacagcacttgggaactcggcacacacaagtggcgtcgccaaacacgtggcgacccgctggtgcacccacaccgcaacgccacacggcacggaaccggaaacaccacggaccacaaagcaccaaggcacaaccccctgggtcaattccccaccatacgccaacctaggaaacaacacccacaggccacacaacacgtggcgtggccattgcgacagagaacccacagctagcgatcattacgggttccaaacagcgccccaactactgagccagcttgaccactcggcgtgacaacagtacgggaggagtcgctacacacccgcacgatcatccggccacaagggcgaggagcccctctaacaccaacggcgacaccaaccgcggcaactatagagggaccacaagcactcacactcgtatcgcacacccctggtgaccacacaacaggga

SEQ ID NO: 494379 - DNA, 89 bp, Homo sapiens
agggtcaggtcttcccagaggccttacttatgtcgtcagtctggggaactctgccatgtgcttctatcactgtgcggttacctctttca

SEQ ID NO: 494380 - DNA, 368 bp, Homo sapiens
  misc_feature (59)..(59): n is a, c, g, or t
  misc_feature (94)..(94): n is a, c, g, or t
  misc_feature (262)..(262): n is a, c, g, or t
  misc_feature (280)..(280): n is a, c, g, or t
  misc_feature (325)..(325): n is a, c, g, or t
  misc_feature (349)..(349): n is a, c, g, or t
gatcctctagagtcggcccttagataacatcattgaaactttgcgtgttactgcctttnacatttgttggagttcattgtagattctggatatnagccctttgtcagatgaacattgatgcaaaaaacctcaataaaatactggcaaaacgaatccagcagcacatcaaaaagcttatccaccatgatcaagtgggcttcatccctgggatgcaaggctggttcaatatacgcaaatcaataaatgtaatccagcatataancaaagccaaagacaaaanccacatgattatctcaataggatgcagaaaaagcctttgacaaanttcaacaacccttcatgctaaaanctctcaattaaattaagta

SEQ ID NO: 494381 - DNA, 506 bp, Homo sapiens
tcccaagtggtggggtgagagtaagttaactttggtgccaggtgaaaggtgggggctctttgcttagactccctatcatggaaagattggagttttctatgcagggccctggggaaaaggattgctgattctgactgcccctgatcagagagattaggattgtattttgacataggatttggaacccatttaaatgttgaagttccctgagacagctctccagctgttgagcctgcgccaggggataagcagcccctaatgaaaggctttgctccctttcccccctcgccaatgttgttgttgcggcctttttgatttgaatcctctgttatagacattttttaaaaacgatttcctctttcattgggcccaagggctgagagtttgaggccccatttttgctgggtaaaaaaatcctgactggggcctttaattcagcaaactgttcatttttttgtcagacaatgtcatattcaactctgttcatattaaacccctgtgaagca

SEQ ID NO: 494382 - DNA, 445 bp, Homo sapiens
gattcctagagtagtcccctctctgccccagattccagagaagcaatctgtgaacccttttgaaaacatttgctgccactagctcagagcgagacgtagtgacctaggaattcaagtagctaactttcaatgaagctggaagtgtgcctgtcttggcggatttagaaactggacagccccttcctatcttgaaaccacatttgatttgacagcgtagctaaaaggaaaaggacgaatagtaactgggttgagttttatgtgcacacggaacatataaacacagcttcaagataaagaactttgagtcagattttcacatgtcatgtgtgagaccatgcagcaaacaatagagagatgggatgggatagctgttgcagactgagatgggattaaaaagggatcccatggcttttcacttagctaaaacaatctggaaatgttaacg

SEQ ID NO: 494383 - DNA, 366 bp, Homo sapiens
cggctgtgacctgcgactagagcagttgtaccctagaggcatgtgtgttgtgactgtgggccgtgactgcggtagacgtctataagccgttaccgcagacccgaactatcacaatcctgggttgtcgatctgcgtggctggacttattgatgatttagctgcgagcatgtcgctttgtggactcttaccgtataacctgctaatactctatgacgcagaccgtactagtctatggacgtgactctcatacttgacttgcagacacagtcgttctagatagtactgctatctcttattatacagactgtatcgacaataatggttatgcttgagtatgcatgatcatgtgtcatctgtacacatccc

SEQ ID NO: 494384 - DNA, 337 bp, Homo sapiens
caggattcacgtgcgtaggcgacggcgctgtggtcatgcctgtatcgcagcactctgggaggcaaggcggatggatcacttgaggtcaggagttcgagacgattctgcgcaacatagtgaaaccctgtatctacaagaaataaaaaaattagcccgccatggtggcctgtgccaccatgtctcagctactcggtaggctgaggtgggaggatcacctgagctcaggaggcagaggttgcagtgagctgagattgcgccactgcactccagcctgggtggcagagggagactccgtcccaaaaaaaaagaaaagagaaacgagctgttcaccttccgg

SEQ ID NO: 494385 - DNA, 170 bp, Homo sapiens
  misc_feature (13)..(13): n is a, c, g, or t
aaattgcctccancaagcagtgcttctgaataggatattggtgtactggatctttctcaaatgtgtgaaaatggcaacaagcgcctgtcttattttgtccagctccgtggcagacagcaaatcattcagagggaaatctttcatcagaggatagtagtcattcacagttt

SEQ ID NO: 494386 - DNA, 1196 bp, Homo sapiens
caatggacctatgcaaggacatgagcagttaatacatctacacccaattcagacacagtggctgaggtgactcctgtatgctccagaccccagtatctccagcaccgaccagtccccgaagctctgacccgccccccgtccccatcacgccaacaggaaacgaagcaccgcaaggaacgacaacagcaactagcaaactatcacagagccgacaggccatgtccggccacgtagcctgagagaacaagaagacaccacttctggaggcttatatcacttcgtgtcgcctcactggaccaagacatggccacttttagaaagccacgcacgctcatgagcgcagcgcggaccgcctggggctccacaggccactcgcagaagcccacgagtccgatggccacgccgggcacgctcgcagcgaggagcacccacggaacacaggtcccgggccgggacagagccaagagtccgaaggccaatggcacaggtggccaactgcgcaagtcccggaatcgccatgcccgccgcgcgtaaagtaccacaacgtgaatgctgccacccgtggcgcacgcagcccaatggaaattcgccaaactagaacacacagagtcacgagaaccctcctacgcgacacgcccctcaacatggttcgacaaattgcagcaccaccttggcctctacagcagtcgcaatcacaacactcgtggcacaaatcacttagtcagccacccgccaaaggcccactctctacccccggacagtttaccgcgaactcacgtccgctgcgaaacaccatgtcacgaatgtacccacattgtgccccaacgtattcgaaacacacacaaagtcaacggcgtttggcactgcctccgactacccccacatccgcgccaacacccccgcggcactaaggccccaacccaacagcgcaccaagcacgaagagcaaggacgcccaagcaccaaaggtgagcaccgccaacccccacgacactccccactgcgagccaaccaacccctccccaaacaaaggcgcctccaggcaacaaggagccaacctctcaaacccacacggcccacaactccccccggagacagagtgaccacacgcgcgcccgcgcacatgtggggggaaccccaccgaagcacaagcgacaaaccgtacagggagaacccaagacacccccaacaaccagc

SEQ ID NO: 494387 - DNA, 206 bp, Homo sapiens
aagtctgtcacactccaggctggttgtccaggaaaagttggcaactttcactgttgggaaattttcacttaaaaataggtcgaagttaagctgggagtggtggctcacgcctgtaatcccagctacttggaggctgaggcaggagaaacacttgaacccgggtggcggaaggtgcggtgagccgagatcgcgccattgcactccac

SEQ ID NO: 494388 - DNA, 541 bp, Homo sapiens
ccggccaggctattggttgaatagtaggctgatggttccgataataactagtatgggcgataagagggtgtaagttatgccttgtagttaagaagtggcgctagggcatttttaatcttcagagcgaaagcctataatcactgcgcccgctcataacggggatggccatggctaggttatagatagcttgcggtggttagtgtaaataagtaaggcaggagtccgaggaggttggttgtggcaatcaaaatgaattaaggatactagtataagagatcaggttcgtcctttagtgttgtgtatggttatcatttgttttgaggttagtttgattagtcacttgttgggtggtgattagtcggttgttggtccgagcggaggtccgctcggaccatacctatgtatccaaatggttctttttttccggagtagtaagttacaatatgggagactattccgaagcctggtaggataagaatataaacttcagggtttatcgtgtgagcacaccatatatttacagtgaatagacgtagacaca

SEQ ID NO: 494389 - DNA, 108 bp, Homo sapiens
ggactgggctgtagttatgtgcttggtgtgatcgcttgatcctgggatcctccaggagagaagggtcctcgggcttggccatggcttgtcagggagagccgaggggag

SEQ ID NO: 494390 - DNA, 232 bp, Homo sapiens
aaagtgtcttcattagttatggatgatgaaatagaaagtgacgcacaaaaagaatcactttctcccggacaattgagactaacttttgaagaaattggagcgacaaagacaagaaaaccgaaagaagcaagctgaagaggaagcaagaaaaagtttagaaagaaagagaagggtgctttttaaagaagcaggggggcaaatggtaaatgaagttggggatggtccgcacagg

SEQ ID NO: 494391 - DNA, 155 bp, Homo sapiens
  misc_feature (32)..(32): n is a, c, g, or t
  misc_feature (35)..(35): n is a, c, g, or t
  misc_feature (79)..(80): n is a, c, g, or t
  misc_feature (140)..(144): n is a, c, g, or t
  misc_feature (147)..(148): n is a, c, g, or t
acaatttaaaaggcaggcgttggaccaaaaanccnaagttattttccattcaaggcaggcaaaagaaaagttcttaatnncaaggcaaatagccactatttgtatagacacaaatatgaaaactataggatgatcaaaannnnngtnntcatatc

SEQ ID NO: 494392 - DNA, 344 bp, Homo sapiens
ggtcggtccttaacccatccattttttttggggggcaattgagaacacataaagcaagcaggtacctagcatccccctcctaaagtttaaattcagagcccagggtcccccccaagcctcaagggagcctcaggtttttttaatttcctcccctcccagtttgaagcaaacaggttattgcctagtcccccccaatcccaaggggggggtgggtaagggcagcatgggggggtggcctggggggggagtaaaaaagtccctgtggggggggggaaagggggacttgggggtggggggggtggccccttcagttttgttcctattaaaggcccttttgaagggca

SEQ ID NO: 494393 - DNA, 848 bp, Homo sapiens
ctcggcgtgtcgttgttgtcggcgcatcccgcttcgggttaggtcgttcctgtgcgtcccttcctctcctcccttcggacccatagatctcaggctcgggtctgccgtccgccggagatcactgttgatccggtccgtacatgcggtcccgtggccaccatgtccctaagcacgggaaacggaaggagatctacaagtatgaagcgccctggacagtctacgcgatgaactggagtgtgcggcccgataagcgctgtcgcttggcgctgggcagcattcgtggaggagtacgaaaacaaggttcagcttgttggtttagatgatggagagttcacgagtttactttgcagaaacacctttgaccacgccatacgcccaccagaaagctcactgtgagatcccgtgactagcaacaaggcgtctatccagacctactggtcgagcaagcggctgactatctccgtgtgtggacgggttggtgaaacatgagaccaggctcgagtgtttgctaaacaatactcaggaactctgatttctgtgctcccctgaactcctttgactggacactgaggtggatcctttatcgtttaagggtacctcaagcatttgatacgacatgcacccatctgggggctggagacatgggccaggtgtaacgggcgagtgaatctcgtgtctggccactgtgaatgaccccgtttgatcgcccatgacaaagaggtctattgatattgcatttacgtcgtgccggtggtggcagggccattgtatgcctctgtggatgctgatggctcggtgcgagtgttttgaactcccgctattagaacaaatgacatcatttagaagaa

SEQ ID NO: 494394 - DNA, 819 bp, Homo sapiens
ctagcgtatccggatacggtacgcactattatagccgtaaggtccatatactgctcaatgggaagttgaaaacactgatgggaactgttgtaatttattgcagctgggaagcatatgctagcagtaacctattcattctctcaagcctcccagaatagagcacaaataggtatcatcttgtatcatgatccacaagacgtagatttccatagtctccctaggtatatatagagcttatcattacacctatgtgtgggtcacctcctccacatggctttctgatatgggtatatcatcagagttccgagtcattcacgaggtagactgagggccacttccaagactgatatggctcatccgtagaccagctcgtcgtgacctggaatgtaggagcatgatgggtgacgccttgtggcatcctcctagattcatgagcgttctccagatgctcggtagtactcgtaggttacgagtagtacatgctcaatggggactgaattctcagcaaagagaaagccctggattcttaggacattttgcgtggatgtgctatgcagaaatcctgccatcaatgtgaaacgaccctgctgtttgtgggtgtgcaccaatcatcgtgcattgaacattcagggtgatgattgcaccttgtggaaccaagacaattgacctgtggcgagacttgctttggaatgttgccatagtaaaggtgggcctacaagccttgtgcaagaaagtgccgcggaaaagactcgcatcgctgtgccacgaggtaccgtatggggactatacaatctgtctggtccaataatacaaggattg

SEQ ID NO: 494395 - DNA, 314 bp, Homo sapiens
aaggaagggtccagcgatggggagagccccaagttgagaactaagtaagtgaacaattattgtatgaacaacttgttacggatacagctgagatcacgaacaacctgtgtgtaaaatgagtttcattacacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 494396 - DNA, 304 bp, Homo sapiens
ctgagatagagccactggactccagcctgggcgagagtgcgagactacggctcaaaaaaaaaaaaaaaaaaagggtaaaatttgaaagttaaaatgaccccttaatcggggggcggcaaaagggttgtggtgtaagcaggctggaaaacgacattagtctcctcgggacatctcctagcagagctctcggagtggactaggtgtattcccaatggagcagtaatattttggaagggaatcttttttttttcttttcccccttgagcagaagggtctcaacgggggcgctaaaaatatccagtaa

SEQ ID NO: 494397 - DNA, 331 bp, Homo sapiens
tatagcttcagactgggattccagaacttaccattgaaaacagagcttttaggccaggtgtggtggctcacacctgtaatcccagcactttgggaggccgaggcaggtggatcgcttgagctcaggagttcgagagcagcctgggcaacatggtgaaagcccgtctctaccgaaaaatacaaaagaaaaacagctgggtgtggtggtacgtgcctgtagtcccagctactttgccacctaagctggagtgcagtagcatgatcttggctcactgcagcctcgacctcctagattcaagtgatcctcccacctgcagtccccgaaggtcgac

SEQ ID NO: 494398 - DNA, 218 bp, Homo sapiens
tctttcttcccaacttttattttaggttcagggagtacatatgcacatgtgcaggttttatacgggtaaactctgtgtcatgggggcttggtatacaatttatgttgtcaccccggtaataagcataatacctaataggtaactttttcgatcctaacccccctcccacccttcaccctcaagttaagccctggcttatggtcgacgcggccgcgaat

SEQ ID NO: 494399 - DNA, 324 bp, Homo sapiens
ctttggggtctttgctctttgtttctaggagaaaacacacacacacacacacacacacacacacacacacacacacacacacggattctatatcgaggagacatttggtgtttacaaaccttgtagatactgaagggacgagagagtttttttgtgtgggtggtcacaaagagctcgcgggcctacacacagtgctctgtggagggactcaaatcttgggaggagaggggtgagctttctgtgggcctctcacacacacacgtgagagagagagaagagtgtagcagagaccacaagagagcagagagcgggcaccgcgctcga

SEQ ID NO: 494400 - DNA, 311 bp, Homo sapiens
catgattgtgcggagtgggatgtaaatatcgccttcctctcgcctattcctcccatgaaaaatggcttcctggccgggcgtggtggctcctgcctgtaatcccagcactttgggaggcctgaggtgggctggatcgcctgaggtcgggagtttgagaccagcctgaccaacatggtgaaaccccatctctactaaaaatacaaaaattagccaggcgtggtggcgcatgcctgcaatcccagctactcaggaggctgaggcaggagaatggcttgaacctgggaggcggaggttgcagtgagttgggatgg

SEQ ID NO: 494401 - DNA, 179 bp, Homo sapiens
gaggctgtgcacagaagcccacagctgagaggagcagtgcgcagacacctagaacccagagggcaggaggggcccaggacactggcaggcccatcctgtgaagccgaggcccacgtagcaccagcacgaattcccttagcaacagcacgaattcccttagcagcagcacgaattccctt

SEQ ID NO: 494402 - DNA, 678 bp, Homo sapiens
  misc_feature (146)..(146): n is a, c, g, or t
ctgatttataaacaaggttcaatatagaatgatataactgctgcaaccggcgctgccacaactacctgtgcgcattgtccaggggcctgaggattgatagcccccacccctgtgccactgcatctagcgcccatgtgcaccattgnggggcctgagaataggcccactctgcctgcactggcacatgtgcacatcatctgagggtctggagatcaatatatgccactcactggcatctgcaggcaccgtctgcagaccagaggtaaggccagccccacctgccacaagtgcactgggacctctggacataatatgggggcctaggaaatgacccaccctgctccctgccactggcccctgtgcacaccattgggagggcctaaagaaaagccaaccttgcctgtggcttccattaccagaaccaacatacaccttttagggcactaaaactaggcttgctttacttgttactgccacttgaacaggtcgtttgcttggggataaaccaatccttccaacaagaaccaatgtgcacaattttgggggctctaaggaacgggcttccttgtgtgctactaaggtcaatgtttcttggggcccttgggatttacccaaatttctttatcaccattggtgtcttgttggacttttgggcctcatggatctttcttcttgcct

SEQ ID NO: 494403 - DNA, 444 bp, Homo sapiens
  misc_feature (23)..(23): n is a, c, g, or t
atatatataaggcaaggtctcanagggtcctgagctgtctccatgcagttggtgtggctgggttcctaacatgtggatgaggtggtgttcaccttcctgtaagcctccagctctcaggaagctttctgaaccatgtccttttgggccttttatggagacttcattacacaggcatgattgattaaatgattaaaccattggcccttggtgatcaactaccattcttcccaattcttgaagtttggagagtgggtttgaaagtcccagccctctaatcctaccttggtctttctggtgaccagcccccatcctgaggctacctaggggctgccagccattagtcagtcattaacatataaaaagacaccattttggagatttcaaagattttaggagttgcatgcaagtaaatgcgaatgaagaccaaatatatatttcacaata

SEQ ID NO: 494404 - DNA, 343 bp, Homo sapiens
tagcctcatggtaggaaaatggttcttgaacaaattacagacacaaatgacttaaatggaatagccctgtatagggcaaactagtggcccccaggagacactacccttccatgccccagacctctgtcttgcatgtgacaattgccaatctggactaccccaagatggcacccaagtgtttgacttctggctacctacggttaccatgtcactagcgtcttattatttcagacctacaaattgtttaaatatatgtcgtcacagtgtaccaaaaaaatgtccagtcggtaaaaaggtctaactctgccaattaagagccagtaagtaacagctattgctgtcc

SEQ ID NO: 494405 - DNA, 111 bp, Homo sapiens
atcagctcggaccacccagataactacgatagcccttatgaaacttaagggtgaaggtggatttagcagtaaactgagaatagagtgcttagttgaacagggccctgaagc

SEQ ID NO: 494406 - DNA, 284 bp, Homo sapiens
  misc_feature (19)..(19): n is a, c, g, or t
  misc_feature (24)..(24): n is a, c, g, or t
  misc_feature (34)..(35): n is a, c, g, or t
  misc_feature (37)..(37): n is a, c, g, or t
  misc_feature (41)..(42): n is a, c, g, or t
  misc_feature (48)..(48): n is a, c, g, or t
  misc_feature (50)..(52): n is a, c, g, or t
  misc_feature (107)..(107): n is a, c, g, or t
  misc_feature (199)..(199): n is a, c, g, or t
  misc_feature (203)..(203): n is a, c, g, or t
  misc_feature (269)..(269): n is a, c, g, or t
  misc_feature (271)..(271): n is a, c, g, or t
  misc_feature (273)..(273): n is a, c, g, or t
  misc_feature (280)..(280): n is a, c, g, or t
ccccacatagaaacttgcntgtancccggggcanntncccnnttttgntnnnaaaagacgagccccaagttcacacttccatggggacaagaccagccctgctcccntttctatgcagaatgcggctgaccagagagctggatcagggcacctggcagacccagtctagggaagagctgtggatttttgaggctgtgtntgtngccccttctaggaattttcccttcacgattcttttccctaaatgcccagtgctctgctccaacctntntnctccccnatcc

SEQ ID NO: 494407 - DNA, 98 bp, Homo sapiens
cgagcggccgcccgggcaggtaccccacctttgcacccaggccgggccagctgtctgatccaggcggtgctcaggaatggttgtggggggctgtggtc

SEQ ID NO: 494408 - DNA, 108 bp, Homo sapiens
ggccggtccgtctttcccaacacatgaaataagtccaaatatgaaaatagagtttagtgtgattaaaggtataaaccttcctaatgttgacctgtgtgggcgataaat

SEQ ID NO: 494409 - DNA, 868 bp, Homo sapiens
  misc_feature (665)..(665): n is a, c, g, or t
gggaggagaggagagcatagcagctgaaacgcaagatggaatgtgggcaggaaagaggtcctgaatggagagcccgacggaactatctccgttagctccccggggccgattgtggcaagtgtcccatgctttctcgcgaggtgctaacctgagaacggcgcgttctgtatccgtgtgtgggtagtggggtggtccgtcatcgatcgttggttgattgtggtggagcgacttggctcgatggagatcttcctagcactgagcccagtataacacctactggagaatgggtatcatgagatgatgagcatttggggctgccggaaggccaggaaagtctggactcctgtagtgagcacctggttaccaagcttgcgcactcttgtcgacacgatccggcgtcacaagcttgggccttctgaggcggtatgggacttatcccaagcgatgctgtctgattcgcgcgtaccagaggccaatcgcccctaggctatcgtgcatggtactatcgattgacacgatccggatcgctaagaagaagcattccccgcgaggacatgtgaaagggctcttcgaaatatgaagagaggttcgaccaaaggttctcacgagggatagagctcttcatgtacgaggccaatggcgcggcagggcgcctaacgtgtcgntaagcttgagtgggcgaaggcagtagggggccgacaattgcagggcatcagcatcccctccggggaggggaccctggcctttacctggtgacattaggcagaagaaagaccccttggtgtggccgggtggtggcaatcatacttagattcgagatgacgcctccgagggtcagaggaaagcactcaacgggaaaggaaaacgc

SEQ ID NO: 494410 - DNA, 743 bp, Homo sapiens
  misc_feature (126)..(126): n is a, c, g, or t
  misc_feature (189)..(189): n is a, c, g, or t
ctctggtcacttccctccaagtccccggcccacacaagctcctggagtcccaggccccttgggggcagcatctctggtggcaggcatcttccccaaatattcaaccttctggggctcctttctggnccaggaggggaactggaagtttccctagagaagcacttggctaaaggggctccaggtccccanactcctgggggaagaagggatccagaggctctggcggcacaaaggcctccactggttctctctgggggtgggcacccccttcctggtgggccctggtgggcaccacaacaaaattggattcggtccaggcggaataatttcttaatttaactctggttccaacatgggtgggtgaagtgagatctaaccctgggaactctctcgccacacaagggaacttatagaacacggcagggtcatggaaccaaatgtaacacattttggcattaatattttatagtaacaaagggtgtaacagaggcccaagaacagggatgtagggggatggcgagaataacttgggcctgtggggcatcggcagggaaactcttggcgaaggatgtgtgtatactccggttggaaagtggggaacgttgacaagaaccggcttgtgtagaaggaggcgcatgggagagggagggtcttgggattgagaagaaccagggacgaaacaaaaatgttccggagacactggaggcgaaactttggggacctttcgtttcacgagggagtcc

SEQ ID NO: 494411 - DNA, 102 bp, Homo sapiens
acaaccaattttttttacttctatcaccctagattagttttgcctgttcttcaacttcatataaacttcatataaatgggggcgtacagtatatcccctttt

SEQ ID NO: 494412 - DNA, 189 bp, Homo sapiens
aagacaaacccaatatacctatcatatgctcaagacgtagttaggctactgaaagacatgacatggtctctaaccaagtctattacctcagagatccacacatcagacatcatactctatactccaaagcagcacaccatggctgctagtgtacctctcctatctctatcatcctacttttagatacct

SEQ ID NO: 494413 - DNA, 301 bp, Homo sapiens
tatgtggatgggggaaaaggaataagaatttacaaagtcagatgggggtgcttccaagtccacacaattaatttggatatttttaatcatatccaaccactcacattggggctatgttaagtcatagctcaattggttcccttacggttcggcagcagatcactggccggtctcttttcaggtctaaggcagaaaaacaaaaaacaaacaaacaaaaaaaccggttctaaactaatcctcaaactggctcagtcagtccttaaaaggggttttaggggaggctatagaaccaatcaacata

SEQ ID NO: 494414 - DNA, 381 bp, Homo sapiens
atacggaactcgagctggtaccctcgataaggggcaagcgtggtggctcatgcctgcaatcccagtactttgggaggccaaagccagaggatcatttgagcccaggagtttgagatcagtttgggcaacatggcaaaaccttgtgtctacaaaaaataaaaaattatccaggcatggtggtgcatgcccgtggtcccagcaacttgggaggttgctgatgggaggatcacttaagcctgggaggtcaagcctgcagtgagtcacgcactccagcgtgggtgacagagagagactctctcgaaaagaaaaaaacacacacacatgtagaaagcccagttaaagtggaattttacacaagaaacaattttttttggccttatc

SEQ ID NO: 494415 - DNA, 157 bp, Homo sapiens
gggtggtattggcagtggcgggggtagcagctccagcgtcaaatttgtctccaccaccatcctcctcccggaagagcttcaagagctaagaacctgctgcaaggtcactgccttccaagctgcagcaacccatgcccatggcagattgcctacttct

SEQ ID NO: 494416 - DNA, 166 bp, Homo sapiens
ccgacagagcgtttctcaatctgtccttaatattggttataggcagtattgattaggtcacctcatacacatacatagagaaatcaggtcagagggaggacaccattcttggtcagagcttccttcaccaacaaattttggtaccaccataacctcttcctcctct

SEQ ID NO: 494417 - DNA, 402 bp, Homo sapiens
cacctgggcgcgccatctacgcgccgcgcccacccaaatacccgggccacccctcccccataccacagggctggggtgctgctagcccatggaactgttttctgtgctaccgtgagccgcccctgaactctccagtggcccagctggtacgtggctccgctcagtacgcgcacgccgtatgtgtgactgtccccgcatcatcgcacgtacagtaccagacgttacgccgacgatgcgcagacatccgaccattatgtaccgtcccacatacagtcgcagggcctaaccgctaactatgtctggaccgccaccgtccggaccgcacacatcaccgtacatacaacaaccgacacggacacccactggctccgacagcccgtccactccaaccctcttctacca

SEQ ID NO: 494418 - DNA, 429 bp, Homo sapiens
  misc_feature (337)..(337): n is a, c, g, or t
gtcatcgattccaccctccgtgtgctcagcctccggagtagctggggattacagggtgtgcaccaccaggcccggctaattttggtattttaagtagagatgtgtttcaccaggtgggtcaggcgggtctcaaactccggacctcaggtcatccacccgcctgggcctcccaaagtgctgggattacaggcgtgagccaccaggcccggccctcctttcttattttgaaagtcttggacatggatagggttttctatagttcccacagagatgtgtggttggtggcttcgagtttataacttgggtaggaaagggtacatctagcccttcctatgtngatattatggacttcacaggttagggaaccatgaactagtttcagaagtgcgggagttacagtgttactacgggtccaccaggcctacggtg

SEQ ID NO: 494419 - DNA, 408 bp, Homo sapiens
  misc_feature (148)..(148): n is a, c, g, or t
tcataacagccggtagtaggttctgtatataaaaaagagtgtgacggataaatgtgaccaaataagattttctgatcactctggttgtggctgaatgtgaatctcttctgaatgtgctggagaaatattcggatcactgacattctgncacgtatattaattgttgaaattcttattcctctatcacactaaaataatagtctataaagatagactgaatattattcactttaatattctaccatacagtactttcctctgtaaaaggccgacaaagggcatggtaaagggcagaacagaatgggggaatgaatacataaaaaagaaggaggaaggtactcaacaactcagactggttaatgagagttgagcaatagtgaaagaaagaacaagagaggagagctataa

SEQ ID NO: 494420 - DNA, 226 bp, Homo sapiens
gaggttttgggggtgagagtatacaaaacgcaagaatcttctctcaaatttcagagaggggggtgcacgtgcccgagccaatatgcgcctataatgtgatatgggggttgtcccagagccagagccggggtttttgtgggggccagagggggcagcgcactgtgtgtaggggtatctgtgagagtcccccctgttgtcgtcttgtagcagcagaatagtagtaggc

SEQ ID NO: 494421 - DNA, 340 bp, Homo sapiens
  misc_feature (264)..(264): n is a, c, g, or t
tcttttggtcagagagtccatatatctattctcatacatacaaaataaaggggacattgctgaactcagggatttttaaggtaagcgaatattttatttcctcggtctcgatgggattgacttcattatacaagaacttgccgctgacagaactgacacacacattttcccccagagaaagaaccctctttcattagcagagatgaattgaaatgtcatgtctgagtgcattcctgctccccactctcaccccacaaaatcccncaagtgaaaataaatcaataaaatccccctgatttactaaaagtcatccctcccaaactttttaactagcagctgg

SEQ ID NO: 494422 - DNA, 1042 bp, Homo sapiens
tacttggcttggagactggcgcggcgtacgtgtccgaggtcactagttgcccggtagtacagcggcacatgaatagaagcagcaatgagagccagtcagacaggcacttcgaacaattcaataaatcaatgtgaaagtcttgaaaaaggatccaggacaactgaagtgaagctaaaactctactgctgctatataagcaggccactgaaggaccgttgtaacatgcccaaaacaggtgtattggacttgatcaaaaagggccaaatggtgacgcatgtgaatgcccttggaagcctgcccaaggaagcagccagagcagaactatgtaggatttaggagtcacagataaaagagatcctatcattaggaatccatctagtacagagtggagacctggcaacagacagagaagatacaaacatggagatacagaaaagctctggatggaagaccctccggaagacatggcatacacaacagatcaagataacaaacacggacacaaaaccagacaaaaatgcacataaaaacacatgagaatgatatcatgcaaaataatgacgagcaacattaacagctggccagcacaggcatgacgtcaagtcatcacatgataaacaacagagaaatggttgactataacagaacgtgggcaatgatctgactaaccaatcacagcatatacccacacttggatagacgtagaaggagaaacgactacaaaactaacatgacagaaaaaactgagtggaactaagtagggaccatgatatacaagaaaaacctacaaactctgactagacaaaggatacatggaacaagaaagaaagcaaacaaccgaaaacacagcaagcggaaaaaccaagccgagaaatgaaacagacgacaggacagcagtacaaaaaacaaaaaaaacaaacacaagagacaaagcacaagagaggatgaacacaataacaaaacaaccgaaaaaaaatgcccgacaaaggagccaaaaaggcaaataggaaagaaacaagaaaagacagagagaatacacccg

SEQ ID NO: 494423 - DNA, 346 bp, Homo sapiens
  misc_feature (69)..(69): n is a, c, g, or t
acttattctgggtgttgtgagttgggggaaaacctgtgaaaacccagagtccccaggttttacaccaanagtgccaaattattttgactggattagctaccatgtagaaaggccttttatttctcagtacaatgtataaaattgtgatctctctcttcattctatctttttctctcaagagttccatttaaatgaaaataaacggggtatatttaatatttctctagggggggaaaaatgaagcaaaatctcattggatatttttaaaaggtctcccacagaggtttatgcccatattggaatttttgttgtatatttctcaaataaatattttggtgaagcataa

SEQ ID NO: 494424 - DNA, 295 bp, Homo sapiens
ggctgaatagtattccactatatataagtaaacatctgttgaatggacacttagattgcttccaaatcttaactattgtgaacagtgctgcaacagacataggaatgcagatatctctttgatgtattgctcttctttcttttggttatatacctacccagcagtgggattgctggatcacatggtagctctacttttcaattttttgaaaaacttccaaactgttctccatagcacttgtactaatttacattcccaccaacagtgtataaggcttcccttctgtcgtcttctc

SEQ ID NO: 494425 - DNA, 402 bp, Homo sapiens
tgggcaggctgcagtgcactccagcctgagtgacaaggagagagactccatctcaaataataaagaagaaataactcaagataacctatcttgtataatgtatatttgaaggcacctgtagtattgtaacatagactgtttctcacaggttaattttggtggaggcataaaagtctttagaatcaccatgaaggcacttgtgttaggaagatacaaacaaacaaaaagccctcacgaatggagcctgtgaacgccgtgaatggagtgttcccacatccatcgaataacaaaaattattatagaagacgctgcagatcccataaccttgcactaagaccagcacaaccttacacaaaaaatacttctgcaaggatttctgcccagcacctgcctgtccaacct

SEQ ID NO: 494426 - DNA, 449 bp, Homo sapiens
  misc_feature (97)..(97): n is a, c, g, or t
  misc_feature (99)..(99): n is a, c, g, or t
  misc_feature (120)..(120): n is a, c, g, or t
  misc_feature (129)..(129): n is a, c, g, or t
  misc_feature (173)..(173): n is a, c, g, or t
  misc_feature (190)..(190): n is a, c, g, or t
  misc_feature (196)..(196): n is a, c, g, or t
  misc_feature (202)..(202): n is a, c, g, or t
  misc_feature (231)..(231): n is a, c, g, or t
  misc_feature (252)..(252): n is a, c, g, or t
  misc_feature (259)..(259): n is a, c, g, or t
  misc_feature (281)..(281): n is a, c, g, or t
  misc_feature (285)..(285): n is a, c, g, or t
  misc_feature (297)..(297): n is a, c, g, or t
  misc_feature (312)..(312): n is a, c, g, or t
  misc_feature (315)..(315): n is a, c, g, or t
  misc_feature (360)..(360): n is a, c, g, or t
  misc_feature (379)..(379): n is a, c, g, or t
  misc_feature (399)..(399): n is a, c, g, or t
  misc_feature (411)..(411): n is a, c, g, or t
  misc_feature (414)..(415): n is a, c, g, or t
  misc_feature (434)..(434): n is a, c, g, or t
ggcgattttagtgaagtttacgctcaaaagcaggattccccagctttccgttgcacaaccagtgaagggcagtccagcccagcccctatttgagttncnggctacccaaggactttgtanacctctttnctggggaggacgctcccaagctaatagacttccttaagctgaanagaaatcagcaggaggncgactnatgagngtgctggaactggaaaaaaggaggccccncccccccgctccgggagctgntcatcanccgcaacttcctgccgaccctnatgngggtgggccgancagtgtggacatcanccnctttttatattcatggacattcccctggggaaaaaaacggagggnctttgctacttgtaaaaanaacataataaatagattttnaacataggaaanccnnactgttttgataataaaangctttttatgaaata

SEQ ID NO: 494427 - DNA, 996 bp, Homo sapiens
cggagcctgggacaccgccggcggtcagagaagcggatcccgtccgagccccggtcccctaatgtaagcgccgaccgtccgccggaagctcgcctatggatggtcccccgtcccgcacataaggtgcctctttgcatagcactagttccccagccgcacgctctctggaccactacatgctggactgggcaatggccgggtcggaggagggcagcacgtacagacccaattgtgcaccagcttgctgggaacaagactctgtcaagtttaacgctggttctgctgcggcggagtcgtgcggtacggcaatattccatgccttcgttccatccgcattggtcaagggacagtttcacgaggtacccaggagaggcaccaattggagcgggcttcctcacacagactgtctgcctggattgacacaaacaggtcaaggttgtgaagatcgtggggaccaccagtcttggcacagggagccggtatcgacagctctgggcccccaatgtactaatcggggaggcccagtgttgccatcgtggtctatgacatcaccaagacagatacatttgcacgggccacgaactgcgtgaaggagctacagaggcagtgccagccccaacatcgtcattgcactcgcgggtacaaggcagacctggccagcaagagagcccgtggaattccagttgccttgggatgctggagtgcgaggatccacttggaggccaggacgtcgagaacagctaagcaccagaagcagagcctaatggaacgacaacaggttggtgtcactgggcacattcgaaaaactgccactgaacgtgtacacgaagacctttccgtgcgctggctcagaggtttcccaaaagaagcccccaaattagctgtgtggcccggcgcaaaccacgtgtgtgaccccatggaagaaaacacagcagtgcggagacctgctgtctccaattggacccctttagtatcactagaccggacaccacgaga

SEQ ID NO: 494428 - DNA, 401 bp, Homo sapiens
gaagatcttctgtcttttgtttagatatttatttatttattgagacagggtctcactctgtcgcccaggctggaatgcagtggcgcagtcttggctcaatacaacctcaacctcttgctagtctcaaactcttgagcccaggaggcagcgattgcagtgagccaacattgtgccactgcactgcagcagagtgagagaccgtgtttcaaaataaaataaaatagggagggatagcattaggagatatacctaatgctagatgacgagttaatgggtgcggcacaccagcatggcacatgtatacatatgtaactaacctgcacattgtgcacatgtaccctaaaacttaaagtataataataaaaaaataaaataaaataaaataaaaattctcaaaaaaa

SEQ ID NO: 494429 - DNA, 217 bp, Homo sapiens
tcctctctttatgtgtatactgtgaaacggctgatcaaagactctaaagaatactactgcttgtctcttatctacccacaccttttaaaaactttcttccttctttccccttcaaatattgaagctctcaaaatcatcttcggagaaaggcacaaacctacctcccagatgtgcatccttcatctgggccacataaactttctaaattgattgagag

SEQ ID NO: 494430 - DNA, 390 bp, Homo sapiens
tcaccctacacatagcaatcaataaaagtacaaacatatataagctctaaagcaggctatatctaccacacagaaccctcattactatccttactactgacaactctcccttaatccctatttcaagtttagtttccctgacatctaatctacatgctactatcaagaagagcttaaattttaaaccacaagtctaaccacggaaaagccttcaagagctctccaacacctacagcacttggaacctactatacatctccggcaagcatcattgcccatcactccctaagcccactttacactactaagtaatacagctcctagatccctgcactgtgtgagtatgcttaggtcagcacttcatcagtatctactttgtactatatataa

SEQ ID NO: 494431 - DNA, 735 bp, Homo sapiens
  misc_feature (13)..(13): n is a, c, g, or t
caaatcagttttnttggtgtctttgcagggaatgaaagaagataatgagcagataatcagcagccatttcctttcagttacggtatatgattctgcctgagaaagcaggatttatgggaaggaaaacttgtctaaggctcatcaagatggcctgacccagagtcacctaagagaactcttccaacttaaatgactagggtgtgtaatcagttgcttcttattctgtgtctcagatttcctagtccatgacatttaatagtgagtatagagtaggatattctatacattttagtatttggcccttggaaacaaagttaaataccatgtcactcagaagactctcaaagtttgtgtataaatggcgaagtatgcactatgagagattctaatccattcacatcattcttgagttgtgcaaatacacttggctttgatttcacttggtgatctaaatttgtttatttaagctgcaagaaagttacattaatttggaatgtgtcatcacttggacccagtatatcagatttttattgagtaaaatgttaaaaataataagtgtaactcagattctggatgttcgagtttacaatacattgcctgtaataaaagctgattctgaagtgcatttttcttgacttactttggcagaaatatacttatatcttaatttatagtttgtaagtttatactgttttctaaaagtaataaatcatttcatgaaaaataaaaaaaaaa

SEQ ID NO: 494432 - DNA, 300 bp, Homo sapiens
aaataaacttgaccttaataactccttagcagggggtctaaagctacgctccttattcaaacaggcctccacaaactccttgaggggtttactgtagtttccttccagcactccggaggtgctcatgaagcacgcgccaagcactgctgaagcggtcatcccagtccgaggtccagcgaaggattgtatcccagcccacagcacatggcacaaaccaatcattaccagtgttctggctaccctggctcacatggaatcacagccatcgactggagcatctatccaggtcaggcatctctt

SEQ ID NO: 494433 - DNA, 272 bp, Homo sapiens
  misc_feature (93)..(93): n is a, c, g, or t
  misc_feature (110)..(111): n is a, c, g, or t
  misc_feature (208)..(208): n is a, c, g, or t
acacccccaagaaaaacacagggtgtggagtagaaaaaggttataagttggatcttaattgtaaattaaccttgagtgtcaagttctaaagcngactcagtgcatgaacnnaggaagactactgtataggtttttttttttctccttttaatgagaaagctttgcttaagggttgcatacttttattggagtaaatctgaatgatccnatcctttggagtaaaactagtgcttaccagtttccaattgtatttagcttctggttggaatttg

SEQ ID NO: 494434 - DNA, 904 bp, Homo sapiens
  misc_feature (888)..(888): n is a, c, g, or t
gatgactcagtccgtgtgtataatgccagcagcaccatagtcccctccctgaagcaccggctgcaggaaatgtggcgtctctggcctggaaaccccttagtgcctctgtcttggctgtgtcctgccacgagtcgtgcgttcttatctggaccctggtgcctacctccgttgtctaccgcgaccctcttctggtgtgcccagagtgctgtctcaccctgtgcatacacctgttaccagtttgtgactggcccccagtgggtgggcggctgtctcgagcttcacccgtggatgcttctatccgggtatgggatgtctcaagcagagacctgtgtccccttccctggtttcgaggaggtggggtgacccaactgctcgtggtgccccagacgggagcaaaatcctggtgtaccacttccttgcaggctgtctagcgagtctggtaaggcccagatgtggtcttgtgacgaggtggcatactctatcaggcgctgtccaaattgtgtgctggagccagatggaagcgattgtggtcactgtattggggagagcatgtgatatgctcgcccggtttgtgccgaacgttgtggtgcgggcaccagggggcgccttggctaggtgcaagtccgcaccgattgcgtgcgaatcgcgtgggaccacaaatcctgaccccggatggtgaggggcagctgcgcggagcgccatccatggctggacccgccgggacgccggccggcgtttatagggagcccagttctgcggtgcagcagctcgttttgaccacaacgccgttggcccctgcggtccgggcgggcacccgcggtctttcagaaggcccggggggggcggacccgcatagtcacgtgcggccgcatgtcctttctctctgcntcatccctgttcatgg

SEQ ID NO: 494435 - DNA, 127 bp, Homo sapiens
aggcatttatacaaaccgtactgaggaatctacaatctagaagataaatgacaacagagtcaaagcacctatctcagaagcagtaaggccactctatgatctctaagcagagaagcagtttgtctgt

SEQ ID NO: 494436 - DNA, 312 bp, Homo sapiens
  misc_feature (25)..(25): n is a, c, g, or t
  misc_feature (45)..(45): n is a, c, g, or t
  misc_feature (78)..(78): n is a, c, g, or t
  misc_feature (259)..(259): n is a, c, g, or t
gtactctcaaccttgttaccttccnccccttgtaaaatcattttnctgtctatatatatgtttgcactcacccctttncttagaaaaaatgctaacatactctcaacactattttgcacttcgcttttgtcacttaacggcatcctcaagatcactccatgactgtacatagagctcttcctcattcctttttccagttgtatatgctgccttgtgctgctccacattatttacttattttttatcagaactgaagtcnccaggtaggtacattctttccagacttcatgaggggtaagttgggagggtgag

SEQ ID NO: 494437 - DNA, 168 bp, Homo sapiens
cccttgtgccaggctggcaggcagcaaggcacagtggtcagcagttctcacctgggcacccccctagctggcagggccagccttgtcccatgggtgcacaggccccatggtggcaggcaggcagggccctgctggcgtggcttggccttgtggtccctgcagctctgc

SEQ ID NO: 494438 - DNA, 892 bp, Homo sapiens
  misc_feature (1)..(1): n is a, c, g, or t
nagcacacagagacagaggaggtcggcgacggcagcctcgcccagccaagtcgtgtattgcagttgtcttctgtgatattttggttcaggtgtgtcctcagtgaagtttttttgtccgctcttaatttgcccccccccgcttgtgtcctcagcgcctttaaagaagaaagtgcccccttgcctcataattggagagtccttgctttttctaaagaggaaacctctctcccctttgagaccaaggaccccttggtttcggaaagccatcgtcttgggcaatcaaaaaggaactctgctgggaacacaccagtattccgcgcgttccccagcacttgttaggccaccatgggcaaatacagactccccccgaaacttctcttggccgaaatggagcttcctgaccctctttcatataggggttttctaaaacgggctattgtaacctgtttgttaaagcaagaaggtttcgaagcaagcgtctttcacagtagcctataactgaaggaatcacgtgacttccctgtgatgtatgggtgtttcctgcaaaagtagtctcgaatttgatgctggaccacccccccgaggtgttcctcgtacattattactcccccacagagcgtttttaagcatccccatccttttgccctgtatttgtccccatttttgcaatccccatagaaggtcgccaccttattgtactccaggaaatgcgactctaatccttctcttcccaaatcgctgtaagtcttatccccctatataaacccctctttgtcctctcgctttaagtcaggatacaccccgggtcgtttaaaaaggagattttctctcaccaacattgcgggccacttttgtcctccccatttaaaaaaatgagaaacccttaacaagc

SEQ ID NO: 494439 - DNA, 139 bp, Homo sapiens
atttcccttcccttcttttaatgatgctttaaaaataagtaatacatccaggctgaacaggcaaaaataaggataaattatagcagaagggacctaagagataaggatgaactttctgattaagaagggtaatgtaaac

SEQ ID NO: 494440 - DNA, 709 bp, Homo sapiens
  misc_feature (52)..(52): n is a, c, g, or t
cattgtacaaagttatgtttatcaaactatgtgatatatttataatacatancttagaaatgtgtgatattgatcctttcggatgggactgttagttatcttggtctctgatggactcacagaaaattaaaaacctgcaaactgaaactcaccgtgaaaatatttgatataggtgtttttggatgcattttaaaaataataagtattctcattatttaaacactattgtaacacttcagcaagatgcagatttaggcctgaaatcaaccactggaatatatgaacaagaactgatttatggatgttactttatagagttttattatacacagtccccaggactatatagccaatcccagtagggcttaatcaggtaccgttaaatactgggctttaggaccataatcctaaactgcagaatgacatttatctaaagtaattaccttgtgactcaaccacatttcactagtatttgctaatctccctagcatatgggatctgggaattaaaaataagcagatcaaataaattacattttatggtatccttagaggatacaatttgactttggaattgaaaatatgtttgattgcgttactttgttaattttttttacaaggaaaaattaaaagaaagaaattcttctatatgaaaatgttactgtatagctttaaaggcagtaagaataaactcgtagccatgaattacc

SEQ ID NO: 494441 - DNA, 918 bp, Homo sapiens
ggcttctcctagatcgcaccgcctcttcctcctggcaagctatataatgatatcgcgtacacattccgttgctctcttccacgaggaggcctagacgccgccgcttgtgctgcgagccatgtctactagtgatccctgaaaagttccagcatatgatgcgagtactcaatacgcaacatcgatggcgcgggtggaacacatatcctttgccatcactgcccattgaagggtgtgggccgaagcatcatgctccatgtggtgttgaggaaacgcgagacattgacctcaccaagagggcgggagcaagtcactgaggagtgacggtggaacaccggtcgtgcatcgaccatgcatgcgagcaatcccacgccaatcccatgatcccagagtgcgttcttgaacggcacacgaaaggcatgtccaaagggatggcagaaaatacccagtctaggtcctacactccgatacgggtcattggcacgaccacacgctccagatgtagatgacctggcagctggacttggagagaacgattccgggcccaatcagagggactgctttcaactatctcggatgcctatcagctgtccgcaggccaggtactaccgaagacctacgtgtccgccgtggcgcgccaccgtgggtgttgtcgcagcgcacggacctaaggtcgcgtaggccttgtcgtgtcactacctagttgagtctccttgcaactggcaggaccccgtcttcgtggggctgtggtgtgacggcttgggcggggactctggggcccaggaaccccggtgtgagaggcagccagagggcgggcctaccccatttcttgtccggcccccagggggggtacacggctgggttgctccctttagaccccccggtcacttcccccaatcgtcccaggccttggcccgcata

SEQ ID NO: 494442 - DNA, 105 bp, Homo sapiens
aaaaaaaagggggccgcttgggtttttgaacttgttgcggggggtgcagtgagtccagatcatgcccctgccctccagcctgaggggcagagtggggctccccca

SEQ ID NO: 494443 - DNA, 183 bp, Homo sapiens
gcggccgcgtcaccggtctcagaatgtttgtgtcaattggccattaagtgagtagtaaggactgttaatgatcacggtgccaaacctctgaagaaaggaaaggtttagggaccactgtggtcacttacccttggttctcggtggaaatcacacttactgccaccagaggcgccttgaaaacaa

SEQ ID NO: 494444 - DNA, 307 bp, Homo sapiens
  misc_feature (136)..(136): n is a, c, g, or t
caaaggggggggggggggggcggggggggggtttttataaaaaaagctgttttttggacccccccattcccccgggaacccccccccccgggttttggcccccaaaaaaaaccccgggggcgttcccccccccggnttttaatttgggcgggggggggggaaaaatttttcccccggaaacccgttggccccttgggcccttttgggggccccataaaaccaggttgggccaaaaaaccggggggggcccgggcgggaattcccggggaacccggggggtaaaaaaaaaaaaggttggcctttttta

SEQ ID NO: 494445 - DNA, 462 bp, Homo sapiens
  misc_feature (60)..(60): n is a, c, g, or t
ccccgccagtggagagggaaaatgtggtgaaccggtggagtctggggatggaaaaggacntggccaaagttcccccgaagccgctgaagtgatgaaccacgaacctggaaccaagggaaggaaaattaaaggaggaggaacccaagcccatctacgcctgccagtggatgatggggatgctagtgccgagtgagacagaggctggactgtgataaatgtaggggtgggatttccagaccctgtttttagggcagaatttctgatttattactggactttgtaataatgaaatgatggaattttggttataagctctgtatttagatgtatgtttatatgattcagatatagacttattaaatttcatatgagatttgattgatgaccatttttaagacattcacttccatagttttcagcacttagtacacatgaattttgagaaacactgttctctaagat

SEQ ID NO: 494446 - DNA, 400 bp, Homo sapiens
cccctccctcttttctctcactcgctaccccccgtatcttacgctctcccttaaggctagtacaggaaagcatggtctggtataggcttcacggaaacttacactcatggcagaaggcgaagagggaggaggaacgtcttacatggccccaatcatgcagatacatatcgaatgctgggaggtgctcttccctctttaaactaccatatctcatgtcacttcctgtttcaaaaacatatatggatatctcctccattcccgcgccacactcccactcctttctttcactctccctttcccctccttcgtccatctccctttttttttcctcttcacctcgtcctcctctcctacctttcacttcaccatttccttcttttactttctttctcttccttct

SEQ ID NO: 494447 - DNA, 396 bp, Homo sapiens
cgaccgaaactctgcgcgggtgtacgaagtttcggcttggcctgtcgccccgatctagagccggtggtagtctttagccgtgtcgttgtcaggcagcccttatgggcaatcacaagatcggaattcgtcgggtcaacgtcgagaaaatcctgctggcggcggagaaggtcttcgccaacaaaggctatggcagcaccgccatggccgacatcgccgaagaagcgcaactgccgcgctccaacctgcattactacttcaccaccaaaagcgagctgtacagcgcggtgctgttcgacctgctggagttgtggaagcaggacgccctgagctttgaaaccttcgacgaccctcgggtggtgctcagcagctacatccgcgccaagatggccgcgcgag

SEQ ID NO: 494448 - DNA, 194 bp, Homo sapiens
cgcttctcccacaggcttgtccccaggcccagcagtgtgagagccagtcttcccaggccaggacagggttcagggaggcagctctgtggtgctgaggcctggccatcctgtgtcacaacctcctccatggccagagtgaggtgaccttgctgggggtgaccatgcctgggcctgtgcttggcaagtctttgaaa

SEQ ID NO: 494449 - DNA, 149 bp, Homo sapiens
tagaggacacgtgcctactgccgtatgtatttcagcactgcctcagatgcaagtgaagaccataacccagtggtcaaaggacagacagaaggaaaaatacctggaactgttgtcttcgggcatggttgataacatgaccaagacttgtg

SEQ ID NO: 494450 - DNA, 264 bp, Homo sapiens
atgacatgctgtgcagcagcggcaggccggtagggtctggctcagtagcggttgcaagcatgatgagcgaggtcatctcgtcttcgctggtggcgtagtagttaccagtgagagcttggaagatttcctggacggtgcccgcttggccaggtaggtaaatgatcccgcctcggcaacggttgaggaggatatcttcgcgcagcgcattcgagaagtacttgatgatgctggtcgcaaagacattgggtggttcgtgaccgtaga

SEQ ID NO: 494451 - DNA, 231 bp, Homo sapiens
ctcccccctggttttggccccccatgggccctaaggttctccccatgttgggctcaataaatgggccacccctttctttacctggccggtaggctcctggcccctaggtttttttaaaaggggaatgcccctggccctccccccctttgacctgctcctgcccccgtccaccccctttccccttttttaaaaataaaatccccctgcctgtggggtgccccggtccaaata

SEQ ID NO: 494452 - DNA, 114 bp, Homo sapiens
cacaacgttgaaaagggaggcaagcacaagatcggccaaatctccataggtgtcttttgggcggaggacaggtcaggccctggatactcttacacagcgcaataagaccaaagg

SEQ ID NO: 494453 - DNA, 547 bp, Homo sapiens
  misc_feature (18)..(18): n is a, c, g, or t
  misc_feature (72)..(72): n is a, c, g, or t
  misc_feature (110)..(110): n is a, c, g, or t
  misc_feature (118)..(118): n is a, c, g, or t
  misc_feature (151)..(151): n is a, c, g, or t
  misc_feature (153)..(153): n is a, c, g, or t
  misc_feature (167)..(167): n is a, c, g, or t
  misc_feature (173)..(174): n is a, c, g, or t
  misc_feature (222)..(222): n is a, c, g, or t
  misc_feature (265)..(265): n is a, c, g, or t
  misc_feature (304)..(304): n is a, c, g, or t
  misc_feature (317)..(317): n is a, c, g, or t
  misc_feature (344)..(344): n is a, c, g, or t
  misc_feature (357)..(357): n is a, c, g, or t
  misc_feature (364)..(364): n is a, c, g, or t
  misc_feature (371)..(371): n is a, c, g, or t
  misc_feature (373)..(373): n is a, c, g, or t
  misc_feature (397)..(397): n is a, c, g, or t
  misc_feature (405)..(405): n is a, c, g, or t
  misc_feature (409)..(410): n is a, c, g, or t
  misc_feature (428)..(428): n is a, c, g, or t
  misc_feature (431)..(432): n is a, c, g, or t
  misc_feature (436)..(436): n is a, c, g, or t
  misc_feature (453)..(453): n is a, c, g, or t
  misc_feature (484)..(484): n is a, c, g, or t
  misc_feature (530)..(530): n is a, c, g, or t
aaaaagatacagtctccncgcccacccacagataggcttgtctgcgctacacgcggataatccctctgtagnaggggagctgttggccttgatccccacggcctagtagntgttgacncgcgctctgtcttcgatgctcgtgtcctggggncngctcgtctatggcntgaganntgcgtcgggtagattggcaggagctccgagtggaggagagatgatctntcatgcgcttgaggtgtttgtcgcctcttggtcgcggtgaggnttgtgtccctagaggttcagatggcggcatgtatctggnagaaaaaggcccnctaggattgtatgagagagaaaggganctctttctcgtgngcaccanacaagcnantaaaacttctacgtggcttgaaanacaatccntgcnntctgtgtgagagaggaanganngctnttattatagtaaaatcntcttgctaggttatctttgtttctcatgttngatgtttggccagctttattctcgttgttcgtaggtctgcttgtangctcgtcatgtgtgaag

SEQ ID NO: 494454 - DNA, 196 bp, Homo sapiens
catgtcggtcccactgatgccagctcactgcacgcactgcacgcccagccggggtgacacaagcgaaactctgtctcaaaaacaaaacaaaacaaaaaaccagaattgagagaccagaatgggaggctttttggactctatatgctgggtagagcggggtatggatgggaataatccttaattcctttctacatag

SEQ ID NO: 494455 - DNA, 136 bp, Homo sapiens
aagatgttattaaagttttataaaaaggccaggtgtgcagtggctcacacttctaatctcagtgctttgggaggccgaggcgggggtattgctcgagcccaggagttcaagaccagtctgggcacacattatggag

SEQ ID NO: 494456 - DNA, 603 bp, Homo sapiens
agcggagcagctggagggcagaggatgcggcagcggggtgtcctgttctcgccatgaagccgcagcagagcgccggtgtccggaaaggtgtttcattcagcgagactacagtcagtggcacacgctgccagttccagaccaagttccctggcggagctggagaaccgtgattgatatggcaatcagtttgaatcaatacagtttcgaactcgtaagactaaccgtttatgcagaagcagagaagctcggcggccagtcatatctcgcaaggtttgtttggggtctggtcgtaacagcatagtaccatcttccgtatgcatggaaactcattatgagaaggttctgaagaaagtctccaatgtacattcaagagcagactgatgaagatctatgctccacaaagggctcctccgtgacagacccatatgtgagcgacggactgcgagttagttgaaacatgtaccattgtatgaaagacaagaggcatgagcagttgggaaggataaaccgacagaaattgctagatcccacattccagccgggccctcatgtatcgacgtggccagactgtagcagtgtccctacctcctctccagagcatca

SEQ ID NO: 494457 - DNA, 392 bp, Homo sapiens
  misc_feature (21)..(21): n is a, c, g, or t
gggcctagcccaaggagggtncccttgcctttccccccggcaagaatttaaagagtgaccccaaggataagaaaaagcaactttgtgtggtgggggggcggggggtagtaagaacaccttaacttgagatcctaccttccttaagagcattttaagcatacaataaagtattatgaactataggcacgatgtggtacagcagatctctggatcttattttatcttgccaaatgggcaggaggaaacttggaggtgatggatgtttattacactgattgtggtaatggttccacagatgtatgcatgtattcaaacccatcaaaatgtatacattaaatatatgcagggtttttattataattatatctcagtaaagctgttaaatattaaaa

SEQ ID NO: 494458 - DNA, 160 bp, Homo sapiens
atacaggaaacagctttaccaggtcacagtatttagcaggcagcagtgtattgtcagaacaaagctatattaccagtgtttcttcattgtcgaaactcacatgctgaagtttattggacataatgacaaagaaatagatatcggtgtgaaggagatatct

SEQ ID NO: 494459 - DNA, 138 bp, Homo sapiens
  misc_feature (45)..(45): n is a, c, g, or t
taagttctaaacagtttcggtttctcaaccgtgccttttcttttngcttaattttttccttatggtttttgtgccactgttctatttctaggctttaaggcttagtcattgcgttcaaaaacttgcgactgcattaaa

SEQ ID NO: 494460 - DNA, 198 bp, Homo sapiens
ttttgcccccgctttatttgtcccccaagggtgggcccccctaggggtactggtagaaatcccttactcagttagaattttcctaaaaataagctttatttatttttttgtgaaaacaaaaagttttgggtcctttactactttttctacagtggccaattgttactcccctaataaaagcccactggtccctgttga

SEQ ID NO: 494461 - DNA, 309 bp, Homo sapiens
gtacgaggtggacaacctcgtgggaggctctactgacggagatgcagctcttccgagggggcccgtaagccagtgtacaattggtgtgcgtgttgggactttacctgcaccttctcctggcagcatggttcaagtggaggtgtctggtcagctcattctcaccaagctctccgtgacctcctcgggcacctaccggtgtgtggccaccacccagatgggccgcgcatccggtgagctgacccgtctcggttaccgaatccctcccgggggcgagtggccggcgctctgattggggtgcctccgtgggcg

SEQ ID NO: 494462 - DNA, 853 bp, Homo sapiens
agtttaaggatgtagctcttttatctaagaattcagatgtcatggcaaaaggcgagatttactgtttaaaaattgaataattttacatgacattcttgaaattctaagaagtccatgtgttagaaccattttcaaaaattcatcagcattcattaaagggcaaacataaatgcattcaatgcataattttggaaggtttaatgtgcagctcagacttcaagtaaactttggttctatttgtgtccattgaatgttctggaaatgacaaaaatatgtaaatggcttcatctaagttgcagtgttttaacagttgcaaagatgtgctctactcaaacagtctatagtcaattctacacctccaccatgcaacatgcagcacagtcattccttgttataccagggctgaatcttgcagatcagccgaggaatctacatgttcactttaggtaacaggggcataggtcccgtcgttaagatgaccagacagtcaaacagctgtcgctgggcaagtctggcctgctcctcattttatagtctcagaacatggcctttaggtctctatccgtatgggcacttcactaagaccgacggtacaccctttgtgaaactataaaaagctgccctgactttccccctcttctcctatttatgtcccttagatattttagggagcctatactaatttccacaccaggcacactttagtcccttagaaggcattatttcatacacttacgatgattaccactggtggtaggcacactctacgtaccgcaggaggaccccattcggcttgacggcgggccgattggtcacaggcagctaggtccaaggtggatacatgcctcaggtg

SEQ ID NO: 494463 - DNA, 1463 bp, Homo sapiens
  misc_feature (226)..(226): n is a, c, g, or t
caaatcccgggggagagaaaacacaccattgggggcgccaccatcttggtgggtgcccgccataactatccccacaggaagagatgcggtccccacgaaatggttccgcacaaaagggggagcctccctcgccaccccccccccggagtgggggtcgcccctcctcttgaagggaagagacccccccacgaagaaataaacttcggtggcgggagaaggagaacgncccccccattcctctggatggattgtgacgcgtttcacacagaaagcggccccccacaccacagagagaggttgttttttttttgtactgtgcttctcctggcgaggaaaccccttttttttggcggagaaatttttttataagggaggatttttgagaagccttctgtatttataaggggcgccccccctctggagtagagtaaatttagtggaaaccctcttcttgtcgtgaaacaacaattttctcgcgaaaaatgttgtctctgagtaagaggatatcttccgccgccaaaaaagtgcgcgccaattttgtccccccaaagccccacacagcgtgtgagagaaacagagaatatgtgattacaccctctggggagattctcacactgcagaatgtgtgtcccccacatctccctctggagagagagccccctctgcgtgtgtgtgccccaccactctgataatcaccgcgccacttttttaattgtggcctctcacagaccgcctctggcgcaaactccccacacaccacggggagaaagagtttgtagaaagtgttgagtttgaggagagagccgctccatctgtggtgaccaccacccacagctctttaataggcgccacagagagagactctgggagactctgagagacactttttgtgtgtgagagaaaaagagtgtttttcgggacaccctctctcagagaatagtgatatacacccccgccccacagagtgtgggtgtggacacttgtcctttttgtgtgtgaaagagagacaccagcagtgtctcaaggtgtacccagagagagagtgtcctttttctcagagcgacactctgtgcgacacacagtgtgatagagagggagactccccgcgggcgcacgacccaaccgcgtgctctctcccagagagacccccctgtggcgcacgaccactgtgttctccagaccacagagagaggtcacacacccacagtatatttgtgccctcttatatgtctgtataagagtgtttatacaccagagaagagagaagaaagagagccaagttctctcttacacttgtgaaaaacatctcttggatccagaaatttgtgggtgtgggagaaaaagaaaagatggggtttatcaagagggtgatttgtgaatatttttgccagccatttaaggctggcgcgctttaataaaggaataaagataataaataaaggaatttttgacacaattccaca

SEQ ID NO: 494464 - DNA, 1238 bp, Homo sapiens
tatagtaaaaacggggtttcactgtgttagccaaaatggtcttgatctcctgacctctagaactggtgaagatacataaattgggtgggtgggttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaagagaacagaaaaaaaaaccaacaacacagagcgaagaaagaaaagaacagagaaacaccgagagacagacagagaaagagagacaggagaagacgagcgggccacaacaagacagacgacagacaaagggagaaggccgagaaagagacaaaagcggacaaacgaggagaagcagaacagaagaaaggaagcgacaaggcaagagccggcgggagaacgaccacaagaaggagagagaaaagaggcccgagccggaagacaaacgacacaggaaagagcacaggagagagggaccgacaacaagaagaagaagaagaggaaagacaacgagcggagcggcaaagaagaaacagggacgggtgagagaggagaacgaccaacaaacagaagagcgagagagagcagagaatagaaaaaagaaacggagcgcgagagaagaaaacagaaagacgacgacagaaacaaccacaaaaaaaaaacagaaacaagacgaagaaagccaagtacaagaagagagaaaggagaaaccacgaagaaagacaaagaaagaaagacaaaaaagaaagaagacgaggacaagcagaaaaaacaaaaaaaaagagccacaaaacaggacaaaagaacaggaggcaaagagagaaaaaagcacgcaaagagaacggaaaggaaaaaaagaacaaaaaacaagcaaaagagcacaaagacaaacacaacacagaaaaagagaaaaaagagcacaaacaggaaccagacagaaccacggaccgagagaccagccgcacacggacggccgacgaaggaccagagaacgaagagaggcctagccagaaaagacagaccaacaaagcgacggacaacacgacccgcgacgacacgggaccaagaagaaaccggcacaacgaacaacaagcacgaagacagaacacaagacccacgacagcaccaaaacaaacaaaaactcacggaaacaagaaagaaagaaaaaaaaaacgaaagaaaacgaaagcagacgacgacaacgacacgcacaaccaaagacgc

SEQ ID NO: 494465 - DNA, 335 bp, Homo sapiens
ggagagagagagatatcagagagagacataagtgggcacacagacacacacagacacacacacacacaccccaaacgcagacacacatacagcaggtaacacccagccccaggcagcccgtgaagctgctgggttctgctctacgcgactacgacccaccggtgagagagcagcccacgggcacacgggcagacctgtcctggacatcacaagggcaccacttttggggagactcacgggcacaccgtgcgcgcacacctgaggctgggatcctgcgctgcctccccggcgatccgtctgaggtttcttcctactgaggcttctcctcgctcgat

SEQ ID NO: 494466 - DNA, 808 bp, Homo sapiens
gatttgccgcccattttgtccgtgtctgttatacttgatcggggttgcaccgcgcttgttgtttcagaatttttgctccgggttccttgagattcgagtaatcttaggaggattttctagtgccacacaccgaattcattggatttattggggggggtacattgaatctgtactcacttttgatagtacggtcatctgaacctattaggtctttccaaccaagtgccgccagatgtcttccagtttttgccttcttaatttctttgccagccagaagtttgtaggtgttccagataccagacttttgcctctttggttgtttattcctgagtattttctttatgatgctactgtacatagagactgtttccctaatttcccttggagattgttcaaccatggtgggttgttttttttttgaaacttttagaaataccttgtaattccattctataaatattagtcattccaaatctggcccccatcttaggaataccaaagtaaatccccgttctttttttcctaaaatgtcaccatgtaatagatctaaccttgcatatatttctgatgtgatgaaatgttgatatatattttctatcgtgccaactacagctctgaaaatttttccaagatagtacatgtattatgttttctataatacttacaccatcattattgttttaccttttatatctcatattctattttaattatggaatggtattattacatatccctgattaaaatattaaaatgtgctatgggaaaattaagaaaagacatattaaataaaccttgttatgtagta

SEQ ID NO: 494467 - DNA, 202 bp, Homo sapiens
tgcttccagtggctggtgcagtcccagcaggatctgctgttgggggctcctggccgtggtcactggtgggcatgtgatgccacatccctctgtcctggcctggctctgcaccactggttttggcttccatctttgttgtgttcaccttggcccatgctgccccttcgccatcttgcagaaacatgcactgtagtggaacggg

SEQ ID NO: 494468 - DNA, 219 bp, Homo sapiens
ctcatgctgctaatccagcactgtggaggcgagggggtggatcacgaggtcaggagatcgagaccatcctggcccacacggtgaacacccgtctctactacctataaaaacaaaattagccaggcatggttgggacctacctgtagtcccagctactatggaggctgaggtgggagtactagcttgagcccaggagtttttttctgccaggaaaccacg

SEQ ID NO: 494469 - DNA, 870 bp, Homo sapiens
gagaagatattaaattttacatgtgacagtgaaatgctatgtggtttataagattacagaccatttgttttcatgtggataattttagtgcatgctcacccggtatgtttttttttttaactgtgaacatttggcttgtctggttttcctttttttaattagataatcacacggaaaattaagcctgttcatatctttaacattcaggatggcaaaccaaggaaagaacgcattgagagattttaagatgtcccttataaggggagaagtgttcttaaaaagtcaaccagaaaactgtcatgcctttattggtcggcaaggatgtcttggtaatgtgtttcatgaatagaatatccaatagagataagctgacttgaatcatttcggagcaatttggccctgtgtaatatgtgtttcacgcacatatttgcacgtgggatttctccaacagaacaggggattcactacgtgccactttaacaagcaccaataggtattattcaaactccgagcatggggtcagaggaacatcacctcaatgttcaataatccttaaaagatatgggcttcatatactgtaatcattaaagggaaccaaggccgtcgggcgactacagcgtctttcgaatcacagaattatgccaccacatccgatgccaggtccctaattggtcaaaggaaggggatcaaggcacaaggggggcccgagactttaaaggtatcccgggatgagggccagcagggacgcggagccacaagaagagggcgaagaggccgcatagctcgccaggtggggcaaaaaaacggaaatggtaactccaggtgaacaaaacaccctgggcgaaccgagggggcagaacaagagggaaa

SEQ ID NO: 494470 - DNA, 105 bp, Homo sapiens
ggatgtaaaggacgtgtgacactccacacacagtggactgagcagaggcggcgtgggaccagaccctcccacatgccagcctggccaaggtggcacagaccagag

SEQ ID NO: 494471 - DNA, 653 bp, Homo sapiens
gactagttctagatcgcgagcgtcgcccttttttttttttgtttggtggtttaaaagcaaggcatgctggtggatgactctgtaacagactaatgggaatggttgaagctgctcccgtggttccactcgggagagtaatctgggacatcttagtgtttggtttggttttttcccctcctctttttttggggggggagtgtgtggtggggttggtttttaagtctggtattttaaattcattaaccagtggttagcccttagggggaggaggacggattgattccacattccacttcctagatctagtttagaaaacttgttccccatcgggggctcttaggagggagtatagtaaagggcctcatttaataacatactccttttggaaagtggccttttctctccacccttgagtagatccagtattggatgaacactctatgaaagtgggtggagcccatctggcccctcctcttttctaggacgccctatttgtgactggtgactttcagggactttggttggccattggcggattttgggggaggtaatttctaacttctttcacggataacatggaagaaaagttatggccccttggaaatggccccaaatgattgcaggttggtaattaaaaaaattttttccctttc

SEQ ID NO: 494472 - DNA, 352 bp, Homo sapiens
tgcgggagcaaggggcttgatcagggatcaggggagcttgacctcgggggctcacgtgatcctcgggggtcagcctcccaggtagcgggaaccataggcacacaccatcataccgggctaacctttggatctcgggaaaagacagggtctcacttggtggcacggggcgggtctgagaacctcgtggactcaagcagtcctccggcctggacctcttaaagtctttgaataacaggtgtagagccagggtgctgggcttcaattattcagtgtctgtaggatttggtatctggcaatttcactagaatttattttctttatttttttatttattttaggaatagagtctggc

SEQ ID NO: 494473 - DNA, 657 bp, Homo sapiens
  misc_feature (8)..(8): n is a, c, g, or t
  misc_feature (11)..(11): n is a, c, g, or t
  misc_feature (50)..(50): n is a, c, g, or t
  misc_feature (58)..(58): n is a, c, g, or t
  misc_feature (60)..(60): n is a, c, g, or t
  misc_feature (75)..(75): n is a, c, g, or t
  misc_feature (94)..(94): n is a, c, g, or t
  misc_feature (148)..(148): n is a, c, g, or t
  misc_feature (168)..(168): n is a, c, g, or t
  misc_feature (175)..(175): n is a, c, g, or t
  misc_feature (180)..(180): n is a, c, g, or t
  misc_feature (187)..(187): n is a, c, g, or t
  misc_feature (198)..(198): n is a, c, g, or t
  misc_feature (210)..(210): n is a, c, g, or t
  misc_feature (236)..(236): n is a, c, g, or t
  misc_feature (245)..(245): n is a, c, g, or t
  misc_feature (247)..(247): n is a, c, g, or t
  misc_feature (252)..(252): n is a, c, g, or t
  misc_feature (259)..(259): n is a, c, g, or t
  misc_feature (295)..(295): n is a, c, g, or t
  misc_feature (303)..(304): n is a, c, g, or t
  misc_feature (311)..(311): n is a, c, g, or t
  misc_feature (313)..(313): n is a, c, g, or t
  misc_feature (321)..(321): n is a, c, g, or t
  misc_feature (331)..(331): n is a, c, g, or t
  misc_feature (344)..(344): n is a, c, g, or t
  misc_feature (392)..(392): n is a, c, g, or t
  misc_feature (397)..(397): n is a, c, g, or t
  misc_feature (427)..(427): n is a, c, g, or t
  misc_feature (436)..(436): n is a, c, g, or t
  misc_feature (438)..(438): n is a, c, g, or t
  misc_feature (463)..(463): n is a, c, g, or t
  misc_feature (466)..(466): n is a, c, g, or t
  misc_feature (515)..(515): n is a, c, g, or t
  misc_feature (524)..(524): n is a, c, g, or t
  misc_feature (534)..(534): n is a, c, g, or t
  misc_feature (575)..(575): n is a, c, g, or t
  misc_feature (593)..(593): n is a, c, g, or t
  misc_feature (622)..(622): n is a, c, g, or t
cggcatcnacntatcctttggtccccccccagaggagacaggtttcctcngcttgccncngaggatgtggcatcngccgcccccaccccccccnccccccgtgaaccgcgggagttgggacagcggccagggctagatgggtgggacnccagtcctccgcccaaagcntgccccngtgcngggcgcnccttggaggcnagccccgggccntggccgagttttgcagcccaaggtcntggcaggcncnttgcngtgggcngcccgagagcaggccggagttccagacccccccccngagcagcnngccagantnccaggccnagtgacatcngtttgagcagatnaatatgccattgggaaaatcaaagactgtcggagaggaggacatggcngaccntaactaaagtgagggggaaagtagagcacnaaaagttcnangaaaggagatgaactccttattccntcngatgaaaatatagtcagaacagatgagtagtagaacttaaacatgcccngagttgccnggaatttgcnaaagccctgatataattcccgttgctgtagaaagactttcnacagtcactaatatatcnagttatgttccctagaaaaaaagtttacntagtttatagaaatgggctgaaaaatcccaattac

SEQ ID NO: 494474 - DNA, 1281 bp, Homo sapiens
gctctgtggtggcggcggctgtgagcggctggcactgctgtgcgcatgcggcggaggccagctggtgcgcctgtcggcgtgctggccctgtcggccgcgggatgagtgaagctggaccgagcccgtctgccttggagcatgagcgctgcgccgccgcgggctcgatactcctccggctcggcacgccgcgggtgctggacgccgactgccgcctgaaggcagaacctacgcctgaccgggcccggcggcggcatgagcccgcgcattgcagcagcgcgacgcgggaatgacagcgggcgctgggcaggcgaacgggcgtgtggttgcgcctgaggcacgatacttttcactgaagtaagggggttgtacattgccattaccagtatctcaatcacagctatgtcctggaaatacaggccaaactgaatatgcgttgaatttcgtaaggagtatcccctatttcattgatttgacagagaacgcacaaggatcaagggtttgaaatcacacgttgtaagtactaccttgcagccaggaggcagacgtgaccagtgggaggtctggcagagccgagcacgtgaaagtcctgggtggacagaaacggccccaaggggcacaagacccaggactgttgggtaatgacggaatgcgctatggcattcacatggcgcaggcagcttattatttctgtaaccttgcattggggaccgggcagggtaagcagaaggagggagaacaacaggagtagggagcatataacaaaggggtgactggagttacccacttgagattaaccaatgaggtgtggacaacaacatttgggaacttaaccaagcagagatcagggggatgaaacataccaaatgggtgacagcggaccaatacgtatagaaacgtggggccaatgaagcactaaatgtaacgtgcgagatcacacggagtataatgtagattggggaaattccacgagacagacggaacgcgatgtggtggacagaaaaccccgacggggtgattacgaaattgagtatgaggccacaaagatgcttgcgtggaggcgcacatggggcagggattggcacagcaaccaacaatatcattgacttgatgaggagtaccatacatgatggtaagaccgaacgagagacgagccatacagggaactgcgcagtgtaatcacgtcggcgagactttacctaaatcacactacaactattccgggtgtaaagagagggaaacgagacacgtacagataataacggagggcaaaaaaaggcagaa

SEQ ID NO: 494475 - DNA, 890 bp, Homo sapiens
ggctgtgccccgccggcttctacggcttgggctgtcgccgccggtgtggccagtgcaagggccagagccgtgcacggtggccgagggcctggtgcttgatgtgcgagcccggctggatacggaaccaagtgcgaccagccttgcgccaccggtttctatggcgagggctgcagccaccgctgtccgccatgccgcgacgggcatgccgtgtaaccactgatcaccgtggcaagtgtactgcgcgtgcaacaggcgggctggatcgtgcgaccgtgtgcgagaccaagttgtagcaatggcactttacggcgaggactgcgccttcgtgtgcgccgaactgctggcagcggacactgcgacttccagtcggggcgctgcctgtgcagccctggcgtccaccggtgccccactgtaaacgtgacgtgcccctgcccggactccagcggctggcggactgtgctcaggcctgccagctgccactgaggacactgtgcgacccggtcactggtgcctgccactctagaaagccaagcagcgcagagggctgtgatgggctgcggggctgcggctgctcgtcctgctcgtctgctgctgctctcgctgctcggctgctgttgcggcttgccgtcggcaaggacccgttacgcgccgtggagctttccgctttgggaggaaagaaggcgccgaaccggaatatgcgtggcgcttcagtcgcatcagcattgaagctgcccggattccggctccggagggagaaactacccaaagtcgtagtggacacgacgatcttggtaacacaatcaatgcagttctggaccacctcagggttgggcagcctcaccaactgtctctcggggctcctttctcgttgaaacacttttagggctgtt

SEQ ID NO: 494476 - DNA, 1192 bp, Homo sapiens
gcccgccggacatcaggcggctcccggggtcatcagacattatgccgggcatgatgccactgatccctttgtggccttccacatcaacaaggggccttgtgaagaagtatatgaactctctcctgattggagacctgtctcaaagaacagggccagtctttgagcccaccacggaataacgagtctgactagatgagttccgtggagtctgcgggccacagggtgagcggattgggagctcattgaagtgccaagacatgtctacttcctgctgtaccttgtctgcacatcttgctgctggatggtgctagcctggctcatccttgggggtctttggagacgttcttttatggccttcctcctcgtgtgtcggtgctgctcaggtgcagttcaggcccaggcgtggctggttgcagcatgctttggggcacctgtcggtcttcagcacctgcacagtgggacaccatgcttgctacagtcattaatgtgattgggacatactgacaggggggaccccctgtcaagattggtcggaaccgcacgagtgcacttgtccaggcagcagtgccaaggcccaacctggcttccagaaagacccagacatgcaatgatgcatacccttcttctttgcgctttgggggaaggatccatactcgtgtgcgagctttgggaagacaagaagtgatcaagactatattgccgaacaatctacatgcaccagaatactttcttcctgaatttggcccccgagtcttgggtgacttctctaactttccaagctgcgtatatttccacatggtcatctcagcagacactgaagtgcggttgtacttggagcctgcgatgacgtaacctttctacggtcgggtttcttcctacactttttgtgcccactaatctggggctgaaaagacattccgggacctgtactacgataaggtcagggttccctgaaaacgcaactgggtgtgagcagtgggctgatcaccatacttgaacctatatttcccccatgcatcattgcgaccatgaccgggaaccccggtcactgcggttccaccacagtgccaggggcccaatgtaaaggtgctcccaaatcgtgtgctttaaaagactgggcacacgtggtacacaccgctggatttcgaatgtgagccacattgtttgtccacaagttctcaacaatatcaca

SEQ ID NO: 494477 - DNA, 881 bp, Homo sapiens
ggctggctgagaggaagtgctaaggctatggacactctgctgctgggatcacctgagatgagtcatgctaggtgtctcaggtctgagcagtggtcctggtggcctgtggtctacaggcctggtgtctgctcctccccctgcccccatgtctggagttgagctgtcggggacccaggtgtcctggtgtcgcggatggaggagccaaagctgttccagggaaccgtgatgtctgggcctagggcatgagacctgagtcctggtcgccagtggcagacatggcactagaatatagtggccacctacatcgtttgccaagtacccctgtgatgtgtgccgtcttcggggccggcacgatgtgatctcactgacgaattgtggctaccctgccagtacccagactctgtttgtctacctgtcgctagaagacagctgacttatgagaaatcttcgtctttgacacttggtaagtctcctaggccagatcagacggtttacccacccgctacctcactctcctacaggaagaagacagtcctaggagctgatagccagaggaggagtccatccacagggccctggcatgcccacaggatcccctaggggctggccgctgtgttgtccacgggggtgagttctggagccagtaccggattaatgtgacgtgaggtgaacccactgggtgccagcacactgcctgctggatgtgagcttgagaagcatcttggcctgacccacccaggctgctggtagagtcacgtaccaggttacccccgacgctggagcaggtggacttacctgctcctgggcgtgcagccattctggtcaattccgttggagacgcgggcaatccagcctgttccgggacatggctggggggggtc

SEQ ID NO: 494478 - DNA, 328 bp, Homo sapiens
gtgactctagcggatccagtgtcatgtataccttactgatacacgaacacgtgacacgtggatgctgtatttaagtggtgtatgttattttcttgagtaaccaatggctgaaaaattaatggttcaaccaggttagatccttggtccgtgtggaatccccaatggtttttccttcttggttggtggaggcctggtggatgttcctggggaaggtcctggttcctttatattaagggtggtgggcgttgctttctcccttctgcttttatcttttccacagttgaggctgggtatgtactttcaaagaaatggccatgaatatgtgtaa

SEQ ID NO: 494479 - DNA, 454 bp, Homo sapiens
gcgtcgactataaacagaagatctttcctcttctcgtttacagtaaaggctcttggtatctttctgttggaatgatttctatgaacttgtcttattttaatggtgggttttttttctgggtagatttaggcctaaatcggcatcatgccaaacttgtgactttgaagctaatcctccaagattgaggttttgttggccttgacttacctggagtaaaggccttaattcccttccttgggctatggttggaggttaattttaaagagggtccggttttccttgaaccgggaaaaggctatggccttggcccggtctcttacatatcgcttgggggaataaataggcggtggtggtatctgaaaaaaagaacaaaaaaatttttccgccctacaggtggtcgttagtatatgtcgcggcggcgccattttgaggagtagtaggccaccgggttctt

SEQ ID NO: 494480 - DNA, 539 bp, Homo sapiens
  misc_feature (141)..(141): n is a, c, g, or t
  misc_feature (251)..(251): n is a, c, g, or t
attggtatgtgagtccagtatggtgctctgtggaggaggctggttcaggcgcgttcattgaccatgccaccacaacgacggatcctcggagtggagcaatcgatccacccttgctgtgagtctcctatctcaaaatgtacnacgcgatctatagtgagcacgaggctcccctaagggcctgggccgctccttgggcgcactaattccgatcattccatgaagtaccaagtcctaacgtttgaacatacacnctacgccctgtatcgatggagccctatagggcctgcagcccatggaggacttgtgtatgtgttctctgtgtgatggaggagggaaaatatctagactcgtaaacacatagattattcttaaccgatacgtgctttatagactcggtatgctttgcaccgtcctgtgacttcaatcgcgcttgagtcgtggatgtagcgacggtgtacccacaggcgctcaaggcgggcatcgtttgggctgactatgtgtgtgacacagtcgcgtgaacgttttcgcctcggggtgca

SEQ ID NO: 494481 - DNA, 243 bp, Homo sapiens
gatcagctccgtcggcgagtggatcatgccgtccatgaagtccacgtcgcgctccgcacagtgcctccggatcgcggcgagatactccgcgagggtggagtagcgctcgtacctcacgtgcacgaacgacctcgcgggcaccagcttgaacttcacgcgtgtgagcacgcccagggtgccgaacgagccatgcatcatgtggaagaggagcgactcgtcgttgtcgggtgttgcccgccgcac

SEQ ID NO: 494482 - DNA, 179 bp, Homo sapiens
atggagaccccaggctgagcaggctgaggcaggagaatccttaatcccagaggtggaagtgcagtgagccaagatcatgccactgcactccaccctgggcaacagagtgagactccgtctcaaaaaacaaaaaaagaacaggccaagataggagggagagaaagctgctgacgcccccc

SEQ ID NO: 494483 - DNA, 489 bp, Homo sapiens
gattttgaatctgacaggttctcagctgcttttattaaataacggattttcttaataattactgtactcaaacttagcaaaaagctctatttatagcccagttttttagtcacacactattgtgtcttgtcaaattgaaaccatatactacattctttacttattaagatggtctttctttgtaataattttggagtaaatagtttacttatctaaacctctgatttctgatttaacagatttttgaagcatttattttccttaccatacataaaaattgtcagttgaggacaaggaaggattaacctggactacggtgaataattgttcaggttgcttactgtgtaactccagaggagcattcacatggtacaatttgcagatttaagtatttattacaaccattttctggcagataacagtggaacaccctgttctgttaaaattagtttattatgacaaattgcctacagatggacattaaactgt

SEQ ID NO: 494484 - DNA, 181 bp, Homo sapiens
cgctctcgcgctctcccctccctcgctcgttttctctctctctcgcccttgccctctcgctctctccctcgctcgttttctctctctctctctctctctctctgtctctcgctctcgccctctctctctctctgtctctctctctctctctctctctctctctcccttctgtcgtcttctc

SEQ ID NO: 494485 - DNA, 783 bp, Homo sapiens
acggcaggttctcggcccgaaagaagctgacaaagcgcctgagtgaccggctaacatcgtgagggcggggaataaggcagcgtgttgtgctgtgtatggacgtgggctttaccatgagtaactccattcctggtatagtaatccccatttgaacaagcaaagaaggtgataaccatgtatgtacagcgacagagtgatcgctgagaacaaggatgaggattgcttattaggtcctgtctggtacaagatggcacatgaccaattcccctttctggtggggatcagtatcagaacatcacagtgcacatgagatctgatgctaccagattttgacttagtctggaggacattagaaagcgaaatccaatccagtgttctcaacaggctgacttcctggctgcactaatcgtgagcatggatgtgattcaactatgaaacaataggagacgaagttcgagaagaggcatatatgaaatatacactgacctcaagcagccgattccagacacaaagtcagcgtgagatataactaagttcatcgcgtgaagaaatgtgacatctccctgccaagtccttctctgcctgttctccacctttggaaaggcatgactgccaggtgcggacagagggtacaccggccctgtcagcttaggtggtcattgccctttcgttcccagtaaaaggaataccgaaaatcagagaagtctggcattatgaagaggggatgaactttaaaggcgaaatgtggccaaaatatacaggaactcaaaagggcttaaattt

SEQ ID NO: 494486 - DNA, 270 bp, Homo sapiens
ggctgttcctcgaggattccattccagcagggtgaacggaaacaaatacaaacccgaacgtgttccgtcgcaggatgggcgccgcctgtcccgggccttagcccgacatctcttctcgctgctccttgtccctgcgcacctcggccgtgtgcagctccttctcgcgcagccgctcgcgcagtggggccaggtgtgcctcgggaatctccttgctgagctccaatcttgtagttgaggcttctcctctgtgctgaaaaatagcttgacggg

SEQ ID NO: 494487 - DNA, 405 bp, Homo sapiens
  misc_feature (7)..(7): n is a, c, g, or t
  misc_feature (24)..(24): n is a, c, g, or t
aacccgnccagtttgtttttttcntaacagtcagggtcttggctctgttaccccggctggagagtagtgatgtggatcatagctcactgcatcctcaaactccctgggcttaagcagtcttccctggcttagcctcccgagtagctaggactataggcacataccaccacacctggctaatttttaagttttttcatagagatagatcttgctttgttgaccagcttggccaacatggagaaacccccccatctactaaaaatacaaaaatttgctgggcgcggtggcacatgcctataatcccagctgccctggagactgaggcacgagaattgcttgaaccttgaactgggaggtggagtttgcagtgagctgacatcatgccactgcactccagcctgggta

SEQ ID NO: 494488 - DNA, 1618 bp, Homo sapiens
  misc_feature (1618)..(1618): n is a, c, g, or t
ggggtttgccgccagaatcacaggtgtcgtgaaaactacccctaaaagccagaatgggaagaggtacacagactcatatccaggacattggtcgctcagtaggcacacgtaggattcgcggcgaaggtccactgcattactggtccatctggatctagtaaagtgcggtggcagtcggacaaatagacaccattgaaacacatttgagaaggcaggctgctgatgactggagaaacgggcgtccgttcaatgtactgcactgggatctgtggagtaacatcgtgaacatgctgaagtcgttgaatcgctgggtgtcagccagttggactactcgtgccttgttggagaactttgacggagccagggcacaagttaactcagtggtgcacctgacttcgagttgggaattgtgcctccgaaggacgagcgagcaggcagctgtatagtcgagaaaagagcgattgtacttgagcgaaggggataccagttcgtcacgagcatggagctggttgacctggatccgtgggaattgttgttgacatgggctggcctgttggccgtgacattgtctgagatggcctggtagtcgtccagaagtaaactggtgcaggagcccagaaggaggcctttgcccatatcatggcgttaagcagcacctggggggtgatgcacagaggcaagcataaagttggacagcggtggtttggaaaccagaagacttgtggaatttccccagctttggaaggcccaacgcccctaacaaggacccgtggcaatccaggacttattgcatgggatagagtgggtttcaaccggggaacggtccaggagcaaacttctaccactttcaaacgaacacaagtttggggctttaactaacgcccccccagaaaccaaccaagtgtcatagcaagttttccggttgacccaaaagtatttcctggggattcgtcgccagcactaggggtgacacgaaaccacatggccatagagcacggccgagagtggtggcctaaacccagtgggccctttggagggtttccaaggcgtgcacttgggaaacacaagcggtccacaacgccggtattacgcggatctttggcgccacaattggcccacgtttgggacaaccccatcggcccttggaccttttaccgaggctatccactgagacattggcatgtttcctaaatcaagcccaaaactaacgcccggaccgttgatgagaaagccccagtgtggaccctggccagtcaatacaggggactgttctttacgaacacctttgcgggagcaaattgggtcaccggcacccaggtttagggccccaatataggaagcacaggcggtggtctactacaaacccacggcataaggggagggagcaccacttgtgcgcacaaagcaaaggaataagtccggagaagagcaacactgtgcctgaaagagcccacacagatagcctagtactgaaaacatctactgggcaacaaagtcggcagtcgaccacataaacttgggaacacagagctactcaggctgttgtggtagctccacaataccacacaaagtaggacacaagtgagcagtagaacacaagacgcaagcagaatcgatn

SEQ ID NO: 494489 - DNA, 467 bp, Homo sapiens
  misc_feature (467)..(467): n is a, c, g, or t
gtcccctgtgggtgctcctgaggctctggacctcagaggcctccagaaagacagtgggcctctgcctgacgccccctgtgaggtctcactgctggggtgagccccccaatggactacctgtgattcccctgaatcccatacctgaacctacacatgcctgctccctgtgcatgcaacctgtgctggtgtaatgtgagtgccctgtgggtgcttggtgtgatgtgctgcctgtgtgagaaatgcctgcctgcccgatgctagatgtgtgcccacgccaatagcatcaatcgcccgccgatggacgcgcaatgtaaagtgattgggaaagacaagagacgagagagaaagaagcacaataaccacgagacaccaaaagatcgccaagccaaatggatcaaggagcacacccattcataaaaaaaaggccaacgggaagatagaacacaaaccgaaaagcaagacgaaan

SEQ ID NO: 494490 - DNA, 369 bp, Homo sapiens
cgcgactggccttgcgggagagttggggcctgctcctgaagagataccgctatgtcgatcgacatcgaatcttcggatgtgatccgccttattatgcagtacttgaacgagaacagattacatcgagcgttagtcaccttgcaagaggagactactgagactgtgaatactgtcgacagcatcgagagttgtgcggctgacattaacagtgctcattgggatactgtgttgcacgctatacagtctctgagaattgccagacccctcattgacctctatgaacaggttgctctggaattgatagagctccgtgtagtgtgctgccaggtcacttatgagacagactgatcccatgatcatgttttactt

SEQ ID NO: 494491 - DNA, 1217 bp, Homo sapiens
  misc_feature (91)..(91): n is a, c, g, or t
  misc_feature (105)..(105): n is a, c, g, or t
  misc_feature (118)..(118): n is a, c, g, or t
  misc_feature (126)..(126): n is a, c, g, or t
  misc_feature (545)..(545): n is a, c, g, or t
ccacccacaccctcggaaaaggacaggtggcccagaggcatccgtgtgttcaagaaccgcagaacatgaatgtgacaccatcccaaccagnactgttcaggtgtncttgttctcttgntctcactnactgactaccagcttctcgaggggagggccccgtctgagacacagagcttcacacgttccttctgctttatttcctctccctagtgaaacattaaacacaggaggaaaagatacagatgtagccatcagaaggaagtgaggctgtcattccaaatggccccccaccatgaagaaacccaggcttcttaaatcaggaacctcacgtctcagttttccctcaggtttctttctgtggtgtgaggacagaaacaggcgtccctgcattcctcagcaatcctctccttcctctaaaggcacgggagaggatttccgagcgcctgcgatgctgtggggaaccgcaggctgggcaccgtcaccaacgcgtcacaacagagcaaatctgcatagccttccccaactaccaccgaaaggatggctcnggctcagcttggtgaacgctcattaaacaaaaagcacactcgagtttcctagcttcattccagaactgctattgtggcacaacaaattcacaacaaattcacatcggagtcccctcgaccgggagctgcgggcccgggaatgcacagcacaggcagaagcattcgtggttcgtcagctcctggcagacgggactcacttcacggacacacagacccacgatcttcatgctattagggtaatttcatcttcacagtaaaaaatcaccaattcccagagaaacggagcatcagcccagctgtcgcacagggtctcgcgggtgctggtcacgggacctgcggccactccaagctaatgaagagccgtttactccggaggtgagtccccgagggaggactgaagtccaagctaaaaaggcggcgccagcgaagcggaggccgcttcctccagggaagagcccccagccctcccgggcccatccgaggcgccccacgcgggagcgcacggtggccggaggcggcgcggagccgagtgtgaggagggcagccgccgccacggcagtggccccacgcgcgcctcggtggcaggtgctccagcgggcggggcacgcggagcccgggctgtaccggacagtcctggaaaaccacaggaaagctacgcgagggtggcggccg

SEQ ID NO: 494492 - DNA, 823 bp, Homo sapiens
ggggtgttcctctctccccacacccggagtttcccgggcctgccattgtggacccgccccctatgctttacaccttagtctctttgcccacagacctcctcattccctcccaaaacatcctctcaagagaagggaggagaagtttcaagaaagtcaggaggggtgggtttggaccctgggcagggtggaggcagtgaccttgcccttggtccctctagccttcttccctgtgcaaaagagaatgaccctggagaggcattcttgtaggagaagaatctagcggccgtgggagaattggggccggagccggcggtgggcagagtccgctgctatacacacatggaggaattctcacgcccaagccccgactctctacgaccttggaggactcctgtgacttcactgctctgcgctctggagaacactggagagagtcctaccgacgttcaaactagagcaggtaaagagccagagtaacatgacctgccaccagtgcccgttgcccactgccctctgccctggtagcccccaggggattccttggcccatccgcatcatctctgcaagaccggatgtgtgtggacccctccatagagtgccccaacaaccaggaccaagatggggctcccaaaggaggtaaaggagaaccctttggcagagtgcttaaggacacctgactacctagaaaagttagacgcaggcagacgttgatcccaaggtcgaacgctcctcagaagcaaggtgggtcctgacagcagtggaattctcccagcaggcatgcaggacacgagggtgttgttaacacacaaagggagtgggaccg

SEQ ID NO: 494493 - DNA, 1135 bp, Homo sapiens
  misc_feature (91)..(91): n is a, c, g, or t
  misc_feature (105)..(105): n is a, c, g, or t
  misc_feature (118)..(118): n is a, c, g, or t
  misc_feature (126)..(126): n is a, c, g, or t
  misc_feature (545)..(545): n is a, c, g, or t
ccacccacaccctcggaaaaggacaggtggcccagaggcatccgtgtgttcaagaaccgcagaacatgaatgtgacaccatcccaaccagnactgttcaggtgtncttgttctcttgntctcactnactgactaccagcttctcgaggggagggccccgtctgagacacagagcttcacacgttccttctgctttatttcctctccctagtgaaacattaaacacaggaggaaaagatacagatgtagccatcagaaggaagtgaggctgtcattccaaatggccccccaccatgaagaaacccaggcttcttaaatcaggaacctcacgtctcagttttccctcaggtttctttctgtggtgtgaggacagaaacaggcgtccctgcattcctcagcaatcctctccttcctctaaaggcacgggagaggatttccgagcgcctgcgatgctgtggggaaccgcaggctgggcaccgtcaccaacgcgtcacaacagagcaaatctgcatagccttccccaactaccaccgaaaggatggctcnggctcagcttggtgaacgctcattaaacaaaaagcacactcgagtttcctagcttcattccagaactgctattgtggcacaacaaattcacaacaaattcacatcggagtcccctcgaccggacacacagacccacgatcttcatgctattagggtaatttcatcttcacagtaaaaaatcaccaattcccagagaaacggagcatcagcccagctgtcgcacagggtctcgcgggtgctggtcacgggacctgcggccactccaagctaatgaagagccgtttactccggaggtgagtccccgagggaggactgaagtccaagctaaaaaggcggcgccagcgaagcggaggccgcttcctccagggaagagcccccagccctcccgggcccatccgaggcgccccacgcgggagcgcacggtggccggaggcggcgcggagccgagtgtgaggagggcagccgccgccacggcagtggccccacgcgcgcctcggtggcaggtgctccagcgggcggggcacgcggagcccgggctgtaccggacagtcctggaaaaccacaggaaagctacgcgagggtggcggccg

SEQ ID NO: 494494 - DNA, 627 bp, Homo sapiens
gcactcgtacccacaccacctgagtcatacaaaaattaaaaatctctaaacagacctataactagtaaggaggttcaatcagtaatcaaaaacatcccaacaaagaaaagcccagaaccagatggcttcactggtgaattctatcaaacaattttgaaagaattaaaactaatccttctcaaactcttccaaaaaaactgaagagagaatgcttccaaactcattctatgaggccactattaccctgataccaaaaccaaagatactaaaaaaaaaaaaaaaaaagctacagactgatattactaatgaatattgatgcaaaaatactcaacaaactactagcaaaccaaattcaacagcatattaaaaggattaaacaccatgaccaagtggaatttaatcctgtaatgcaaggatgttttaacatataacaatcaatcagtgtaacacatcacattaacagaatgaaggacaaaaactacagtcatctgaatgcagaaaaagcatttgacaaaatttaacaaactttcatgataaaaatactcaacaaaacaggaatgaaaggaaattacctccacatataaagtccatgtatgaaaaacccacagctaacctttcactcaaaat

SEQ ID NO: 494495 - DNA, 1220 bp, Homo sapiens
  misc_feature (91)..(91): n is a, c, g, or t
  misc_feature (105)..(105): n is a, c, g, or t
  misc_feature (118)..(118): n is a, c, g, or t
  misc_feature (126)..(126): n is a, c, g, or t
  misc_feature (545)..(545): n is a, c, g, or t
ccacccacaccctcggaaaaggacaggtggcccagaggcatccgtgtgttcaagaaccgcagaacatgaatgtgacaccatcccaaccagnactgttcaggtgtncttgttctcttgntctcactnactgactaccagcttctcgaggggagggccccgtctgagacacagagcttcacacgttccttctgctttatttcctctccctagtgaaacattaaacacaggaggaaaagatacagatgtagccatcagaaggaagtgaggctgtcattccaaatggccccccaccatgaagaaacccaggcttcttaaatcaggaacctcacgtctcagttttccctcaggtttctttctgtggtgtgaggacagaaacaggcgtccctgcattcctcagcaatcctctccttcctctaaaggcacgggagaggatttccgagcgcctgcgatgctgtggggaaccgcaggctgggcaccgtcaccaacgcgtcacaacagagcaaatctgcatagccttccccaactaccaccgaaaggatggctcnggctcagcttggtgaacgctcattaaacaaaaagcacactcgagtttcctagcttcattccagaactgctattgtggcacaacaaattcacaacaaattcacatcggagtcccctcgaccgggagctgcgggcccgggaatgcacagcacaggcagaagcattcgtggttcgtcagctcctggcagacgggactcacttcacggacacacagacccacgatcttcatgctattagggtaatttcatcttcacagtaaaaaatcaccaattcccagagaaacggagcatcagcccagctgtcgcacagggtctcgcgggtgctggtcacgggacctgcggccactccaagctaatgaagagccgtttactccggaggtgagtccccgagggaggactgaagtccaagctaaaaaggcggcgccagcgaagcggaggccgcttcctccagggaagagcccccagccctcccgggcccatccgaggcgccccacgcgggagcgcacggtggccggaggcggcgcggagccgagtgtgaggagggcagccgccgccacggtcacgtgtgccctcatcgtcggctgcctcaggttggctaggatagctcacagtcgggtcgggagctacatcggagacaccgtgtctagaaaccggcccagtgcctggagaaacgcacag

SEQ ID NO: 494496 - DNA, 1019 bp, Homo sapiens
  misc_feature (209)..(209): n is a, c, g, or t
ttctgtgtttctttttttatttccattagtctctcgtctgcttctatctttatcctgtggactaagagacagagtgcagcataaacctagagagagaataccagaagatcgaagaaggaaaagggaagagacgagagcatgtccgtccgtctaaatccctccgtaaagagtgggtgttagcagccaactgttaggttcgtgtatctctnccagcagccggcttgttatattaccccctctgcaacagagaacacttggcaaagtgggggacaccacagctgtgtgtacaaagggttatagtgagaagtgttgtcccccgccgctttatggaaatggtggtgtccgcggaacagatgctagataaaaccgtaatgggggtataaaaaggaaaaaaaaaaacagggggtcggactgggaaacgtgcaccaagtagctgcatgaagaaaccgggtagggattggtggagactttgtgcagcgctccatttgggacggagtcccatcaccacgttggggacgcattcctatgacccccggcttctcctccctttgtggaccccccggaggggcccaactcagtgtggtgctaacatagcccgctggcaccactagtctccgggcggtggacaatgagagagaccacgtcttctcttcgcaccatccccttagcgtggaggaagtctagagaagggacgtgcggagaaccactcctggggacgactcagaagcattatgtgcacccatgtcgcgctgctcttgtagaaaacaataatgtatcatgcctctgtcacccacagatacactctctgcggtgttataataacctcacgacatgcatttttctccgagcttgctctttgcaataactcttccaccacgattattaaccctcaccgcgctacgctccctcattttctaaacagcggatcccaccaaactggatatttctcacacactttattcatattccacattcttcaaaagcgaccacaattcgcacagcacaataaacaaaaaaat

SEQ ID NO: 494497 - DNA, 222 bp, Homo sapiens
  misc_feature (5)..(5): n is a, c, g, or t
ggttntagcagcgggatggggccagatgtataggcgtgggcatgtggcaggcaggtgggcagtccaggagcagcacgggatgacaagcctccgctccactcccacccccgtacctacccacgttgtgtacaaaagcccttcaggcagccactggtggtcaagagtatactctgtggagctcccacgggaaaggggctcccccagttcagaccctgctttcag

SEQ ID NO: 494498 - DNA, 1176 bp, Homo sapiens
gacgtggtgtgaggttagcatacgtatcaaggacaggtaactacgcatggctcccgaagtgttgccaaaacctcggactgcgtggccgtgtactggccaggcggtcttgcgtaagatcgatagtggctagtagcaattcgtgcgtatcgcctgggggttagcagcttgggtataagtttcgtgtggcgtgatctaaacgaaagaaggcatacgcgagatttcatacagaaactacgatgtccatgaaagattttggaggagatgaggacaggctaggtatccttgtcagcagttgtacaggtaatgctctggaatataaagaattgctgtcagggttggaaattacctgagaagtttggtgcactggactctgtggttacctgtgaactgatgcacacatgcaatatcgttgggcctaaaggagcagtacgatgtcccgttcttggagtgaaagtgaagagcagattgtaagcatacaagtaccttttgaaacaaaacccgcttacacaaagagaaacaccaacagaacagagaccacgtacaaaccaaaaacactaaccaaacagctagaaacgcgagacgaaggacacgagagcaagatagagaagaaaaagacaagaaaccgagagccaaccaaggaaccatgagagacaagagctaacagaagcacacaggaagagacaaggcgagcgcagaacgagaggcgaccagttgcccgcgcaacaacaccctcggctacacgccgctacgacgagcccgacacgacgaaaagagcacacacagagagtaccctgagcaaatggaaagcacaagggggggtaccggggtagcacgcgaggtgaccgggggacgaccgtcagaagcgggggggaaaccggtgaaacaccggcgagaaaacgcgacacagcgcacggacgccgaacactgcaccaccaactgaccgaccccacgctgagaaacacgggaggcaggacgagagacccccaaacacatctcggcagacgcgacacaaaacacgggacacgcgacaccgagacagagagagaccaaaacccacgacaagcgacccgaaaccgtgacagacgaaggaagaacgcgtatagagacagcccggaggtcgacggaagagggacacaccatgatgtagaccccacagaacggggaacacgccagagc

SEQ ID NO: 494499 - DNA, 421 bp, Homo sapiens
gggttccggtacaagatgggggttggggttggccccttcccccccaacggtgttttcccggagaatggggctcttggttaaaacccaaattttttggggggaaaaaaaatcccccggggttgggttaaacccgggggtggttgttccggttttccagccccgaaaaaaggatttatccctgaagggaaagcccttggggttggttcaaattcagggggttttgttccgccagccccccccgtttaaaaccagggattccgggaatttttggggggggtttttggttttgaaaaagggactggtccgccgggtggtgaataaggttttaaggtttcctgggtcccgaaaaaagatgcccgatggccctttaggcccccttggggttttttaatggggccattaaaggcccttttgtttggga

SEQ ID NO: 494500 - DNA, 161 bp, Homo sapiens
  misc_feature (2)..(2): n is a, c, g, or t
  misc_feature (73)..(73): n is a, c, g, or t
cngctctagaggacccggaacactacgatggcaactgtttattttcatgtcagagtagaggtcacttgctgtnaatatcaacaagcattaaagatttgtctttgctagaataagtgaactaatactacgtgtttcgtcaaattgacccagaacgtatatcc

SEQ ID NO: 494501 - DNA, 534 bp, Homo sapiens
  misc_feature (503)..(503): n is a, c, g, or t
  misc_feature (522)..(522): n is a, c, g, or t
tatggaattattatcctttatatagtaataataaaattgcttcaaatctttatagttgtaaattattgtcttttgtcattcatagccttccaaatattgattagactctgacaaaaatggccagaaagaaaaccagacaaagcaaatacagtgaatgatgagtagcagacctgaccgatacattgcgttgcacattgtaagagagtcttcactacacgatttctccaccatgttatgtgtagaatactaagcatgataacagtctggtggggtgggttatgatgaacaagcaagaaacatgaaattgctaagcagttttagaaatgataagaatttagcttagttaaatgcttatttagtaagcaaaaattacttttagcatactgtttgtaaaagtggatttagaacccttaaatgggcataatgtgtgtataagacacaggagtctgccttgacttggaagggaaccagctatgggtgtggatcccaactgcaaagatgcnggcatgagtgtgaggaccntgggactgatct

SEQ ID NO: 494502 - DNA, 468 bp, Homo sapiens
ttttcttctccagtctcaggtatgtctttatcagcagcatgaaaatatactaatacatatttcatgttaatgggctgggagatttagtattgttaagatggtttgaatatttgtccccttcaaaactcatgttgaaaattaattcccaaaatgacagtattgagaggtggggcctttaagaagtgattgggtcatgagggatctgctttcatgaatggattagaaatggggtcttgctgtgaatggattaatggcttatgctggaattgagactgttggcttcataagaagaggaagagagacctgagctagcatcctcagcccccttgccatatgatgccctgcattacttccagactctgcagagagaccttaccagcaagaaagccctcaccaaatgcagcccctcaaccttgcacttctgagcctctataattctaagaaataaaatcctgttctttataaatt

SEQ ID NO: 494503 - DNA, 187 bp, Homo sapiens
agatagccgaacaaatagcaataccaggaagaacagacataagagtaggaaatatatagtatggaaggtataccagaaaaagacatggatgaaagacgaagaacttcttgaacagaaaacacaagaaaagatacaaaaacaagaaagacaacaaagatagatatctagatagaataatagatagata

SEQ ID NO: 494504 - DNA, 365 bp, Homo sapiens
cgcagtagctcatgcctgtaatcccagcgctttgggaggccaaggtgggcaaaccacctgaggtcaggagttcaagaccagtctggccaacatggtgaaaccccgtctctactaaaaatacaaaaattatccaggcatggtggtgggcacctataatcccagctactcaggtggctgaggcaggagattcgcttaaacctgggagacggaagctacagtgagcagcgatcgcaccactacactccagcctgggcaacagaacgagactccgtctcaaaaaataaaaataaaataaaaaataaactatttggttatcaggctgagtggcataagctcaatgtgactatttagtaacttccccgttc

SEQ ID NO: 494505 - DNA, 476 bp, Homo sapiens
tgcaagaaacacagagttctttgacgtgacaagaagaattataaataaaatagctccaaggcagacaggctgaatgagccttttaagacagcctgttggtgcctcaaactttaatacttagaatatcaaatgttagctccacgaggatagcatcctgggatacgtgtgtgtgtgtacgcatatgtatacgtgtgcataagtgtgtatatgtaggtttgtgtgtagcgataaatgttttgttgcctttatggcctgggggctgattgagggcctggtggaacgcccctagcccagaggaaggagcaggccctacctgcgttctccctgggttactccctacttcattacacgtaggcaaacaccaaaagccagggaaagcataactgctgtagataacaagggcagatctcagatagagaaaagctttctctgcaataaagaattattttgtgaatggtgaaaaaaaataaaaacaa

SEQ ID NO: 494506 - DNA, 872 bp, Homo sapiens
  misc_feature (149)..(149): n is a, c, g, or t
  misc_feature (231)..(231): n is a, c, g, or t
  misc_feature (263)..(263): n is a, c, g, or t
  misc_feature (280)..(280): n is a, c, g, or t
  misc_feature (282)..(282): n is a, c, g, or t
  misc_feature (285)..(286): n is a, c, g, or t
  misc_feature (288)..(288): n is a, c, g, or t
  misc_feature (291)..(291): n is a, c, g, or t
  misc_feature (293)..(293): n is a, c, g, or t
  misc_feature (308)..(308): n is a, c, g, or t
  misc_feature (323)..(323): n is a, c, g, or t
  misc_feature (328)..(328): n is a, c, g, or t
  misc_feature (394)..(394): n is a, c, g, or t
  misc_feature (402)..(402): n is a, c, g, or t
  misc_feature (458)..(458): n is a, c, g, or t
  misc_feature (508)..(508): n is a, c, g, or t
  misc_feature (527)..(527): n is a, c, g, or t
ggacggttggaggaacggcagtattcacacgtcggctgctgggaagatctggattctcgtttcaggtcaccatcagaaaagctaagtttgctgtatagtgaggatcaggagatctgatcctgattgcagaaccttccctgattacagantcttgggattgttgagaggattacatgtaaagtaccaggacagtgcatggcacatgtcgtttctcccacttcacccttctanaccatcccagaagatctataagatttcatcgngggaaatcactaggagntnctnngnaangngaaagaaggaagatngtcggttggaataanacacngggttgaatgagttccagaaagcagggttctcaacctcgtggacagcaatctggagaagaagagancttcaaanaaaccaactagaagcaacatgcagagaagtccaatgagaggggcctcctcaggaangaagacagctggtccacagcagaaaaatcttgaaccagatctcccaggangatggggtggtcgctctgnacgagaaccccccttcaggatccgtgaggaagaccagaacgaacaaagcagaagactccatggaaaagcgagatggtggcagtaaccagcgaaggacctccagaacccctcggaagaaaagggccggggcagaccccacgtggatgaaagtgacagaggcgtcacacacaatagaaatggagggtcaacgtgacgaagacctgacgactgcagaccagggcagtagaggaactgggactcaggcaacacagccagagcagccggaccaacccagccaagacaacagtacgaggcaaccggaagcagtagcaaattgcagcaacgcggcgaaaatgtgcaacagcg

SEQ ID NO: 494507 - DNA, 818 bp, Homo sapiens
  misc_feature (149)..(149): n is a, c, g, or t
  misc_feature (177)..(177): n is a, c, g, or t
  misc_feature (209)..(209): n is a, c, g, or t
  misc_feature (226)..(226): n is a, c, g, or t
  misc_feature (228)..(228): n is a, c, g, or t
  misc_feature (231)..(232): n is a, c, g, or t
  misc_feature (234)..(234): n is a, c, g, or t
  misc_feature (237)..(237): n is a, c, g, or t
  misc_feature (239)..(239): n is a, c, g, or t
  misc_feature (254)..(254): n is a, c, g, or t
  misc_feature (269)..(269): n is a, c, g, or t
  misc_feature (274)..(274): n is a, c, g, or t
  misc_feature (340)..(340): n is a, c, g, or t
  misc_feature (348)..(348): n is a, c, g, or t
  misc_feature (404)..(404): n is a, c, g, or t
  misc_feature (454)..(454): n is a, c, g, or t
  misc_feature (473)..(473): n is a, c, g, or t
ggacggttggaggaacggcagtattcacacgtcggctgctgggaagatctggattctcgtttcaggtcaccatcagaaaagctaagtttgctgtatagtgaggatcaggagatctgatcctgattgcagaaccttccctgattacagantcttgggtctcccacttcacccttctanaccatcccagaagatctataagatttcatcgngggaaatcactaggagntnctnngnaangngaaagaaggaagatngtcggttggaataanacacngggttgaatgagttccagaaagcagggttctcaacctcgtggacagcaatctggagaagaagagancttcaaanaaaccaactagaagcaacatgcagagaagtccaatgagaggggcctcctcaggaangaagacagctggtccacagcagaaaaatcttgaaccagatctcccaggangatggggtggtcgctctgnacgagaaccccccttcaggatccgtgaggaagaccagaacgaacaaagcagaagactccatggaaaagcgagatggtggcagtaaccagcgaaggacctccagaacccctcggaagaaaagggccggggcagaccccacgtggatgaaagtgacagaggcgtcacacacaatagaaatggagggtcaacgtgacgaagacctgacgactgcagaccagggcagtagaggaactgggactcaggcaacacagccagagcagccggaccaacccagccaagacaacagtacgaggcaaccggaagcagtagcaaattgcagcaacgcggcgaaaatgtgcaacagcg

SEQ ID NO: 494508 - DNA, 118 bp, Homo sapiens
agtaaaactacatctcactgatacacactagtcgaaccactagtattttatatattatgttttgggacgtgtctcattctgtaccaggttgagtgcagtgaccaatcacagtcactga

SEQ ID NO: 494509 - DNA, 664 bp, Homo sapiens
gggactgagccgctgagggtagttacgcttatttttttttggtctttggttttttttttccctttttcctgggagaacgggggtctcgtatatggcccaggaaggttctggaaacctctcgtgggcaaatattagacgaagagcccgcttcccccaaaaacaacagcgaaaaacaaaaacaaaaagaacaaacaacagggtgacggacacagcgctgcccccccgaaaacacaccttacagacagcacaaaagagagacagggcagcggcatgaggaccaccaacagacgggcaaaggtgacaaaaagggggggcaaaaagaggggtagcacacagaagggaaacacaacgagggtgacacaagacaaaaggagagagagggaaaagcctccccacgccagagaagaaaaaacaagagcgcccgcaggcggggaagacaacagcgcgggcgaggcgcgtcgccagcggaagcaaacaaaaatccacaaaggtcgagggcgcagacaagcacagaagaggggcacacaaactacacaaccggcgggaggccactaattccacaacaccaacaaggcgcaacaaccagacagcacgaagggccgaccgaaagcaaacagaaaacaaaaaaaaaaacagccccccccggcccagagaggggggggga

SEQ ID NO: 494510 - DNA, 258 bp, Homo sapiens
ggtacactcacacctgtaatcccagctactttgggaagctgaggcaggtggatcacgaggtcacggagttcgagaccagcctggccagcatggtgacgtgccccactctctactacaaaatacaaacaatgtagcttgggcactggtggctgcactgcctgtgtgtccctgtgctaccttgggacggctgacagcaggacgaatatgcttgacgccttgtggagtgcggacggtttgcacgttgatgcccgacgactc

SEQ ID NO: 494511 - DNA, 260 bp, Homo sapiens
gcaggctggaagtcagaacaagaagcttatagaggaactagaaaccttgagagacattcgttctcccaaaacagattactagaaatatttaactatacaacagaaggcagcatgtatagtatgcttatagaaggaatacaatatatagctgaccagaatggtggcttcttttctttgtatcattcatcttcttcttaaatcacttaacattcctgaaatgcttcactgtacgtagttcagtcgtagctattacttcgaat

SEQ ID NO: 494512 - DNA, 371 bp, Homo sapiens
  misc_feature (18)..(18): n is a, c, g, or t
ttttgttttaattagggnccctttcgggggaaaaataaagtaaaatttaataaagcctttgatcacatctcaatccataagttagctacaaaacaaaaaatcctagaactttttagagccatcacgactgacgaggtgaccgggaacaccagttagagaagggggttcggtgtttggggtggtgcggtgtttccggctgttgaaaagaatttgaatgaaattacaaactacccctcgtcaaaaatccacatgaagttgatattggtgcttataaatcactctctcccagtccctcactggttccaaccttcaggtgataaaaattaggatgggatccatcttccctgtgctgacagtctggggtccccgca

SEQ ID NO: 494513 - DNA, 218 bp, Homo sapiens
  misc_feature (6)..(6): n is a, c, g, or t
  misc_feature (12)..(12): n is a, c, g, or t
  misc_feature (100)..(100): n is a, c, g, or t
  misc_feature (187)..(187): n is a, c, g, or t
attaanaagctncttaaattaacagctctgaggaatttcccaggtttgggggtcaggtgggtcccaaaaccctcccttggggggcccaaacgataatgangcaaaaaggaagagaaccctctccagcctggctgacccaaacccaaccacacaatggtttgtctcaatctgacccagggggctgganccctccgtaaattgttgaacggctgcttccc

SEQ ID NO: 494514 - DNA, 356 bp, Homo sapiens
  misc_feature (47)..(47): n is a, c, g, or t
  misc_feature (173)..(173): n is a, c, g, or t
  misc_feature (235)..(235): n is a, c, g, or t
  misc_feature (241)..(241): n is a, c, g, or t
  misc_feature (268)..(268): n is a, c, g, or t
  misc_feature (289)..(289): n is a, c, g, or t
  misc_feature (340)..(340): n is a, c, g, or t
  misc_feature (342)..(342): n is a, c, g, or t
ttcctcaaccttctgaattagtgttgaaagtcccggttttacagaanggggactctaaacttagaggagttacctgctttgccaagaaaattctcaaacacagacatgtcagcctccagcgcctgtgttctcctgattgcaaccctgaatagctccacctcttagcaacccanaatgataacaaggggacgtctgtacccttcgatcacacactccccacgctcagtcactgcancaccanaaacccctgttgagctggtacactcanccctggggaacctacgcctanacctaaggggctgaactccgtatctcacgacaggtcacctcacaccatcancnaggggaatccgccc

SEQ ID NO: 494515 - DNA, 763 bp, Homo sapiens
  misc_feature (2)..(2): n is a, c, g, or t
  misc_feature (55)..(55): n is a, c, g, or t
  misc_feature (124)..(124): n is a, c, g, or t
  misc_feature (153)..(153): n is a, c, g, or t
  misc_feature (204)..(204): n is a, c, g, or t
  misc_feature (227)..(227): n is a, c, g, or t
  misc_feature (287)..(287): n is a, c, g, or t
  misc_feature (290)..(290): n is a, c, g, or t
  misc_feature (351)..(351): n is a, c, g, or t
  misc_feature (393)..(393): n is a, c, g, or t
  misc_feature (395)..(396): n is a, c, g, or t
  misc_feature (417)..(417): n is a, c, g, or t
  misc_feature (430)..(430): n is a, c, g, or t
  misc_feature (460)..(460): n is a, c, g, or t
  misc_feature (479)..(479): n is a, c, g, or t
  misc_feature (518)..(518): n is a, c, g, or t
  misc_feature (526)..(526): n is a, c, g, or t
  misc_feature (536)..(536): n is a, c, g, or t
  misc_feature (541)..(541): n is a, c, g, or t
  misc_feature (553)..(553): n is a, c, g, or t
  misc_feature (563)..(563): n is a, c, g, or t
  misc_feature (584)..(584): n is a, c, g, or t
  misc_feature (601)..(601): n is a, c, g, or t
  misc_feature (630)..(630): n is a, c, g, or t
  misc_feature (637)..(637): n is a, c, g, or t
  misc_feature (640)..(640): n is a, c, g, or t
  misc_feature (649)..(649): n is a, c, g, or t
  misc_feature (651)..(651): n is a, c, g, or t
  misc_feature (701)..(701): n is a, c, g, or t
tngaaaaaaccctaaaagaaacccccctcggcttcaaggatcctctttctgaccntaaaacctgcttcttggggggtggccatccctgcaacccgcccacccctaagtccctttacttttgtantctaactccaaggtattgttcagacctcngctcctgggggccggcccctggagtcttccctccctggtagcctcttaccngaattccaaaacacctaaggaanaaagatggatgggctggtggggaggggggtggctggggctgggccttcaccattccaganacnaggccagtgattatgcaaactgggggaatctcctcccatatctcccaagatctggtcctgnccaggccatgctaaactaacccctgccccaactctcctcccnannttaccttccttcctacccccntctccctctcccntcccctgactgttccacccaggaggagganactttaaatagccgggctnacagttttttattttaaaggaatttggctggggagctgnacagggcnccctgtgatntgaanaaagcttttggngcttgtcctnacaaccccctcagtcctcccnccctgtcctcccctgtntcctttcctcctcctgggttcatgttgtnataaaanaanattgttggngngtaattaatttgttcaaaagaaaaaaaaaagcaaaacaagagacttggtnccgactgaagcctattttaattttattttattattttcctcttgttagaaataaaaccctta

SEQ ID NO: 494516 - DNA, 395 bp, Homo sapiens
  misc_feature (91)..(91): n is a, c, g, or t
  misc_feature (94)..(94): n is a, c, g, or t
  misc_feature (116)..(116): n is a, c, g, or t
  misc_feature (225)..(225): n is a, c, g, or t
  misc_feature (227)..(227): n is a, c, g, or t
  misc_feature (230)..(230): n is a, c, g, or t
  misc_feature (260)..(260): n is a, c, g, or t
  misc_feature (299)..(299): n is a, c, g, or t
  misc_feature (315)..(315): n is a, c, g, or t
ttcaaaagagatacaactgaagcttgcaatggaacggatcattaaggaccttctcagaaatagatgaaatggatgtgggcttagcagttgntgntgaggatgattcggcacttcangagcttgagataattgtcgattttatgtgaatccctgcgtaggcagtggagcaggttataataagcagggcgagactcttcatcagccatctgcagggatggaagtccncnacnagacaggggtagaacttcattttctttggnttcaggatgaacctggctgctatcaacttccatgccctntataacccgtttgggnttgctcctctctctacagctttggataggatagcctccgggcttctttgcataccacgtctttccgtgaccagatgatac

SEQ ID NO: 494517 - DNA, 967 bp, Homo sapiens
  misc_feature (279)..(279): n is a, c, g, or t
  misc_feature (631)..(631): n is a, c, g, or t
aagagcgtgtgcgcgctgctccccggtgtcttttcgtgctccgcgcgcttctattacaaggcgtgttcttcatggcaggatcattcttcaccaattgatggggtctgggtcgcctccttcctccaccaagcgggttttctccggggcccgccgtcgcgtttttttaaaaccgccggcggggtggtttttcttccctcgccccgcgcgggctctttcatcccgccgcgccaccccttctgttttttgcttcgcgccaccacaagacgggccgcccctctnctccacactgtggcgcagacttggtgctccccccttgggggccccaccacccctggggcggaccacatcctcgtgttccccctgggggcaaaacctctctggtgagtcccgtactacaacattgttcgccgcgcggcgcgtcctgcgggggtgtattatctcccccgttgtttttttctgcccacacccccttgggttcacccagaagagacgtcgcttgctgtagaatctctcctcctcctcgctcgctcgccacacgtagtgtgtgtgttctttctctctcctcgccccccacgcagcagcttgttttgtttgttgtttgtgcgctgcggaggagggccagaccgatagnagaaaacactactctctctttagatagtcgtgcgcggcggtacaaccacaataaaatagggaacaaagaggagtcgctgttccccaagacagctgcggcggggtgcaaacacaaaaccctgtggaggaaccacctcttctatcgggaggggcgacgacccacaccacaacgtcgctgcagacctcccccccaccccaacgaaaaaggccccctccgtcggcccccaagaggggtttttttttccccccccccgggattttttctcgggggcccacaacttccgggaaaaaaaaaatattttttgggggccccaaaaaaattttttttttcccccca

SEQ ID NO: 494518 - DNA, 140 bp, Homo sapiens
ttaagtatagaatggggggaaatactgtgggttaatggttcagactgtgagcttccttggggaagatgaggtatgtatccacggcttccacatctttcaactggtggtttactcgaactgttctccaccctgttctgtgc

SEQ ID NO: 494519 - DNA, 1123 bp, Homo sapiens
  misc_feature (1)..(1): n is a, c, g, or t
  misc_feature (390)..(390): n is a, c, g, or t
  misc_feature (574)..(574): n is a, c, g, or t
nacaaaaaaaacggagtttttgtttccctagatttgcatccaaaagagaaggcggccgtttgttttgttgggtgttctgcctcgcgttggtgtagataagcagaccaaccacaaaaccaacagaggggggggggttccctcgtcgaaagcaccatctctttggttaggagtagaggatccacccaaagggtgaagcggcggggttctaacaaatgttattactttgtggggcgatcacaccacatgaccctctccagtagggatggacgatatgtgtgtgttcaccactgagagcgtggtgtaccacactcatttgtccctatttccctcttttgttgggtccttggggtacattgtggtgtggtgtagcgcgcctcccgccccaccatntggtggctcctccgcccacatattgttgggtctcccagcaggaatatgactcccacacaggggtgtgtcacctggtcctctaaactgctcccgtttggttagcgcagcagctccttgttcgttgtggaagagacacggagcgtgctaaacaccagcttgtggtggggccccacacagaagcctnctttgttgagtgtgagagtcccggagggaaaactcttggcgggtttcaaccacccggcggcgtgtgtgcgaccacaggggagtgatccttgtgagagccacttgttgtgccccccccacaaccgaggagagggttgtaggacatctccacacagaggagtaatagacagggcaattcgtgccacaagagagggcccccacacaactgggggcaaaacatcagaagggctacagagccaggcggtgtgaagaccgtcagagcgccttccttcgtgcccttggaaaccaccacccctccctagcacacaagggagtgtcccgcccctggagaggaaccaagcgaggatgacccaagacttcctgacacctcagtgttcccagggcaacccctgggaggcgagcgcaaactggggctggcgggcagcccaaacttagtgccctccctgggcgcccccccccccttggtggcctttgtgaccccccttaagggtgcgtggtgaattttttttttaaaagggttcccaattaaaagttgggccccctcctttta

SEQ ID NO: 494520 - DNA, 181 bp, Homo sapiens
cacgtacaagggttttcccatgaaatttacattgagttgtccacctccagcttatagggcttctggaacagagtgggtcttgctcttagtgattccatgggagaaaatggaattggaggtactagtagaattcaggggaactgtccagtcagagacttcgactgtcatagatttggagctt

SEQ ID NO: 494521 - DNA, 294 bp, Homo sapiens
  misc_feature (137)..(137): n is a, c, g, or t
  misc_feature (173)..(173): n is a, c, g, or t
  misc_feature (214)..(214): n is a, c, g, or t
  misc_feature (250)..(250): n is a, c, g, or t
  misc_feature (263)..(263): n is a, c, g, or t
  misc_feature (280)..(280): n is a, c, g, or t
attcggcacaggagggaagtacctgcagtgaccctgcccccatgaccttggccaggcaggatgattccagagcccgtactcgtggggatcctcactgaccagcccagccccatccgcaagccaggctgggctggcantaacttcgctgggctctcccaagaccatcagcagcncatccagccccctgggctcgggctgctgctggttcttcatnaagtcccttggtctctagctcggcagggctgctctnctctccgccctcntttgtgtatcaagtggncttttttttttttt

SEQ ID NO: 494522 - DNA, 528 bp, Homo sapiens
  misc_feature (59)..(59): n is a, c, g, or t
  misc_feature (104)..(104): n is a, c, g, or t
  misc_feature (164)..(164): n is a, c, g, or t
  misc_feature (170)..(170): n is a, c, g, or t
  misc_feature (190)..(190): n is a, c, g, or t
  misc_feature (214)..(214): n is a, c, g, or t
  misc_feature (473)..(473): n is a, c, g, or t
  misc_feature (475)..(475): n is a, c, g, or t
  misc_feature (511)..(511): n is a, c, g, or t
  misc_feature (528)..(528): n is a, c, g, or t
ccgggctaccatgcgaagccccgtctctacaaaaagtacaaaaatagccaggcgtgctngctgctagtccccagctacttgggagctgaggtgggaggagaatntgattggcccatcttgagttatgagcctgacacttgactaaagggagggcaattatcccnagactnatagcatcactccaaatatnattgcatgggaagatgactctacnaataaaaagaaactgggtgctgggcgccagttgtcacgcctgtagtcccagcactttgggagcccagggcgggtggatcacctgaggtcgggagttcgagaccagcctgaccaacatggagagaccagcctgaccgtctgtactaaaagtgcaaaattagtggggcgtggtggtgcatgcctgtggtcccagctgcttgggaggctggggcaggggaatcacttgaacccagggggcggaggttgtggtgggccgagancngccattgcgctccatgcctgggaaataagagtgaantccgtctcaaaaaaagn

SEQ ID NO: 494523 - DNA, 362 bp, Homo sapiens
cgatctcatgaccttatgatctgaccgccttggactcccaaagagctgtgattacaggcgcctgtgggcgcatactatgcctgccttctgtagcatggactgtgctctgagctgcgcctttcaggagagctctgcggggcatcatagcctttctgagctcatggcatgagatgtacggtggtgagcgacctcgattgagcaagtggcttaacctatctgggctctacgagaagggtcagtagatcttcgcatgggcacttaagagaatgcccggcatattagaagggcttcatgtctgctttaaaggtagcccttgccaaggatcttgtaaggcgcacttgtttgagcaaggagtgaggcct

SEQ ID NO: 494524 - DNA, 313 bp, Homo sapiens
agatcataggtgacgacaggtgacatatgatagtgacatgtaccggaagcgggtgagtgatagctccatttgctcctatgatctaatgccaagctaagacaggcttacggttacagtggaaattgcgagctcacagaggagcggacatgcagcaaggctgacgcaggtaaagcagagaggggtggatgacccagggagtggctcagttcacgaaaagctgagcgggtgaacgtccacggtactcaaacgcggtgagggagctcgcggcccttgccgtccacgtagggcttcatgtgggacacgcagtagtcgg

SEQ ID NO: 494525 - DNA, 339 bp, Homo sapiens
cgtgagatagcagtccgtgaggcgtcggtgtggcagaagtaacgagccaggtcgtcagggctgactagtgtgcacgatgagttgctggccccggacggtgacgtcgttaatcccaggaaggtgtgcagaccctcggccagtccggagggatcggtgagggtcgccctgacaatggatccggacaccgaggcgcgaacctcattgatgggaccgtccgcgacgagctgtccaccactgacgaggacgacgcgacgggcggagggaatcggcctcctcgatgtagtgggtggcgaaaaatgaccgtacgcccggtgtcggcctcctcacccattgactgct

SEQ ID NO: 494526 - DNA, 161 bp, Homo sapiens
ggtcgctctgaggatcccgaacttctgctccaattcgcgtactagccggacttggatatgctggaaaggatttcagttgaggaacgggagaccaagattatgatagctttccgaccaccaccaacttcaatttccttagctgccgtaatatcgcgtcagtt

SEQ ID NO: 494527 - DNA, 362 bp, Homo sapiens
accggtatgttggcttaccggttagctgacgcgtcaaccggcgaggttaaggtcggagccttcaaattccgactcccagaaacgacgggtggagcagtggaaaatatccacgccagcgtcagacagtggcttgagaaactcacccaacgcctcaggggtttgcaccaggcgcgcggtgtagtcttgctgcttccactgggagaaacgcaagatgatcggaaagtccggttttcgacagcggcgcgggtggcctggatcagctcaatggcgaagcgcgaacggttggccaggctgccaccgtatacgtcggtgcgctggttgctgccttcccagaagaactggtccacgacgtgaggtaggag

SEQ ID NO: 494528 - DNA, 915 bp, Homo sapiens
atcctgccctggggtcggcccccctcccggtgggcgcttcacctctgtcaagtgtttgcgttgtccttgcccgccatcacatgtggttccttaaacgcccgcgggccgagtgtttccccctcccaaagggagttttttgcgcttccgcccgtgtgctcgcccgcctttgaatgggcccagtggttttgtcccaagattcctgttgaccccccagtgcgtttctagcagtgcgttctgaagacccacctgggcgagtttaccacacctctcctttagttctgcgaacatcttggtttggatcccagtcggaacagcgctcctctagaactgtgcggccaaatccccctccaatgttggttcactaaaattaggcgcccttccagcaaaatatgcgcctccacggctatattcctcccgcgcatatctccgccactatctgctacttctctttaaacctccccccttgtattgttcttattgtgtagtttattaaaacacccccctccccagtccttcacccgcgcgtcaacaacccaaacattaatcctccttaattccccccctccccgcagaatttggaagcaactttaaatcccccagagcaggtctcttgccgaacacactcttcgtgtgcgtacggagttctctttcttcccccgcgtttgagcacccgcggttctgagatggagtggggagcacccctgttgtaccataacacaagccctcttctgtggactagagaatatccttcagaacacccacaaactcttcttgcccactaattctcgcagcccactcctaagatgggttagcgaaaattctttgggggaaacactcctgctgaaagatgaacagacacacaggggagcaacaaaggggcaccaaacaaaaacccttttttccccaaacaaaaca

SEQ ID NO: 494529 - DNA, 301 bp, Homo sapiens
gtaggagtgaacatgtctattgcgtgaagcagatgatgtgattaagatgtgggaaagggattggtgaaattggaacaatccagaataacaatgataattgttgaagagtatgcaaagatgatttggcaaatagaacattgaaatgcccagaaactccaagaggaattagcctcaggaaaattagtggaacaggctaattctccaaaacaccagtggggagaagaggaaccaaattctcagacggaaaaagatcataactagtgaagatgaggatgacgataaactatgcagactgatattg

SEQ ID NO: 494530 - DNA, 998 bp, Homo sapiens
  misc_feature (108)..(108): n is a, c, g, or t
gaaactagtccatggcataaccgtatgtaccgccattcttcagacctgtcataccatgttcgcagtcagctcatgctcatggacgcaccccgtggatgctgccagaantctccagccactccgagtagtccccattccgtaacttggcaaagctcaaccactcactagttatgagtcgcgagactagtccgaacgtgtgtctgcatattaatgtccttatgtcgacagtgccggttacgcgtcctaatctcagaagcttggtcgatagagtttgaaatcagcacagatggattgctgtggatcaactcaggatcaccagataatttcaatcatccaggttgactgtgcctgacacctcgagtgtacatcaatccgaagtgccaggactagcatgagttcgttattgttccacttgagtaccgcagtgcaaagtaattgaccgtcggatccccaaggcctactatctcgtatcacagaaatccagcttacattctaaggaaccaactctcatacggtcccaaactagctgaagtcgcatgtttgcctgactaacgtctgtgagacattcatcgaatggtcatcagatgcgactattaattcccatgcaaattatctgtctttcgtccacctacaattttggccccagccacacttttcaattccacttcagacagtcttttttgggtagtagttcaggtgcccagcttaacgcgggctggggcacgatggtcccttgtcctcacgagttgctacagatgcctctttcactgttcagtcagcgtgcctgggtactccagtgtttggacacttggaaacatgcacctgttaatcaaggcacgtggttcaggaccacctcccgggagtctacgaggccagtggctgtaaagtttcacctcgggggggggagaaagcctctgttaaagttggaattgcccttccgtggggctgggactgttcgtgtgccttgtggacccgcgcaaggtttttggggttggcca

SEQ ID NO: 494531 - DNA, 251 bp, Homo sapiens
tgtgcctggcccttttctgctaaaaataaaaaattagccaggcatggtggaatgcgcctgtggtcccggctgccagggaggctgaggcaggagaatcgcttgaaccaggaggcagaggttgcagtgagccaagatcacgccactgcacttcagcctggatgacagagtgagactctgtcaaaagacaaagacaaagaacaacacagagagggcagagaaagaagacgaaagagcacggcagggagggaggc

SEQ ID NO: 494532 - DNA, 441 bp, Homo sapiens
  misc_feature (9)..(9): n is a, c, g, or t
  misc_feature (11)..(11): n is a, c, g, or t
  misc_feature (60)..(60): n is a, c, g, or t
  misc_feature (77)..(77): n is a, c, g, or t
  misc_feature (118)..(118): n is a, c, g, or t
  misc_feature (157)..(158): n is a, c, g, or t
  misc_feature (364)..(364): n is a, c, g, or t
  misc_feature (395)..(395): n is a, c, g, or t
  misc_feature (407)..(407): n is a, c, g, or t
  misc_feature (424)..(424): n is a, c, g, or t
ccggctgtncntagggggacctttatcctgctcaccgtgccaggataagcctgcgcttgncctaaccagcgcagcanaaccgtctcaatgccttttggccacatccgtcattgcagancaaagtttacacgacgtcccaaagtgacgttcatgctanngtgtttttccagaaatattggtttcatgtttcttattggctctgctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgattcgccactgttaaaggttcctnagagttggcctggtttgtctctgggagatgngaattaaaccanattaaagagctttccantggagggcttggtattg

SEQ ID NO: 494533 - DNA, 383 bp, Homo sapiens
agccacaattagctggggcacaggctaatgggagaaaacaggttggtaagaggtgattgaaagagaatgaatggaagggaacctaggctggacagtgacgagaaggctgcagcaagcctgtgtgacatgaaatccaaattagaagaagaaagaaaaacatggtgatgcttttcataggcaggactggcaatagaaggaacaagaggaagaggagcacggtatgggggaagaaaaaggaagtcaacaagtaacagccagcacacttcgtgacttcagatggtggaggtggaaacaagccatggcttgacaccagaaagtcaccccaatatgccaatttacataaagacaagcttgttcaattaaggggacaaaacataaaggca

SEQ ID NO: 494534 - DNA, 608 bp, Homo sapiens
  misc_feature (97)..(97): n is a, c, g, or t
atcaaccactgtgaacttccaagggaagttcttgatgcttatctcaactgcacctttcccatcgcatttcactgtacatagagcatatcatgcatanatagttctcacaaatgtgtcagttgacatgaatgcaatgatgtcagaattcggggcaacctcaagttcggttgttactctggtcaaaaggttctatccgaagctagatgctccagcacagatgtgtgtgtaattacctcgcttatgagttgccacaatcaatggtgtcagttcctctgtaagtaggcctttgtacacttcatgctgagccaccagaacatttgctatgcctgctactcaacagagatcttgtgccaccttgtcacatttggttccagctactaagcagaacgcttcacatacaaggcgtgtggttacagtaatggtattaaaagtaatgggtgctacggaatcgtttgcatgctcagctattgccagggtcctctgaaattgtagcaatgaggccgaccgccggaactgccacggaaccgccgctcggaacatggtctccgcttccgccgcatcctcggccttacagcagcgccgtgcacggccaactggcgacgcctcag

SEQ ID NO: 494535 - DNA, 128 bp, Homo sapiens
tctgaaaaagtgctcaacctcccccctcctggaagctgtgaattcctcaggaagtaaaccgagaagatgccagctcccagaagctcagcatcactgcccgctcttctccagtgttgggcttgctcctg

SEQ ID NO: 494536 - DNA, 326 bp, Homo sapiens
tctcagccatgttcatgcaccacatctgggggaggctgagacacgcggcccgctcgagcccgaagcaatagaggttacaaagtttacaaagctatgatattgctgctgcactccagcctgggtgacaaagtgagaccttatctctattaaaaaaaaaaaaagacatactgtccataataattatacatatggtgatgtttcagtacatgtatccccccaaatgtttctgagtgtggccctgaagtgtctctgtccccctgataatcaccacacagtgttatttttcatcacttctttatcgtgtaaagtgtagagatacggggacc

SEQ ID NO: 494537 - DNA, 993 bp, Homo sapiens
  misc_feature (75)..(75): n is a, c, g, or t
  misc_feature (91)..(91): n is a, c, g, or t
  misc_feature (100)..(100): n is a, c, g, or t
  misc_feature (103)..(103): n is a, c, g, or t
ttacgcacgagcatggaactgaaggtgtagaaccatgcgcctgaagaaaacggaacgcgagcaactgcggctganatatggtggccactgngcctatgtnggngttgtgcttgtgggtaacagatggcacgaggatcagcttgagccgatcatccgacaagtcgataagcccaccgagaggccagaaaaccatcgcctcgacaacatgatgcccgcctgcgccccgtgtaatcgaagtaaagggcggcaggagcttgaaggctggcgcaattggcttgcagggcacgtgaatagcctcaatgagtatcacggcatatatcgaatggcaaaagcctttgggttggtcgtggagacggcggctccggtcgtcttttactttgagaaatgccaggccgggcgagaatgaaagccctgactattcggcagccttgggcttggctcattgtgcacgctgggaagaacgtcgaaaaccgcagttggaggtctcactaccgcggccgctttctggtgcatgcggcaaaaggaatgacccgtcgcgaatacgaagaggccaaggcgtggtcttgtgcttgcggagcgattgagatccctgcgtttggtgaactggaccggggcggtgtgattggttcggttgaattggtagacgtcctcgatcacagcgactcaccctggttcatggggccaaaggcttttttgctacgcgatccgcaaccccttccatttgtgccgcttaaaggtcgactcggattcttcgaggcaccaaccgctcatgactgagatagacgaattgcaggaggagcgtcgcctctgctccatctgtgatgatccaatgattgaggggcaggccttccacggcattcgccaagcccattgggattgtgctcagcaggcgccggcggagactcctgcccagggtttcatttgttcatgcggcaacagaggccgagggtgctatgggggaagcccggcttacgcctcacccctaccccgatc

SEQ ID NO: 494538 - DNA, 262 bp, Homo sapiens
aaagagaacagattgattttaacaacatgtttcccgtaatgtcctaacttaatagcactggaaaatctttctgttaagaaaaggaaaactaactgaccttcaacaggctctttatagcaaaggcattttcgtgccccacagaacagtcttgtataagggagatttatcagggacttccaggaagcgagagttccgtaattttctaacactgaagcaaagctacgggaactaggtttaccatctcctagacacaacccctctt

SEQ ID NO: 494539 - DNA, 670 bp, Homo sapiens
gcacagagaacacgccgcgatcacagtgtgccacacgggagcatgtctaccaaatgtgggaatatgtggacccggctactccacccctctggaggccatgaaaggacaccaaggaagagaacggctacctggcctggatttaccggaacacaagcactgagggcccagattatctggccactgtggatggtgaccccaaggcttcccagaattgcgcaggtcattcaccggctggccatgcccaacctgaaggaccagctgtattacttaagagggaacaactgcagcagctggttcggtgatatgcaccaagtcgcgcacacaagctggtgctgtccagactcatcttctctctgcatctatgtggtggacatgggctctgagacccgggccccaaagctgcacaagggcatatgagcccaagggcattcatgccaagtgcgaactggcctttcttcacaccagacactggctgtgcagacgggaagtgatgatcagattcctgtgagacactaagggcaatggcaaagggggttttgtgctgctggatagggagacattcgaggtgaacgggacatgtgagcctgtgggtgctgtaccgctggctatgacatttgggaccagactctacactgtgatgagcagcactgtagagggcaggtctcacgtg

SEQ ID NO: 494540 - DNA, 480 bp, Homo sapiens
cctgcagagaaccctcatttctgttactgctgaataagattccattgttgaatatttattcacttactgaaggacatttggttgcttccaagtttggcagttatgaataaacctgctgtagacgtctggtttttgtgtggacctaagttttcaactcatttgggtacgtacaaaggagtgcagttgctagattgtatggtaagattatgtttagttttataagcgactgccaaactgtcttccaaagtggctgcaccagtttgcatttttaccagcaatgaatgagagtttctgttgttccacatccttactagcatttggtattgtcagtgttttggttttttaccattctaataagtgtgtagtggtatctcgttttaatttgcaatttcctagtgagcatcttgatgttgagcatcttttcatatgcttcttggccatcttctttggtgaggtacctgttcagatcctttcccccta

SEQ ID NO: 494541 - DNA, 158 bp, Homo sapiens
gcaaacaaacaaacaagacacacacaaacatgaatcaccagaggtaggtagggcaaggttttagctggaagcacatgtatgtctatgattacattacacaacattactcactatggcagctttctactctcatcatttgttagttatctggcaggggg

SEQ ID NO: 494542 - DNA, 357 bp, Homo sapiens
ctaacttatagagaagtagagagtagaatggtgataaccagaggctgggaggggaggggtgagtatagaaaaaagggatacattggtcaacaggtagaaacttatagttagataggaggagtagttctggtgttctattgcagagcatgttgactgtagttaataataatgtattatgtatttcgaaatagctaaagagagaactttaaatgttctcaccacaaagaaattataaatatttaaagtaatggatatactaattgctatactctggtgtgatcattccacaatgtgtacgtatattgaaacatcactttataccccataaatatgtaaaattattgttggtccaattac

SEQ ID NO: 494543 - DNA, 741 bp, Homo sapiens
gggggggggcgggtaaacagacttggccggcgaaggaaatcagcaggacgcctgcgcacaacatgtgggcaaccacctgtgccgctccgtgcctgcagagagttgaggaagaagatgaaacgtggaagtttgaagaccaggatagtaaagaagccaaaaaaccaaatttcataaatttgggacaccagtctgccgacatcacattacatacctaggtgctgatatggaagaatttcatggcaggactttgcccgatgacgacagctgtcaggtgatcccagttcttccacaagtgatgatgatcctgattcccggacagactttacctcttcagctttttcaccctcaagaagtcagtatggtgcggaatttaattcacgaaagatagaacctttggctgtccttgcttacagcacatgtccacggaaagggaagcacagtttgggaacaacagcagagattatatgcctatcgagaagaacaggattcgggaatggagatagtgaacagtgaacagccatgggacacacaaaggttcaaagtccttgagctaagaaccagtcagatggaatccagcaagctaaagtgcaaatccttcccgaatggtgtgtgtgccttcaaccagtgttgcagttcacttagaaatcccctcataaagtgccagcatttttcgcttcaaacctgtctcacagagaagaccaatgttcctactaacgtggcgcgcagaatcccagaagcaga

SEQ ID NO: 494544 - DNA, 342 bp, Homo sapiens
caacaagttgctctatccaattggattacaaccggtatcgaaaattcgggtcacttcaggataacttcaggaccccggtgcaaggctatgagaagatttcatgggaaaacttttctcaggtatcctgaagaagttttagcggtttttacgagttataatttagatgatactcaggcctcaagaaaaaagagggaagactggaaaccaggaggagaccatgtttatttggcaaaatttttaccaagtgaaaagcggagggatttacaactggagtgacagtagctttcgtcgacacatccggtggcagtatctcattttatcccaatatctcgaggggtgtca

SEQ ID NO: 494545 - DNA, 1306 bp, Homo sapiens
ggagccttagaaaccggccccgtgatcgcgagccggagccggagccggagccggggccggcgggctgctgaggcccgagcggcaggagcgcagctgcggagcggctgagccagggctgcccatgtctgctgatgaatgctgcctgcctgccttctgccctgccctggcgcctgcagccccggggctggtccagtggggctgggcactggcgtctgctgcatgtgcgcctggcagcccttggatggggcagccggcttagcgcgctgcgctctttgtccccgcagtgtcgcagccagggcgggcgggggcgccgcccagtccccggccccttggagcgcccgccgcgggtccccacctccattggacgcctttcaggggggggcattgaggccttggaggcggggctagccgggagggggctccgtgccggcctgcctggccgccacccgcattgacaattggggccctgcctttccaccttggccccggccctgccgaccccctgcagaggccggctcgaggaaacttccgaccagcgaggtcgtcgtgacacggagtcctgccagagaaggaagcgcggcgggggaaccccaaaggggccccgaggcaccaggtggtgcgggagtgcacggggcttgcggagggcgcagaacgacccaggccaaagaaagaaggaaggcaggcgtgcgtgatcgttacggcactatcacaaggccaggcaagttgcaaggaagcttaggaggccacgttccaagaaggacgcggttacccccgaatattgagcattagggggaggaaaatcgccgtgtggaccaaccctcagcggagctgtgcgtgcgggtctgggtcaaaagaccgggggaggccaaggtggcgataagcgcgaagcgataaccagcaagttcgacccgctccaaggtgttgcgtaagtgcaggagatcagccggcgcatatttccacgccttataaaggacgttttcccaccgggataacactatacaagcagtgtggggcgcgcgcagtaggcacgtgggccgggggccggcttcaaccaagaagctaccttttaactcctaaaggccggaggtgtccagcacaggttttagagcaagcgactactctagaaagacgtggcgagcgaggggcagcggaggggtcgccagagggcgaaagcaaaaacgggtggagcacaggaaggaggcggaggtgcgacgccactaagagagagagtactaaagtaggctagcagactcgtctacattctgctcgccacctgtctccttcctccttgctcgtcttattatat

SEQ ID NO: 494546 - DNA, 511 bp, Homo sapiens
ctctctactcaccggctccgaatggctcaaacctcaaggccaagctgtaccctataccgggcatctctccccagggttgggtatgtggaaagtgtgggattcaggttggttaaataaaacaaggggtggtttttttaactagtgacagcaaactgggtagtaaacggtctgttctgtggctacagagtaaccatagagtatacatgagccaaagagtatacatgaatctcagctagtaacttaggtttcaggatcagattctctaaaaacagggcggtccagcagaacattctacagggaaggaatcgttctattcggcatggtccaatatggtagccactaggcaaatgtgacggtggagcacatgaaatatgtctagtgcaacttagggacggaattttaagttttaaaaatggtaattaatttaaatctagatttacatagctgcgtgtagctggtgactgtggtatatggcagtgtagcactgaagaaatatcttcactacattccc

SEQ ID NO: 494547 - DNA, 392 bp, Homo sapiens
cgtcgacgtttcacctttctcttcatagagcagtttggaaagactctgtctgaaaagtctgtaagtgattagtaagaccactttgaggccttcgttggaagcgggatttctcatttactgctagacagaagaattctcagtaaatcctttgtgttgtgtgtattcaactcacagagtggaaacttcctttattcagagaagttttgaaaaacactttttgtggaatttgcaagtggagatttcaagcgatttgacgccaatcttagacatggaaatatcttcatactaaaagtacacagagtcattcgtagaaagtagtttgtgatgtgtgccttcaactcacagagtttaacctttcttttcatagagcagtttggaaacactgtcgacgc

SEQ ID NO: 494548 - DNA, 234 bp, Homo sapiens
tagcgttggtgtctgcatccaaatacgacccttcgacaggcagaacaggctgtttgacaaatcaacttgttggcacccggtagtccttagcgacatattgggcgatgtgatgtttactggagacatgcacatcgccggcgtcgtacaacttcgaaaatggtctaaaccggtttcgccactgtttcccggtcaaactcgatcatacgtctccccatgtatcgagtcatagcaagt

SEQ ID NO: 494549 - DNA, 109 bp, Homo sapiens
ctcgttgcgcagcctgccgctgctgttcaagcgcccggcactggtggcgctgtacgtgccgacggcgatggtggtgacggcgcagttcacggcctacagctatgttgag

SEQ ID NO: 494550 - DNA, 308 bp, Homo sapiens
gatcgtgcctaagctgagaatctccttttgaccctgggtcacgttacaagaacatcggtttatcggcgcttggggccactgttaagtcaaatcccttcttcacacgatccgctgcagtgacaccattctggagggagccctcgtagaagatgtaggatgggaaggcgctgagtgcagggtgcatcctggtactggacctgcaggctgatgggccggatgcccaagcaccagcaggcgctcggacagcgattgtgacagccctgtgcctttgggcggccttcttgccacatcagcaccaggaaattctt

SEQ ID NO: 494551 - DNA, 552 bp, Homo sapiens
ctttttcacctccacacttgtggtggatttgaccatccgggggccaatatgaggttgggcaaaggccctcttgtcttctttcaagttcctcaagcccgcccacaagaaccagggaaagatggggcagttcagtggctttaaccttgggggccgactcctcccccccccccgcaatttcgccaaaaccaagaaatagcccccgcccccccccctgggcccccaatgatgggttgtttggccaaaaatcttgctccccttttgggggggggtcccccccccccctcgggcccccctgttccggggaacatggagccctggggttttttttttttttttttttaataaacccaaagcagggtcccgtcccccaggggtgtttcccccctgcccctgcgggttcttttaacaggatttttgggccggggcttccactcagggcaacggcaggcccggttgtgggttcccccccggtcttggccccaggggtggcagccggtttctggggccccccctttggtttttttaattaaggtccaagttgggttttcccca

SEQ ID NO: 494552 - DNA, 1065 bp, Homo sapiens
  misc_feature (1)..(1): n is a, c, g, or t
  misc_feature (3)..(3): n is a, c, g, or t
ncntaatacaccctcagactacttttgttatttgttcttttcttctcttctgatctttgctctctttgtttctctgtctgtattctctcattcttgttttctctcattctatgtggtctataactattgtatattgttctttttttcttctcttcttgttgtctttacctttttctatatttctttctgcttccatttgcttcatatcttgtccccgtttccgaaattcttttatcacccccttgaactgctccctgccacatccattcagtacggtctaaccacaaacccgctcctggtccaccttcagccgtaccagatctgccgatggccaagctatcagatatgagggatggctgacacatgcgggaagaagaacgtatgttggcgctctcgtgctcccaggtgctagcactcatcacagctgttgaatccatcttgggacctcgatgagagctgaatacttggatgtgaccagcaggcgtgtcgaagcaagggaagaaggccggtttaggacagcctggccctgggtgtacacgaagggcttcttctttcctgctgtctgctcgggagccaaccagcaaaccccgggtccctccccgacgcggtaggtgagcagcacctggaggcgctcggcggcgcggcagggctgcgggaaggacacgcacagggcctggccatagtgcgagaagggctgcgtgtagaagctcacgggctccgcaggcggctcctccgagccgggccgctcccgccgcagcgccgccgccgtcacctccaggcacgggtgcgagtccagccgcagctcggcggcgccctcgggctccaggcagcgcaggtccaggaccgcggtgccgctcagcccccggctccctgcgccgggccctggaggcccgaactcagcccgcaggtccaggtgcaagtgcagcagctcaaaggcccggaagttggaggccgaggccacgtccacagcctgcgcggagtgcagcggccgccgggccgcgccgctgccgggggaatgctcgccgctcgccatggccgcagagccgttgctcaccggccggccgc

SEQ ID NO: 494553 - DNA, 978 bp, Homo sapiens
  misc_feature (1)..(1): n is a, c, g, or t
  misc_feature (3)..(3): n is a, c, g, or t
ncntaatacaccctcagactacttttgttatttgttcttttcttctcttctgatctttgctctctttgtttctctgtctgtattctctcattcttgttttctctcattctatgtggtctataactattgtatattgttctttttttcttctcttcttgttgtctttacctttttctatatttctttctgcttccatttgcttcatatcttgtccccgtttccgaaattcttttatcacccccttgaactgctccctgccacatccattcagtacggtctaaccacaaacccgctcctggtccaccttcagccgtaccagatctgccgatggccaagctatcagatatgagggatggctgacacatgcgggaagaagaacgtatgttggcgctctcgtgctcccaggtgctagcactcatcacagctgttgaatccatcttgggacctcgatgagagctgaatacttggatgtgaccagcaggcgtgtcgaagcaagggaagaaggccggtttaggacagcctggccctgggtgtacacgaagggcttcttctttcctgctgtctgctcgggagccaaccagcaaaccccgggtccctccccgacgcggtaggtgagcagcacctggaggcgctcggcggcgcggcagggctgcgggaaggacacgcacagggcctggccatagtgcgagaagggctgcgtgtagaagctcacgggctccgcaggcggctcctccgagccgggccgctcccgccgcagcgccgccgccgtcacctccaggcacgggtgcgagtccagccgcagctcggcggcgccctcgggctccaggtgcaagtgcagcagctcaaaggcccggaagttggaggccgaggccacgtccacagcctgcgcggagtgcagcggccgccgggccgcgccgctgccgggggaatgctcgccgctcgccatggccgcagagccgttgctcaccggccggccgc

SEQ ID NO: 494554 - DNA, 315 bp, Homo sapiens
aatgcatatgatgtttgagggctgttttgaaattatttttcttttcgggtcttccaaaattcaagaaaagttgattgccttgaagattcccaaatttaaggttttttggcatgggtgttttctattaaaaattggttatatgatgtcaaagtaatcctttcataatagaattgacatgctctgggatagtttgccaaaggtaaattataaagtgaaatctcttgtttcattatcttcccttctaaccccaaagatttgtttttctagaaaaaatgtccctctctggctttaataaaattatgcctccgaaatcca

SEQ ID NO: 494555 - DNA, 105 bp, Homo sapiens
aggagaattgcttgaacccaaaaggcggaggttcaaggtgaaataagatcgcccccctgcacttcagtatgggcaatgaaagcgaaactccctttcctaaaagca

SEQ ID NO: 494556 - DNA, 424 bp, Homo sapiens
ctggcctatggtgaaacccacctctactaaaaatagcaaaataagccacggtgtggtggcaggtacctgtagtcccagctacttgggaggctgaagcaggagaattgcttgaacccaggaggcggaggttgcagtgagccgagatcataccactgcactccagcctgggcaacagagtgaaactctgtctcaaaaacaaaaaaaaaagaattcacccatattattcattatgctatagattttaaaaacttcttcactccctttatcttctattatcgccctttagggagacatggaaaaccttttatctgtttacttcagggaaactatatgagatactgaataattgtaatgtattcagtgttaattataaatacgcagcgtatgttttgatatgtatggtatttatgtgctttaggtaatt

SEQ ID NO: 494557 - DNA, 316 bp, Homo sapiens
tggctctcgcaccgaacagttagctaaattgtaatgcaaggaaataagtgctaccccactaaacacacaaatagtaagaaggcaaaacagcctttgctgagacagagaaagtttgagtggtctggatagaagatcaaaccagccacaaccttgccttaagccaaagcccaacccagaacaaggctccatctctctccagttctataaaggctgagagagatgaggaagctgcagaagaaaagttgcaaactagcaaactagttgattcatgaagtttaaggaaagctaatcctgtaaaataaaagggttaggggct

SEQ ID NO: 494558 - DNA, 260 bp, Homo sapiens
taactcctcctctttctcctcctcctcctcttcctcaaactcgggttccagcattgtctcaaactacaggctccaagctgggtctcaaactcaggctccaacttagtccgaaactacgggctccacctcggtccctaactactagtcaccacctctgtgtaggtctcagtactaccgactcctcccagccagcggataggtataggcggtataagatcaccaccaggattctaccggggatcctactaaaagtcgacctg

SEQ ID NO: 494559 - DNA, 1330 bp, Homo sapiens
  misc_feature (1)..(1): n is a, c, g, or t
ncgcctgtggagcaagtaccgtcttgtgggtcgactctttggtgtgtgtctcgtgatcggtgctcttgtttctgttttgtcatgtgtttctttggtgtgtttctctgtttttgatgttgataggctgttggtatgggccggtcttgcctttggtgctggtatttgtcggctattgtttctccctgtgttgtgttttttcttgtgatcttgtagtatgttgtttcttagtgtagcgttgtggagcctgggtaatgcgactttgatttgtacgagttgtttgtgcttttggctgtggggctcctttggtgctgttgagcgcttatgtgtggtgggccctcgtgtgacttaatggccctgggatctacccctgtacgctttttttgaatggtaattctgccggattgaggaacttgggaggcatggtcttggttgtgctaggactctcgcgctggataaagtgcgccttacttttcgtggaccacccttgcaggctctgagattaaggtgattatgccggaggcaccactgtagtctgtgatactcagagtcccactcccgtgctagctcaaagtgcaccagcctcatgggccccagtggcttgaagaagtctaatgaaggtgtccagtgtctagtattctctcctgtcctattgtattggggtcgctctattgtatgtggggatcttgcattcccctgcttgcccatatcatttgacgaatgccgctaatatagggcatcctgcgccctcgcctgttgtgaggctcaggcactggaaggtcagttgccatggttaccgaggaccctggtgtactctggtgctgtcctgttctactggacctcgcgcgatcccaagccgccaggggtgctctgctgggggctccatttggtgtacgtcgtgggcccccactttcaagccagctttctgacggccttccgatcctgggccgtgaaccacagcaggaggagctccagctaagacctccccactccccgctgagggagtggaggtcgggtgtcacgtccaggaatactgaaggaatagcccgaggaaccgggctggggtttatttaaactgttctgtgtgggtctggggagaggagagcaccttaactattattggggttggcttggggctggggcaggatctcagccataaagtgccagtttgcttagttctcactgtctcctggtatgtgctgccctgctctggggatgcacaggcaggcagggtgggggagggaggttcctcgcaggtctcagcccggtacagggtcattgcaagcagcctcctgggcagtcgtaaataatccggggatgtctcaattagttt

SEQ ID NO: 494560 - DNA, 766 bp, Homo sapiens
tcaaaagtgatggtttaggacgcactatattgaatgactccctgtgtatttttacacccacagttgttatattctccctgttaaaatagttggaaaggggaaatttctgatttaacccaaatggttatcatcctaggtaacttatttcagcacacagtctgatatttccaaattctttctttttcgaccttatactctgagttattacttactgtaagtggtgtatatgaaagcccccacgcacttttcccctatggatctcctaatatgccccgctaatccaacagtctttgtttgtttttctattaaaaacgccactccagaaagatataatgtgaaaaagaaaggaattttacgagcgtagggaaaagatgaaatgtcacgacactttgaagaactattatgttaaagtgatataagcaccttaatatacttgagaaactcttcttaatatgcccatgaggtaggcctgatctttgaaatagtgaataggaataccatgcaatttcctcagtgagtcactgagtagaatgagttggtgggatccttgggaagccacaacggagcggagttctggatcactgtcccctcccgtcccgtgaatccccgagcccgcacgacctgcccccccgccacagcttataccctggaatgaggacacaggtgatactttgagctgtggactgaactggccgacaccacctgtaccagattgaatttcaccttgtaaggaggaagtgaatgaaataaaggatccccctaagga

SEQ ID NO: 494561 - DNA, 856 bp, Homo sapiens
aacattcggttgcgtcgctgttacccagatttgtaagtgaagatgctcatagttgtgtgcctagtaccatcatggtggtgtctcgggtgtgttggcattcttttcgagttccttatactcacggcgcctaccggtacgctgctgacagaaactcgcagatggcatgttctgcaggatgcatatactgggagttcgtagtcaggacacggtcacgctcagaaggagagactccggacttttagaaatgtaccgtgctggagtggtcgggtgctttctgggttggggctgatgggggcgggcgggtacgtttgtacctgggtggcacggaagcccatgagatgggataccccccgagtccatggaccattacgcagatggtcatcggcctcagcattgccaccgtggggttatcgttgtcatggcagaccccaaaggaaggcctaccgcggttgtttgaaagtaaccaccagtgaatctgtcttctgtctctgtccctttccccgtgacacacagagcaggcatggaatttaatgggtgtctggacaagacacttgttcatggacagacatcactactggggatactaccaagactgaaacacgaaacaatcgtatgtggtcattctctggctatgggaggtgtttggtggccttcaccagattttcacagggaaccaattaaattccctcaggagaacgttaacaaaaaaatactttaataacgatacatacatagtaaacaattttttggggggcagcgccacgcgaaggtttttagacactttttggcgcggggcccggaataagtaagtggtcaccgtgtcacagaagcccgctacaatgcgggttccccctaa

SEQ ID NO: 494562 - DNA, 602 bp, Homo sapiens
  misc_feature (1)..(1): n is a, c, g, or t
ngtggtcctctactcctctctgcctgctgcgcggcgctgcgctctgcgcgcgccactactagtatttactcactctcgcgcgcagcactactatcattctccccgcgctgtctctctcgcgccgcgcgcgcgctgtgtgctctctctctccgcgcgcgcactatagtatgtgtcgcgctccacacgacacgaatcacgcgcgcgcgcgcgcgcgagatcgtgcagcagggagctgcgcgacccgcggcggcgtcgtcgcgtctcagcagaagaggtttgtcgtctctgtgtgtgcctcctcgccgcccgtccgcgcgcccactctcctgtgtgtgtgggcacaccacgcgtcgtgtgtgtctctctctgtttgtctgtgtgttgtgttgtgtctcgagacgaggtgcgcgcgcgcggtccgcggcgcggtggtgtgattattatctagtgaggtttcgccgcgcggtgtcgtttgctgcgtgacctccaccacggtgagtggatgacacgtgagaagcgagtacatagttgtccccccggagtgtagtacagtaacaaaacaaaaatagaaaagagagaaagaaaacccccgaacaagaaca

SEQ ID NO: 494563 - DNA, 698 bp, Homo sapiens
  misc_feature (2)..(2): n is a, c, g, or t
  misc_feature (112)..(112): n is a, c, g, or t
  misc_feature (233)..(233): n is a, c, g, or t
  misc_feature (244)..(244): n is a, c, g, or t
  misc_feature (257)..(257): n is a, c, g, or t
  misc_feature (261)..(261): n is a, c, g, or t
  misc_feature (270)..(270): n is a, c, g, or t
  misc_feature (286)..(286): n is a, c, g, or t
  misc_feature (288)..(288): n is a, c, g, or t
  misc_feature (290)..(290): n is a, c, g, or t
  misc_feature (297)..(297): n is a, c, g, or t
  misc_feature (303)..(303): n is a, c, g, or t
  misc_feature (310)..(310): n is a, c, g, or t
  misc_feature (322)..(322): n is a, c, g, or t
  misc_feature (324)..(324): n is a, c, g, or t
  misc_feature (328)..(328): n is a, c, g, or t
  misc_feature (330)..(330): n is a, c, g, or t
  misc_feature (336)..(336): n is a, c, g, or t
  misc_feature (350)..(350): n is a, c, g, or t
  misc_feature (354)..(355): n is a, c, g, or t
  misc_feature (360)..(360): n is a, c, g, or t
  misc_feature (363)..(363): n is a, c, g, or t
  misc_feature (367)..(368): n is a, c, g, or t
  misc_feature (375)..(375): n is a, c, g, or t
  misc_feature (378)..(380): n is a, c, g, or t
  misc_feature (427)..(428): n is a, c, g, or t
  misc_feature (697)..(697): n is a, c, g, or t
cnatgatcgtctatcaatggagagattttcgtatttctatattctaatagttcacgatccttgcttgatgtcagtaattcattatcgactataccaatagttgcatcttccnccagaatatttgcttgatatgctccaatcggaatttcaggcaatccaatgtagtcatgatctgccactactgaaccttgcaagagataaagactttcttgttcactggattctcttatgtngggcttaaggngggacattttganaggncttttcagnctacccccagtgttgncncncaggccngccccnccccttnctgtaatatagncnatgncncaaggnccaccccattcagnctgnnaacgnccncccnncccccanttnnncctttgtcttaaaacttcatgccccccttttaaatgaaatgtttttnnttgtttgggtttctttttaacaatgatcttgcttttatttagttcatccaaattgttgttctccatctggcccagtgaagttgtcttattctccattattttatcagcttctttaattgcatctagaattttggcaaacatacttgtattatcaccatccacttcatgaagactatctgaagtctcaggcatataaggatttcgactaaacatttgaaaatatggtgtatttttagtaggttccaagtgagttacattgaaggcaattna

SEQ ID NO: 494564 - DNA, 853 bp, Homo sapiens
  misc_feature (390)..(390): n is a, c, g, or t
  misc_feature (494)..(494): n is a, c, g, or t
  misc_feature (496)..(496): n is a, c, g, or t
ggcggtcctccccgcccggcgggcccagcagccctaggagcccagcgccgccgcatgtcctccggggctagcgcgagcgccctgagcgcttggtagagcagctcaagttggaggctggcgtggagaggatcaaggtctctcaggcagctgcagagcttcaacagtactgtatgcagaatgcctgcaagggatgccctgttggtgggtgttcccagctggaagtaaccccttcggggagcctagaatcctgtgctttactctgaagactcgaagagaagtttggctgaggaatgccttcaagcacaaagtggatgaatgactgccttcaagtctcaagaaaacacttttccctaacttttagagatatttcagccctttccttgtggccgnggtcctatagccaaaatcacagatattccatgagtttcctacttggagtgagaaaactgggtgaaggaatagaattttaaatagtaataactgctgtgtttttngngtgcaagtacttttatacataagataaaaaaaacttacacaaaatacaaaaatgactcttttcataagtgagtactaagatttctatacctggaatatcatgtatgttccatttacgtggatgttacactttaggacggacaatagtttgttattaaccacaatgaatacttataagtgtggtcgtggaagttattatccataaaaattgtctttgtcatgattataatctaaatgagaccagaagtcaattgggcgggcacaacgcgtattaccccgcggcgggctcaaggggagcggttttaccattgggcagtttcgaccttgcaaatgtatgttcgcgccgtaaaaaactttg

SEQ ID NO: 494565 - DNA, 96 bp, Homo sapiens
gctgaactcatgagaagtatgggattgccacttcaatttggtaggataactgcacataaggattttgaggtatctatgaatactagaaataaagtt

SEQ ID NO: 494566 - DNA, 426 bp, Homo sapiens
ctagaaaaggaacattgaataaaaagacaagagaacagagacataaccctaaaaacctaaaaagtcaggaagaagtagccaacaagattagaaaggtagtaagaaaactagaaggaaagttttaagatgggaagtaagtggtcaagtctgttcaacgctgacccacggtcacctagcatataggagatatgggcattgggtttaggagcatggttccagtcacggctcccctcaccagagtaacttggactttcatgatcgctcgcagatagactcctcggtgtggtttctttcgcataggcttcactttaggtcagtggggcagtttggttccggtggatttttatatagtcattgtctctttcatgtggtcttaggtcaagctgcggatttagcggcactggctttataaattattatattcat

SEQ ID NO: 494567 - DNA, 380 bp, Homo sapiens
tcctatagtgcatggctggcggagtgcatggctgcggagtgcatggctggcggagtgaatggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggtaggagaatcgattgaacctgacagatggaggttacagtgagccaagattgtgccactgcacttcagcctgtgtaacagagtgagactgtctcaaaaaataatgataataggaagtttcctcaggcttccccagccattgcactccgg

SEQ ID NO: 494568 - DNA, 105 bp, Homo sapiens
ggtacgagtaacgctgagtctgttctttaatggacaccgtccacttgtctgcatcctgactgaggcgggaacaggaggggtttgggaaatggtgccactgggcct

SEQ ID NO: 494569 - DNA, 734 bp, Homo sapiens
gactcccgctgtatattaaggcgccggcgatcgcggcatgatgactgctcccggacaagggcggtgatgcgttctgctttggacttctcgagttgagtgcgtcgcactccttctgcgcagcgcgactctgcatgtcctcgagtcgcagatctttccacgaggagccagcatacttcctgacacatggaaattgttgttcgtcgttgccaattcttgatcccgatttgccccagagctctttcctgcatgaataagctaggctaaagtctctgttgttctatgcccaaaactgccccaagatgatggaagttggggccaagccagcccctcgggcatttgtccactgcagcagtacactaccaacagatcaaagaaacccctccggccagtgaagaaagacaaaactgctaaggccaaggtccaacagactcctgatggatcccagcagagtccagatggcacacagcttccgtctgggcaccccttgctgccacaagccaggcactgcaagcaaatgccctttcctggcagcacagatgactcagaacgaggggagcagtgtcttctgcaaagccagtcttgagcttcaggaggatgtgcaggaaatgaatgccgtgaggaaagaggttgctgaaacctcagcaggcccaggtgtggttagtgtgaaaaaccgatggaggggattccagtggactgtgaagaacttccaggaccattttgcaaaagcaagacca

SEQ ID NO: 494570 - DNA, 186 bp, Homo sapiens
ggtcccagggtgactaacatgagaaccccttctctgcagcatctgataaaattacctgcgtagctttagagatcactgctgcctgaccagcagccgctctgctggaatctgtccagaaagccccttggggctcagaaaagtaggtgggttaataatagaagtaggctatgggttaggtctacctgg

SEQ ID NO: 494571 - DNA, 104 bp, Homo sapiens
agggggggggggtttttttggcccccccggccctttgggcccaaaccccctttcccttttttttttcccaggggtgggtttttccaaaaaaaaaaaaggttgga

SEQ ID NO: 494572 - DNA, 253 bp, Homo sapiens
  misc_feature (99)..(99): n is a, c, g, or t
ccccccccccccccccccggggggggaaaggggggggttttttcccccccccccctggggcgggggttttttagccttttttcccgggggggggggccntttttttccttttccccgggatcccccccccgggggggggcaggttttttccccccaatttttttttgggcccccccggttccctttggtccccccggggtttttttcgtttttggggcccggggttccctttaaaaaaagggggggtttttga

SEQ ID NO: 494573 - DNA, 172 bp, Homo sapiens
gggggggggggcccttttttaggggtaaccccccccctttaagggtggggggggggggtgggttaaaaatttggggggtggggtttattttttccccgggtgggggttccccctttaggggttggggttagggggaccctttttttaaatttttccttttttaaacggggga

SEQ ID NO: 494574 - DNA, 236 bp, Homo sapiens
ggaaaagaccttgaaacaatggaagaaattccaaattgactgttagagtgctcctaggaaaggaaacaataggatagatagatggattagatagatagatgattagatagatagatagatagatagatagatagatagatagataggaggggatttattgtggcaattggctcacatgattatggatgccaagtccacagtgtgtcatctgcaagctggagaaccaggaactggtg

SEQ ID NO: 494575 - DNA, 178 bp, Homo sapiens
acttttggaacatggctcacataatacctggcaaacttaaaatctggataccggcaggcacggtgtctcacacctgtaatgccaacactttgggaggcgaggcgggtggatcacttgaagtcaggagttcgagaccagcttgcgcaacatggtgaaattccatctttactaaaaatac

SEQ ID NO: 494576 - DNA, 132 bp, Homo sapiens
tcgagccggtaccaacctgaagttgccaaatgtaaagcttcttcaaaagaataactcatatatttttgacactcaccatgttgctagcctgaatgcgtggaatgacaaaaacacacaaatcaatgtgtgtgt

SEQ ID NO: 494577 - DNA, 200 bp, Homo sapiens
cccactccaccttataccagacaaccttagccaaccatttacccaaataagttaggcgatagaattgaactggcgcatagatatagtaccgcaaggaaagtgaaaattataaccagctaatatagcaggactaccctatacctctgcatatgattactaggatactttgcagggaccaagctaagcccccgacccagacg

SEQ ID NO: 494578 - DNA, 802 bp, Homo sapiens
ggcaggcagatcactggaagtcagtagtctgagaccaaccagaccaacatggtgaaacctcatctctactaaaaatacaaaaaattagccgggcgtggtgtggggcacctgtaatcccagctactcaggaggctgaggcaggagaatcgtttgaacctgggaagcagaggttgcagtgagctaacatcatgccactgcaatccagcctggacaacagagtgagaccccatctcaaaaaaaaaaaaggaaacaaccaaacaaggtggtttcaattcagggtactcttaaccatccatctcttccggtataaaacctcggtaggtcccacggtttcatcccttctccatctggggcccgttggagaacattgggtgtgggtgcgcatacccgttgatgtcgtgaggaaccagtaattctgggttaaagggttcccctgttggggtacttatatagccttgtttgaaattcctttttccgggtatgacccgtgaatattcggctgagcgatcatgaggaaatccgattgcatcgccgtggggcttgacctcttctacaagggggcgtgccgctttataggctatgggacctatatgtgcgggaatgagaactccgcgggtagcccaggatttgttgtcgttgggggagcgggtccgtccctccagcttaccggagccagactcttagagcgacactcacgccgactgggtacgcgcgtaccttatgctggtccccaatctttcagatcaaacgttggcgtgcagcttcgagaattcgctatagctcccttttcgacgacaccgca

SEQ ID NO: 494579 - DNA, 898 bp, Homo sapiens
  misc_feature (2)..(2): n is a, c, g, or t
  misc_feature (67)..(67): n is a, c, g, or t
  misc_feature (74)..(74): n is a, c, g, or t
  misc_feature (91)..(91): n is a, c, g, or t
  misc_feature (94)..(94): n is a, c, g, or t
  misc_feature (96)..(96): n is a, c, g, or t
  misc_feature (105)..(107): n is a, c, g, or t
  misc_feature (110)..(111): n is a, c, g, or t
  misc_feature (115)..(116): n is a, c, g, or t
  misc_feature (129)..(129): n is a, c, g, or t
  misc_feature (133)..(133): n is a, c, g, or t
  misc_feature (139)..(139): n is a, c, g, or t
  misc_feature (150)..(150): n is a, c, g, or t
  misc_feature (152)..(152): n is a, c, g, or t
  misc_feature (154)..(154): n is a, c, g, or t
  misc_feature (156)..(156): n is a, c, g, or t
  misc_feature (159)..(160): n is a, c, g, or t
  misc_feature (175)..(175): n is a, c, g, or t
  misc_feature (180)..(180): n is a, c, g, or t
  misc_feature (184)..(185): n is a, c, g, or t
  misc_feature (201)..(201): n is a, c, g, or t
  misc_feature (203)..(203): n is a, c, g, or t
  misc_feature (207)..(208): n is a, c, g, or t
  misc_feature (214)..(214): n is a, c, g, or t
  misc_feature (229)..(229): n is a, c, g, or t
  misc_feature (306)..(306): n is a, c, g, or t
  misc_feature (312)..(312): n is a, c, g, or t
  misc_feature (319)..(319): n is a, c, g, or t
  misc_feature (329)..(329): n is a, c, g, or t
  misc_feature (336)..(337): n is a, c, g, or t
  misc_feature (339)..(339): n is a, c, g, or t
  misc_feature (341)..(341): n is a, c, g, or t
  misc_feature (343)..(343): n is a, c, g, or t
  misc_feature (404)..(404): n is a, c, g, or t
  misc_feature (408)..(408): n is a, c, g, or t
  misc_feature (419)..(420): n is a, c, g, or t
  misc_feature (427)..(430): n is a, c, g, or t
  misc_feature (439)..(439): n is a, c, g, or t
  misc_feature (441)..(441): n is a, c, g, or t
  misc_feature (465)..(465): n is a, c, g, or t
  misc_feature (486)..(486): n is a, c, g, or t
  misc_feature (504)..(505): n is a, c, g, or t
  misc_feature (507)..(509): n is a, c, g, or t
  misc_feature (567)..(567): n is a, c, g, or t
  misc_feature (660)..(660): n is a, c, g, or t
  misc_feature (678)..(678): n is a, c, g, or t
  misc_feature (724)..(724): n is a, c, g, or t
  misc_feature (728)..(728): n is a, c, g, or t
  misc_feature (733)..(733): n is a, c, g, or t
  misc_feature (753)..(753): n is a, c, g, or t
  misc_feature (760)..(760): n is a, c, g, or t
  misc_feature (777)..(777): n is a, c, g, or t
  misc_feature (799)..(799): n is a, c, g, or t
  misc_feature (820)..(820): n is a, c, g, or t
  misc_feature (829)..(829): n is a, c, g, or t
  misc_feature (894)..(894): n is a, c, g, or t
tnatttcccgcttttattttgcttttgaaatctttttccttggtggatttgtacgtgtatacactanaagcctnaaataaagtataaacanaananaaaaacaannnaannaaannagaaaaaaaaaanaaanagcacnagggcagaaananancnaanncccctaaaaccaaangaacncaannaaaagggaaggggaancncaanncaaccnaaaagcaaccaaacnaaaaaaaaagggaaacaaggaaaaaaagaaaagaggggaatctgtccaagaggggagagaaaagaaaaaaaaggtanaggganaagtgtntagggtctanggccagnnangngnatggcagaatcatttgtgtgatgaagcaggctcctcctgccaaaaggagagccaaggggcncctncaacccctttnnttttttnnnnaggccagtnanttcaagcaggggttggtagaaggnaagtgctttaaaaatgttganttctcacacgcagaagcnntnnnctccagttttgtgttgggagggcaatgtgtacccagggcagggtacagtagatgaccnctacctgcacacatatagatggaggtgaactggagcagagggtcagggttagggtcacccaaagtccctgttcctttacccagcctctgttcncatggagatgcctttctnccaggccttcaaggacagtgtgtccactacactgcgtggtgaagtncttnttggnatctaactattatgagatangagagcnctctgcaagtaggtgangaacgagtgagctttaaagacnattactgagagtgtcactgcnactgctgcnatggaggtgagagctaaatccggggaatgccggacggtcacagcttgctttttgtacaacttgtntata

SEQ ID NO: 494580 - DNA, 181 bp, Homo sapiens
agtaacgatgcagtcctcacaagcggtcctcgctatgactaagctcctcctttagcatcgcggaagggcttcaagatgagctgtcttggttcccgttgaggcccagtaccctgagttccatgatctccttcggtgaagagcacaggagggaaaaggggaatggacttctacaggatggagt

SEQ ID NO: 494581 - DNA, 138 bp, Homo sapiens
cattaatgagattgattcgtgctctgcaaaaatgttgtcttaacgctaagttaataacagcaacagctgctctgtaatagtggaatcttcatcgaatgagatttcgaccttctgctcctctcaaaatcacattaagca

SEQ ID NO: 494582 - DNA, 231 bp, Homo sapiens
ggtcatcacttaccctgcccttctttttcctcagaacaccgtgaactttggtggtattatttggtatctccccactgcatgtaaactcccgtggtgaccttgcatgtcttatgcaatcctcattaaaacctttttttttttttttttttttttttgtttttttttttttttttttttttttttttttttttttttttttttttttttttttttttttttttgtgtgggggg

SEQ ID NO: 494583 - DNA, 145 bp, Homo sapiens
atagcgtcgagctcggaccccactacctctctagcaactgaatttagcaaatacaatcgtaatcccagcatgttagggaggccagggtgggcagatcatctgaggtcgggagttcaagaccagcctggccaacatggggaaaccc

SEQ ID NO: 494584 - DNA, 208 bp, Homo sapiens
aggcgccctacaggattatagcttcccttctctaaactactctatatttatattctacctctgctcaacttactattggctaacacatacataaaaatattaagtaactagatgtaaaaatggataaacctctttagttcttgacttcaagtatgggagaacttttattgtgtccccattaagtatgatgctggcttttatacctgag

SEQ ID NO: 494585 - DNA, 136 bp, Homo sapiens
ttcgattggcgggcacttacagtggctgggtcaggccatgagacacaggtaggttctggtcacaggtagaaggcagcagccacctgggtgatggctgggctgcaggtccttctacgggtgacctagtgggcttgta

SEQ ID NO: 494586 - DNA, 650 bp, Homo sapiens
  misc_feature (650)..(650): n is a, c, g, or t
ctgcgcgatctgcggatctcagcgaacgctctttctggaccacacacctaccattgttgggagcatggagggagtggtgggggcctccgatgaacagctcatcatcggctggtacatcttacccgtgctggtgtgggtgttcaggtactccctgcagaggctggaatacactgagtggcggaccggacgaagagtgtgaaggatcgcacacagagagcccccaactgaggacccagcttccagccctgtgcggacgtattataggtgctccagtgcatgtcgggcagacgggcgcacaggccgcgcaagaatgaggcgatcactgtggtccctcgccagaggagcacttgtgaaggtcagagaggggccatgagacccccgtggaaacactgccgacaatgacttaggatccatctcccttgtccacccactttgaccgggtccactcatgggcatggtttacaaagagaatttggttacgtggacattaaagtcataagcgagaataggggaaacttggggtacgtctttggcttgaaagcaccttacgggagttaaacagatgagttaggcagttttttgtagaaaatggagtactaactggttggtttttggaaagccacgtaaaatgtaatacaccggtgtctgtn

SEQ ID NO: 494587 - DNA, 386 bp, Homo sapiens
cccgtcgctctacaggatcctcctggttgtccggtctatcacttttgtatatcttttcaatctaccagctcctgtcagtcttcgtatttttttaatgagttttttgtgtctctatcttcttcagttctgctctatagttactatattcttgccttctgctagcttttgaatgtttgctcttgcttctctaggttcttttgtgattattcaggaccaggttgttcagtttccatgtagttttgtggttttgagtgagtgtcttaatcctgagttctagtttgattgcactgtggtctgagagacagttagttataatttctgttcttttacatttgctgaggagtgctttacttccaactatgtggtcaattttggaataagtgcga

SEQ ID NO: 494588 - DNA, 842 bp, Homo sapiens
agcggatggcggcggtggcggtggcggcggctggtgcgcgcctgagaagaggggacgccagcccggtcaggcctcgtgtgcggcctacacgctccgttcgctcgtctcgctcccgcctcccgccccgcgcccggccatggcggacgccgtcgtcctgccctgacgtcccggtgcctctcatcgagtcggacgctgtagcttcgcttatcgcccggtacctatcggctgggcccgtgtcggagagcggaccagtgtgctggtgcaggagtctggagcgagttgaccgagttgtatgccgaaatgagatgtggactagtggatgtggcaatcgagcacaacaggagctacgaggagtcggtctcgtccaactaatgcatgttggctcctgatcatcttttgcaaatctgcgaacgcagtcggtcctatgttggatagaagaaattccagcacagtatttcgaagagttacttctttacttggtgcacgaaggcagtctttgctacgtacagcagaaggtaccttaactttgaagaagtgtcctgctttgtatcagtagcctaataattattataagttgtgcaagtattgtaaagcatgtgcgaagcaaaggtgactacttgtaactattaatcatgctgtggactataaaaattcttctgcatttagccatagaacattgacttttattaccattaagttgtttaactgggtccttctgcatttaaaaaagttgattacgatattagatgttcagcttaaaaagcttgaagttattctgagaatgttgttgacgtttaatcaatgtgacgttcttaacttttccattttggtagctccctcct

SEQ ID NO: 494589 - DNA, 4454 bp, Homo sapiens
aaataaagaaagatattttcatgggcagaagatgccactcctcttcccttactccattacgacacttggattaaaattaagtgatagaacaagtaaattcaaaaaaggaaaaaagaactaaataaatcagttcgatccatccttctggcttaccttccacagtcctcttgtcccctcttgctggtaaatgttcatgaagttgcctatcattcctccttgaatggtgttgctttgcgcttgcatccgaatctagagattattttaaagaccaacatcagaaagaaactaccacaatcccacccacaaccaatgtatacctctgacagtcagtccgtcagtcagttgcttaataaccattagcaaggaaaaaactgtcatataaatactgctatgatgctaccttaaaatgactaaaacgtataaaaatttattcttaggaactctgagatctccaaaaagcatctaagagagtccagagtcctacgtacagcagttcattaaatgtcaaaaggagaaactgatttttgtgaaaaaagtctttctaggatagaaaacagcatacttccctactactatataggtgagagaaaagttaatttcaaaggtttaatctaattaatgagttatccagtgtacctggcagcacgaagcacaggcaagcatagttcttaaattagctgctccaagccactacagtctccagccagctgaaccaaaaggtatgcaggcgagctagccaagtgacagccacatgatacctgttacactctgttacactttaattagtggaatccacatgaccaagattccaacataaaaagaatgtttgatgtagctctttgcatttttaagaatgaagaaagattttttactacaaaatgtgtaccttatttttgtttagggagcaaatacgttaccactaacttctaaaagaactgttattgccacacgaacgtgggaaaataaaccaagatacaggaactgccttcccataaggcctaagatataattaagaaattaatgagagtacgaatatttttctctagctctcttaccccaacactggtaaacttatggcaaaggtacctgtatttcttccttacccacgaggtccctttgctacaatgcatatataactgtagtgtacccagaatactgcagatggctgtaatgcttgtcagaatcccctattagattgaaggctctctgagggcagggtccttgtcttactcatatttggattctaaccatggcgtataccaactggtacaagatagaagcatagaatactagttaaatagtggggcagaaaaagaaaagaggggaagtaggaaaggaatactctgtggggttcaaaaagtaagtcattcctaatttttattttatttaattagttgcttccaaaaaaggatttaaagatgctctatccctagtattttcaataaggtctcctaatgtgttatgtaatctaattgtagtaattaaattttttcatctgtatttcctgaaataaattacaagagatacagcatgagccacggcacccggcctctaaaacgattcgtaaaattcaaaatccaacaaaaacacaggtgggtccagatgtggcaaattattagctcactaagtgaaagcctagcccctcatatttattctcaatgaaaatgtaagtgaagaagttcaagacagaatcaggaaaaacaagcctactttcctccatccgatatgcctgtcctattatcctctccaaaccaacaaccacgttgtggcatggacactccccgggtgtctttctgcatttccccacttccttcttgaattgcaatcagggtttctgctgccctcaccctcaaaactcccctcttcaaggtgaccaactgacatctttgttgctaagttaaatgaggcttttcaagtaggatcttgtataagctctttgcagtgtgtgccactgtttaccctttgtcctacttgtagctgtctcctccctgttctgctgtagcatcaccccctctgacttcttttcttttctctacagcatcctacctgtgtctgctggggttccccagaaatctatcctatgcttcttctctccttactgtacatgttccctgtgtgagctcacctactcccaaggcttcaactgccatctaaaggctggccaggcacggtggctcatgcctgtaatcccagcactttgggaagccagggcaggcagatcactgcacctcaggagtttgagaccagcctggacaacatggcaaaaccccatctctataaaaaatataaaagtagcgccagacacggtggctcgcgcctgtaatcccagcactttgggaggccgagacgggtggatcacttgagatcaggagtttaagaccagcctagacaacatggtgaagccccgtctctactaaaaatacaaaaaactggccggttgtcatagctggtgcctgtaatcccagctactcgggaggctgaggcaggagaattgcttgaacctgggaggcagaggttgcagtgagcctgggcaaccgagtgaaacgccatctaaaaaaaaaaattgtgtgtgtgtgtttgtgtgtgtgcagctaggtgcagtggcttgttgtgcctatagttccagctatgtagggggctgcaatgagaggatcgcttgagcctgggaggtggaggctgctgtaagccattttgtgccactgcactccagcctgggtgacaaagcaagaccctgtctcaaaataaataaatgaaaaataaaataaaagactgatgactccaaatccatgcttccaacatggatccaaagacacatttccaatcttccaagattctccatttagatgtcctgtgtataccttcagatagggtcccacactgaactacttctcttccttctccaaacagtcatctctcctcttgtgtttcctaaaccaggacatggaagctccagctacacactggcaaaaaccaccaattgagacattagtcttggctcctccttcccttctacccgcttcatgtatggaaacctcatattaggtcacgtagtgctatcagtcctacaccctaaatagttttctagcctgtcttctttttcctcatccccaaaaccaattcagatcctcatctagtcttcctacatgacagccctgcttctagtgctccctgtctcttaattctttctctccatggcaggcaggtgatgtttacaatgtaaagctgatcaggtccatcctcctacttaaacactttcagtggcttctgtctgccatagatatagcaaactcaaatgctgacaggtaccaagaaagcagatgccatgagtgaatgatccaggctgggtcgaactgcacacacatatactatgtgagtgacagaggttttgtaaaccagagacagtatccttcaccccagctactactgtcataactgaatgaatgtgggcctaatgttgatttctctcaagaagatggagtcccagatttttatgtgcaatttctcatttttaaaatattggctcaattaaaaaaacaaaaacctctggggattggtggatccatggcagggctgtgggtcaccagtttgtgctgtggtgtactggagaaaatcaagatgcttagcgtgacatgaggctgtccacgttcttttcctgcaggtattctgatataggtctcactcactatccagtgcctacagaatactgttcattaaatactgaaagactggaaagtagttcactgcaactcttatcaacatcatataattttcaatatggcaaaaacctccttaattcagaatatctaagaaaagagctattttcaaagcatgaaaaaccgaacagaatgtttttaaacaaacaataatttttaatggtgtctgtctgtactgaatatagtaaaacagtttcaccaaaacatctgctgcataatatatatacttagaaattagagttgaaattaaaagtgaaaaatctgtcatgctattgttctttcaaacacacctcaaacttttacttgtgatctgtgcagtcttggtctgaagtctatacccatgtgaaacagtgaacagtgacacagaaatgcatgaaggcctactcaccccgagtagagtgctttcagcccttcttctctgcctatcctcactaatgcgtgcaacattcctcggtatctaatttccttaaattttgcatcattcgtctggccttgaatctggagccgtgtcttggttaaatcaattggaaatgtaccttaaaatttaaaaagaaattcacttaataaaaagaaattccactaaataaaggatacgtagtgatatattactgaggaaacattcagactacaatataaactaagaaagtgattaagaaatggcactttgcaatcttgtttatatttttaaaaattgaggaatcaaaagattaataaaacccaaaaaatgcatagatataaaaa

SEQ ID NO: 494590 - DNA, 127 bp, Homo sapiens
caagatggtcctcactcactggatctgcaagtgagctgagagaacaaagtagaaaccataacctttggccaggcatggtggctcacgcctgtggtcccagcactttggaagctgaggaccatcgttg

SEQ ID NO: 494591 - DNA, 207 bp, Homo sapiens
ctaaggcttatatgatttctttaaaatttaagataattggagttaaaaggcttgattatggtaccaaggcatggactctgttggccattcaggccaaggtttatgggggcaattaaaaagggctacacttggaaaatttggccaaaacaaatgtaaccccccctcccagagcaagctggaaaattttcctatattgcagaagtatca

SEQ ID NO: 494592 - DNA, 675 bp, Homo sapiens
gggttccatccggctctctttcctctcacaaatttggatagcagccgggggataggaggcggccctccatttccccccgcaatttttaagcgggtattttttagttggtttcccctttttttcaaaactaacttggccaaaaccaaatgagatggccaggctcttttgttttttttgttttgttttgggttttttttttttttggccgcgccccggattttaaaactgggcggtggaaggtgcacaccgttggttggagcgggcatccccccaagtttcccatgtggcccggggctttttttgccccttgttgttttttttaaagtccttcccaatattggaggccttgttcaggggggtcccctgccctccttaaagccccccccctttttttttaggggaaggggcccgtcctttccccagtcccccccggggggggggtagccttgcttttgggttaattttgtaaagccaaattttttttattttccccctaaaaccttttttttttgtttttttttgaaaaaggggcccttggggccccccctcccccctttttttgcccccccctttaaaggtttaaggggttttggtttccccgggggggggggggggccccccggggtttccttttccctttctttgggcccgttttattaaagggcccccccttta

SEQ ID NO: 494593 - DNA, 622 bp, Homo sapiens
ggttgcctgatcctgggctcgttggcggcgtcactgatcagcttcgctccggatcctcggaatcccgtagtcgcggggaggcagagcgtctgtgagctgcttgtccccatcctgcggtcgtcctggggacacagagccctccgtggtgcccggggtattggtgattgtgagccaggtacctcgatcttcctcctcgtgcgccctgccctctggccctctcccagcacctggtgccacagcctgatggcacgcccatggtctgggcctgggtggcgatggcgtcacgtggtgtcccctctttggcctggctcgcgtgactgcctctgggtcctgggtggcaggtccttccttgataggggtgccgtcattgcacaggacatgcccagaacactcgggttccaacatcgggaggaagaggaaagtacgcgcacatctacgggacgggagggatactagatagattttcttgcccctcccaaggaatccaagccgtgattaccggggggtctgcaacgcctaggttcactgtgaaccgcgagcagcccgttttactcctccggttttccccagcaccgatggatcgtgtccttaggtgtaggatcctgctctggcttttcgatga

SEQ ID NO: 494594 - DNA, 319 bp, Homo sapiens
cagaaggagggcaggatgagctgccgacgtgtccaccacctcctggactcttccgcagggacttcggcagcttcgagcacattttgcaaaagcgtcgagtatttctttctcaggcttgttgctgtcaatcagcttggtcacctccttcaccaggaattcacacaccttacaggaaacatcagactttgctgagacctcgcgctttttaatgggctccaccagctccagggcaggtatgacattcttggaggccactttggcgggcaccagagtctgcatgggcatctctttcacctcatcacagaacccaaccagcgca

SEQ ID NO: 494595 - DNA, 794 bp, Homo sapiens
agcggggtggcagacttggtcgggtctgccattccgcgctgtggaggtttgttttttactctttgcagtaaatcttgctgctgctcactctttgggtccgcactgcttttgtgagctgtaacactcacggagaaggtctgcaggttcatttctgatgccagcgatggacacgcagcccgccaggaggagatgaaactgccgaacgctgccgaacatcagaaggaacaaactccaatacacgccgcctttaagaactgtaagcatcctggagggtccggcggcttcatgaagtcgcagagaccatggaacccaccaattccggacacaatatgcactcattgcactccgagcctgggtgacagagtgaaaccctgtctcagaaacttagcttccattgacgaccagctttggctgttccaatctcactcacaggctctgaaagacccatgctcgtctttggattgcttggtacctgcagcacgtttccatgcctgggagggagaatacagagtaagtgaacagtttatctcttactggaacagttccaatgctcttagagattataagtaagtgaatgaaaacaatgagttcaggcattcagtgggaaaatccgactctgaacaggtatggaggtgggtctggatttggtcaacatttcacttcgctactcgtctgaaatgcagctcagagcgaagggaggccagcaatcaggtaacgcacgtcatggtgagagtacctttggtcaccacgggaaaacaaaactaacaagtgtttggcaagagacacagatcgga

SEQ ID NO: 494596 - DNA, 978 bp, Homo sapiens
  misc_feature (61)..(61): n is a, c, g, or t
  misc_feature (72)..(72): n is a, c, g, or t
  misc_feature (80)..(80): n is a, c, g, or t
  misc_feature (129)..(129): n is a, c, g, or t
  misc_feature (157)..(157): n is a, c, g, or t
ggactccgtcgtccgcccgcgccctgagggagcctgtgcgcgtcgactgcccagagtccgngaatcctccgntccgagcncgtccggactcccccgatcccagctttctctcctttgaaaacactaagnataatgtcactgcatcagtttttactanagcaatcacctgtcatgcctggagtcagtggctcgtactcagaattgccctcagtacccagataatcacgacgtgcacctctataagaacgaacgggagccagagggtgaacgctcatgaactcaaggatcacaacggagacatcacaggtattgactgggctcccaagagcgatcgcattgtcactctgtggggcagaccgcaatgcctatgtctggagtcataacagatggtgttaggaagccaatcctggtgatcctgatgaattaatcgcgcagctacttttgtgaagtggtcccccctagagaacaactttgctgtgggaagtggagcacgactcatttctgtacgcaactcttgagtctgaaaatgactggtgggtgagcaagcgacatgaaacaagccgattcgctccacagtcctcagtcttggattcggcattcccaacagacgtttccgctggcacgcaggatcatgtgacttctcaatgtcggagtgtaactctgcctactattacacagacgtggctgcaccaagccgagccagcacgcccctggggcagcaccgatgccctttggggcagcctactgtcaaaagctcagttgccatgtgtgcacctgagcggcttgcgtcccacagggggtcaagacctccgcgtgccaactgaggaccccgcctttggccaggcgtcaggccacggacgagcaaaccggttactgagggccgatgtcctaagcaacacgccgcaggcacccgaacgccggaaacacacgacatttacagcacacaccatccgtgggccccttagcgtgcagaaaaac

SEQ ID NO: 494597 - DNA, 548 bp, Homo sapiens
  misc_feature (246)..(246): n is a, c, g, or t
  misc_feature (253)..(253): n is a, c, g, or t
  misc_feature (363)..(363): n is a, c, g, or t
tatcccgattgttcttcaagagtctgccaccagccaccaagatgatgactggtatatatataatttctagctcggttgtggtggatcacgcctataatcgccagcactttgggggaattaagggttggatcacttgagctcaggagtttgagaccagcctggccaacatggtgaaactgcatctctacaaagaaaaaattagtcaggcatggtggcgcatacctgtagtcccagctacttgggagnctgaggngggaagatcacttgagcccgggagttgaggctgcaatgagccggaatcacagcactgcactctagcctgtgcaacagagaccctgtctgaaaaacaaaaaaagttggtcntccagggagtcagtgcttcctgctcctcttgtgttactttttcctctcctgtctgaaacctccttttactgttgtcctccactggttaccatcatcatcttcaagtatttgtacgatacctcctgggtctgtctatactctaacatcctgataacactttttctgttacattagggcctcaccag

SEQ ID NO: 494598 - DNA, 158 bp, Homo sapiens
tgagctctagtctatactagacctgatctatactacctatttatccgtggcctatctatgctcgtcatctatactgacatatctatacagaccgatctatactgacctatctatactgacttatctatactgacctaatctatcctgacttatctatc

SEQ ID NO: 494599 - DNA, 696 bp, Homo sapiens
ctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaccatgaacaccgacgattgttgacgacgccccgtcccacgcgagcatggcctacagttccaat

SEQ ID NO: 494600 - DNA, 125 bp, Homo sapiens
ggaagctgtcatcatcttcttctgtcatctccttggcaaactccaagatcctgcgtgttctcgcatcacgcccgttcgctctgcacgactccaatgtccttgtttgtacagatgttgggagagaa

SEQ ID NO: 494601 - DNA, 1441 bp, Homo sapiens
ctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaatgaaaaaaaa

SEQ ID NO: 494602 - DNA, 2003 bp, Homo sapiens
ctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaagaaaaacaaaaaaaaaaaaaaacaaaaaaaaaaaaaaaaaaaagggcggccgggcgccggtcaaaaaagatttctctccccccgggggggcgcccaatgtagtcgcgcgcggataccccaggtttctcttggataaaaggggggcgccccatataagggggcgagcccgatatttatatcaacgccgaagagcgacgctggcgcggctgttctacaacaaagcgccgcgaagcagggaaaaccggtgaatcaggtgggggaactctcgtcgcgggaagggaacccctcctactcttcgcgcgggggagcgacctcatacgtgtgggacacaaatctttccctctatagggcagatttattagccgctctcagtggcgggacaattcaatcacacactttttagaaggctgtatatatcagcggtggttaaaacaccctagccggcgacatatgtggacctggggccgcgtagaagaaaccttctgtggctacatgaggagggcggatcttgtctctctctcttggcgaacacgatattcttttccaccggggggcgcccttcacgtcgataaataatgtccgttggttgctctcgcgccatccctgacgcttctcggctgcggtcgtcgtccgtgacctcgacgccgatcgccgttgtcgcatggcggtcgtccatctgggccccggccagccgaccccgccccgcggtgtcgagcgcggccgctcgctctctcagtcgacgccctggcgagtgcgtccttctctgtcgcgcgcttgtgt

SEQ ID NO: 494603 - DNA, 1311 bp, Homo sapiens
  misc_feature (890)..(890): n is a, c, g, or t
  misc_feature (1311)..(1311): n is a, c, g, or t
ccacgcgtacgggcgaccgctgagtgccgcggagagtgacggctggcccggtcgacgggagcctggggcggggctggctgtgcccagctgaatggatgcgcgctggtgctgtgtctggcccctgcccccgtcccctgccctgccgttccctgtgttgactcttcagtggtgccctgggatgtgctgggctgcgatgtgccccatgcgtgctggctgtgctgtggatagttctgtcgcatgtgatgcgagacacgactcattctgactggtgcgaacgtgttgcctgctgtgacttgacacacttcttgctgctgttccggactgtgctgcctgacgttgcgcttgtgacgtgcagtgccaaccatgatgggaacaaccatccgagatgtgcaggaatgcttcaacgtgatgacgacttgccgtacacaggccgaccttgatggctacgactgtgagcagacgtatacgcacgaggagtcgcgcagaacgagatagtagagccgcgagtacgactacacactatcaactcgcaagcgacttgaccatcgagcacgcagcgcgatgcatagcagcctgcattgcacatgtcgacccaagtcacatgtgcaacgcacgcacaccactcacgagagcaccacaagcagcactgctacgcatagtatcactcggcactcaacacgagaaagcagctggcatcccgaagtcgacaccacacatataccgcacacgcagtgcgcactcggaatcgctcatccaagaccaggacacgcaccaccagcacacacacaaccaaacgcacccgagcacacaggcctacgcagaactaacacacgcacggaccgatgacatcgacgcgggcacaacccggaccaaacgcactaggagcgcancacataacaagaacactggggacctgcgcgcccgacgagaaccacgaaccaagaccactcgaggagaagctacgcagaccacgcaaactccgagaacgataactgcgtgatctactcactcagaagcgtaggccgccaagaacggcatggataagcacggctgagacccccacacatgcgagcgacgcacataccgggatcacaacggacaggcgaccgaactgagccaaacgggcagagcacacgcagggcaccggacggagcaatcaacaccggtgctaggagcaccaccaagcgctatcagcacacccgagcgcggacacgcctccacgacagcgtgcaaatcgcacgccgtaccgcgcagacaccacaccgagcagccacccacagaccccccatacaacgacaagacaaccagccn

SEQ ID NO: 494604 - DNA, 1039 bp, Homo sapiens
  misc_feature (47)..(47): n is a, c, g, or t
  misc_feature (66)..(66): n is a, c, g, or t
  misc_feature (92)..(92): n is a, c, g, or t
  misc_feature (96)..(97): n is a, c, g, or t
  misc_feature (106)..(106): n is a, c, g, or t
  misc_feature (128)..(128): n is a, c, g, or t
  misc_feature (135)..(135): n is a, c, g, or t
  misc_feature (140)..(140): n is a, c, g, or t
  misc_feature (145)..(145): n is a, c, g, or t
  misc_feature (180)..(180): n is a, c, g, or t
  misc_feature (193)..(193): n is a, c, g, or t
  misc_feature (196)..(196): n is a, c, g, or t
  misc_feature (200)..(200): n is a, c, g, or t
  misc_feature (211)..(211): n is a, c, g, or t
  misc_feature (213)..(213): n is a, c, g, or t
  misc_feature (231)..(231): n is a, c, g, or t
  misc_feature (238)..(239): n is a, c, g, or t
  misc_feature (242)..(242): n is a, c, g, or t
  misc_feature (248)..(248): n is a, c, g, or t
  misc_feature (250)..(250): n is a, c, g, or t
  misc_feature (271)..(271): n is a, c, g, or t
  misc_feature (276)..(276): n is a, c, g, or t
  misc_feature (279)..(280): n is a, c, g, or t
  misc_feature (282)..(282): n is a, c, g, or t
  misc_feature (289)..(290): n is a, c, g, or t
  misc_feature (292)..(292): n is a, c, g, or t
  misc_feature (295)..(296): n is a, c, g, or t
  misc_feature (298)..(298): n is a, c, g, or t
  misc_feature (302)..(302): n is a, c, g, or t
  misc_feature (322)..(322): n is a, c, g, or t
  misc_feature (331)..(331): n is a, c, g, or t
tctctctactagctgccccaacacccctgttatccccaaaggtaacnacgaaagcgcaaaaagctnacgcccttcttttggtatgtgtttcnctgnngcctaccanaaaatgttgggtaggtgttttnatgtaantcttnggtanatttcactctccattcgcgcaggggttcaggcgtnccaccaccggatnaancctnacagggttgantncctaacgaattttttgangggggannatncgcgcntngctaggagcttggaaaaatangtgtnacnnantggggtnncnaanntnagtnagggagtgtgcgctccgctnaccaaacgnatacccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaatgaaaaaaaa

SEQ ID NO: 494605 - DNA, 263 bp, Homo sapiens
cctatgctacacattttaactttaagctacgacccagtatgaaatatgagtcctagggggagtactatgctgtatgtacatgacatgctctgcagtctctacggaaatattggattcaagatagctgactgttggacctggcatcaaatacacgcccatgtatccttctgtcgtaaagtaagaacgctcttgcatttgatgtggactaaatatagatgatatcactatctgctattctgcctttgttctgaaacaattgcttt

SEQ ID NO: 494606 - DNA, 1390 bp, Homo sapiens
ctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaatgaaaaaaaa

SEQ ID NO: 494607 - DNA, 599 bp, Homo sapiens
gcggccgcctactactactactgctcgaattcaagcttctaacgatgtacggggacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaatgaaaaaaaa

SEQ ID NO: 494608 - DNA, 319 bp, Homo sapiens
  misc_feature (40)..(40): n is a, c, g, or t
cactttatagatcccctctttggtggtgctctcaagtcangagcttttatcttctgccatctatgataacacagtgaatctgtaccggcagaaggatgataactgggtatactctcccacccttgagggccatgaatccactgtgtggagctgggcctttgaccctagtggccaacgcctggcgtcttgtaatgatgaccgtactgtgcgtatctggcgtcagtatctaccaagcaataaacaaagggtggcatgcaacggctcttaccccaaatggaaatgtatctttacttttaccggctttcactcaaagaccatt

SEQ ID NO: 494609 - DNA, 1399 bp, Homo sapiens
ctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaatgaaaaaaaa

SEQ ID NO: 494610 - DNA, 1254 bp, Homo sapiens
  misc_feature (757)..(757): n is a, c, g, or t
  misc_feature (768)..(768): n is a, c, g, or t
  misc_feature (774)..(774): n is a, c, g, or t
  misc_feature (776)..(776): n is a, c, g, or t
  misc_feature (778)..(778): n is a, c, g, or t
  misc_feature (780)..(780): n is a, c, g, or t
  misc_feature (783)..(783): n is a, c, g, or t
  misc_feature (787)..(787): n is a, c, g, or t
  misc_feature (793)..(793): n is a, c, g, or t
  misc_feature (797)..(797): n is a, c, g, or t
  misc_feature (801)..(801): n is a, c, g, or t
  misc_feature (804)..(804): n is a, c, g, or t
  misc_feature (813)..(813): n is a, c, g, or t
  misc_feature (819)..(819): n is a, c, g, or t
  misc_feature (828)..(828): n is a, c, g, or t
  misc_feature (831)..(831): n is a, c, g, or t
  misc_feature (846)..(846): n is a, c, g, or t
  misc_feature (859)..(859): n is a, c, g, or t
  misc_feature (871)..(871): n is a, c, g, or t
  misc_feature (874)..(874): n is a, c, g, or t
  misc_feature (1052)..(1053): n is a, c, g, or t
  misc_feature (1068)..(1069): n is a, c, g, or t
  misc_feature (1083)..(1083): n is a, c, g, or t
  misc_feature (1131)..(1131): n is a, c, g, or t
  misc_feature (1156)..(1156): n is a, c, g, or t
  misc_feature (1160)..(1160): n is a, c, g, or t
  misc_feature (1165)..(1165): n is a, c, g, or t
  misc_feature (1193)..(1193): n is a, c, g, or t
  misc_feature (1196)..(1196): n is a, c, g, or t
cgtaggtaggcgcgggctggtccgtgtgtgctccgtgctcgggcgtccgtccgcggcggcgcgagtgggcgggcgctgtgtttgggtggtcttgccccgtgtttggtgcggtttggtgcggggtgtgtggcgggggtcttcttggcttttcttggcgctgtggtgtgtggctctgtcgtctgggggtgtgggcctggttgcgtccctctttgtttgcctccccacatacaccccttggtgtgaagcaccccacccggtttgggcccccctatggacctcgagtgaccacaaagtgtgcacaataaaccaggcgttgtaaacaccggccctgttctttatttcgggtttctaagggtacgaagcccattgggtggcgggaattttcgccacagaggccatagcacccataggaagaagagtcctaaggaaaaatagaggcgcccacttggggaaaagggggacccggcccttgaatggttaaaatatctccgggcgttccaccaagtgacctggatgttgcgctagggacgcttccggtgttctaccagagttttcaggaagccctcaaggacctgcccccggggcacacaggtgtgagaaaagtgagggcccgtaacaaggaagtgaaattctgagattgtttggggcttaagccgtggcaccccctgcttcccatgcgtccccggcccccacatcacatctggccctccaatagaatattttttgtgtccaattggtggttgttgcgcccaggctnggagtgccagntggcgncncntnttnggcntccacntgcncacnctnccaaccatntcgggnctccaaacngantttctccagcctctnagcctccctgagntagcttaggacntcncaggtgctctccacccacgcccggctaaatttttgtaatttttatagtaagagaatggggtttccccacatggttggccacaggctggtttctgaaactcctggcctcaaggtgtgaatccgcccgcctctcgcctctcccacagcgctgaaagttaacaaggtgtgaaccccaccgnngcccacggccctccnntaggttttaaggangtccccagccctcctcccttctgggcccgacccgcttatactgctccnttttccccggccaaaatgccccccnagtnctgcncagggaccccccacccaggggccctgcnccntgagataatgtgaatacgactgtggacccaacgccaattaaacctctgtttgttccga

SEQ ID NO: 494611 - DNA, 1225 bp, Homo sapiens
ctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaatgaaaaaaaa

SEQ ID NO: 494612 - DNA, 297 bp, Homo sapiens
  misc_feature (224)..(224): n is a, c, g, or t
cgtcgacgcagtgtgagctgagcgtggtggctcatgcctgtaatcccacagtttggtatgctgagctgggaggatacttgagcccaggagatggataccaccttgggcaacatagtaagaccccatcttcacaagaaatttaaaaattaggcaggctcggtggtatgcatctgtggtcccagctactcaaaaggctgaggtgggagaatgccacttaaacctgngaggtcaagactgtagtgagccacgttcattgcactgcactctagcctgggagagagagtgagaccccatctc

SEQ ID NO: 494613 - DNA, 243 bp, Homo sapiens
gacttcatatcagcctacgccattagatggactcctcagatattctgctgatttataggtggtgattgcagctttgatgctatacaggtgagggcagtcttgctacaggagccacatgcgcattggtcttcatgagcatgtctgggatctcccgaagctctgcagttcactgaatcaagctctgaccagccttattgcaaggttggatgcctggtcagagcagcagggaaagacagggcgggg

SEQ ID NO: 494614 - DNA, 340 bp, Homo sapiens
tcgactctaacgatccccagttttattgctataggctattatgattattaatagatcagatatagattggtagtattggttatggttcattgtccggagcagtattttgtagaaaaggatagctattagaaggattatggatgcggttgcttgcgtgaggaaatacttgatggcagcttctgtggaacgagggtttatttttttggttagaactggaataaaagctagcatgtttatttctaggcctactcagggtaaaaaatcagtgcgagcttagcgctgtgatgagtgtgcctgcaaagatggtagagtagatgacgggttgggccaggggattaat

SEQ ID NO: 494615 - DNA, 1134 bp, Homo sapiens
ctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgatacttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaatgaaaaaaaa

SEQ ID NO: 494616 - DNA, 715 bp, Homo sapiens
gaaaaattaacttcccctctgttccccaagccttacccgggggggggggggcacccactgtgatcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgatacttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaatgaaaaaaaa

SEQ ID NO: 494617 - DNA, 774 bp, Homo sapiens
  misc_feature (43)..(43): n is a, c, g, or t
  misc_feature (87)..(87): n is a, c, g, or t
  misc_feature (109)..(109): n is a, c, g, or t
  misc_feature (158)..(158): n is a, c, g, or t
  misc_feature (195)..(195): n is a, c, g, or t
  misc_feature (204)..(204): n is a, c, g, or t
  misc_feature (228)..(228): n is a, c, g, or t
  misc_feature (245)..(245): n is a, c, g, or t
  misc_feature (269)..(269): n is a, c, g, or t
  misc_feature (275)..(275): n is a, c, g, or t
  misc_feature (296)..(296): n is a, c, g, or t
  misc_feature (304)..(304): n is a, c, g, or t
  misc_feature (311)..(311): n is a, c, g, or t
  misc_feature (350)..(350): n is a, c, g, or t
  misc_feature (356)..(358): n is a, c, g, or t
  misc_feature (379)..(380): n is a, c, g, or t
  misc_feature (383)..(383): n is a, c, g, or t
  misc_feature (390)..(390): n is a, c, g, or t
  misc_feature (397)..(397): n is a, c, g, or t
  misc_feature (453)..(453): n is a, c, g, or t
  misc_feature (460)..(460): n is a, c, g, or t
  misc_feature (530)..(530): n is a, c, g, or t
  misc_feature (579)..(579): n is a, c, g, or t
  misc_feature (587)..(587): n is a, c, g, or t
  misc_feature (591)..(591): n is a, c, g, or t
  misc_feature (723)..(723): n is a, c, g, or t
aagactacatgcttaacattaagcttagaaacataattgctgnaatacattaaaaatacttcattttccaatattgtaaagtatatntcccaatacctggtataaatcnccttttgcacaaaaatttaaaggacatcctacagctagctattactacngcgttaagtaatcatttgaaggaataattcacaaggngagcaggtnataaaactaagcataataattatngcatttaactaaaaaanatcaagtagttctgaattacactngtgttnggtcttagtaatgggcatatncactttcnagctacnagtttgataaatatactaagattgtataagagtggggtncccggnnntgggttttctggggggggtannttnctttccngtgtccntccccaacagcagttggaattttcttttgaacacaaagtaaattaatgtttatacngtttttncacctgagtcatgtaaaaggggactcctttcattttaaaaagttatatttaatttttgggggccttaatnaaaatttaacatttaaccatgtgtttttttttgtaaacagtctacatgncaacaaangganaagggttaacaaaggcaaatactgacttcatttgtgttttaaacacgattatatgaatttttcttttttaattaaaaaatgacataaaaccattcatataggtcctcttctctcaactgctttgagatatanctttaaatatgggtagatcaagacaagtaatgttgggaatctcttatcctg

SEQ ID NO: 494618 - DNA, 615 bp, Homo sapiens
ggcaggcaatgacggtgggcacgtgtctgcgcgcgccgagtggggcccctacaagaccgagcccgccaccgacctcgtgcctgctggcgactcaagcctgcgagaaggggccggcagacgtggacctacctgcaggacgagcgcgccggccgcgagcagaccaggcctgtgaagcctacgcccgtgagggctggacaccaagaagttactcttaatggacttgcccatagcccacaccgccgtttgacggggggctctgaacgggatgacatattaacgtgggtgctgcaggctgaggatgggcacatggacgggtgattatggttggcccacgtttatcctcctgatcatggcgctctcgtgatcacttgcacacagtggcacgctatccctctagacagccgtgatacatgacgaagagattgtgctggataccttgcgtgtcaagtgcagcgtccctgacgtgtggctggtggccgtgcacatcgagagatacgtccaccgtgtttgggactgcgctcaactatgtgtctctcagaacttctgggtgttggcgcctgagcgatcctgacctggctacgagcccggaaacattccttcaacaagcaaaaggtg

SEQ ID NO: 494619 - DNA, 379 bp, Homo sapiens
tcctggagactagacagtttcagaatgctaaggcacagcaggagttgaatccagtgtcaagaggattacagagtatctcatacattgctggtgggaatgttacatggtgccgctgttttggaaagcagtccagcagtttctcaaaatgctaaacatagaattacacagtaactctgagataacatcccacttcacggattgaaagagaattgaaagcatatgtctacacaaaaacgtgtacatcaatgcccataggagcattatacataatagccaaaaagtggaaacaacctaaatgcccatcgatggacaaatggataaacaacatgtggtatatgcatatgatggaatattattcagccaaacattcaagccgtca

SEQ ID NO: 494620 - DNA, 179 bp, Homo sapiens
  misc_feature (6)..(6): n is a, c, g, or t
  misc_feature (18)..(18): n is a, c, g, or t
  misc_feature (57)..(57): n is a, c, g, or t
  misc_feature (153)..(153): n is a, c, g, or t
  misc_feature (165)..(165): n is a, c, g, or t
ggcagngcccatggcggngggcggcacccagaacgggcgggcaggccggctccgcanacagggtattgctgtgttgcccaggctgatcttgaaactcctggactcaagtgaatcctgacctcagcctcctgaagatagctgggaattacaggngtgccaccatgncccagcttgtaatt

SEQ ID NO: 494621 - DNA, 149 bp, Homo sapiens
aggccttgggggtggggcctcctttagccccctcctcctgggggatgctccccagggttagggggctggttttaggggaaaaggtggggggttttttttgtaaaataaaaacaaggttttgtacaaaaattaacacccttgtttagaga

SEQ ID NO: 494622 - DNA, 107 bp, Homo sapiens
cctcacagaccctgaagcttcaccggcgcagtcattctcataatcgcccacggacttacatcctcattactattctgccgctgcaaacttgtaccggtggcaaccaa

SEQ ID NO: 494623 - DNA, 430 bp, Homo sapiens
gaaaagggaaggaggtggaggggagggcaatagaggcgggcacactcagtataacttaatggaactatagggtactccctctctgacattttgggcaaattcctctaaaaaatgtttctatacagtaccattccttctcccatcattggcttccatatcagtgccagtattatagaaagatctaggtctaaaagaagccaaaagcagtcttaaataatgggaagctttcgggcagatgggtctaccatcagtctatcgggcagtgtatccctctacatcttctccctcatcatcgggcaggggttgggaagcacggagctccatcaagcggtcttctctaacctcctgggggggggagctaagtactggattttctccaaaccatgatatctggaagtgctccacatctcatctttttgggccatatcta

SEQ ID NO: 494624 - DNA, 228 bp, Homo sapiens
gagcgggattcgtcgctgcggagtgtcgctgcgcactgcctctgccacctcgcggatcaggagccagcgtggttcgccccgatgcctccggtgccggtggagaggaagcgagagggaagccagcgttgctgggattgacgcacggtgcgtcgccctaccgccgtggaaagaagcccagagccaccggtgaccaggtcaggatcgcgttgccaccggctcgtcagccga

SEQ ID NO: 494625 - DNA, 92 bp, Homo sapiens
gagaggcagaggataaaggaggaagagaaaagggcagcagaggagaggcagaggataaaggaggaagagacaatccagcagccagggtcgac

SEQ ID NO: 494626 - DNA, 867 bp, Homo sapiens
  misc_feature (48)..(48): n is a, c, g, or t
ttttttttttagcctaaaaaagcaactttattaatgtcctgcagcagngtacattagtaattataacaatgcattaaaattttcatttcatgtcataaaaaatcagtttccttcatgatgatacatttatgtttaactggagtgagtttggtccctccaaaaaacctttctggggaacatgccttctccagggactgcttcctaaagatgcccaggttgcttaccacaggtcactcttgggtcatttaaaagctcgtcaagctgtctggactgcaccctctcacctgaagttgagccaaattcccttctctcaaaccctaacgccgccatcacctaagacactggggccatctcggcctgggtcagagcattactaacaacgctaatggtggggatactcttgggtcatagactcttaatcttcatttaagcatacaaacaactacagtctaacaagtaggctcctgctatctctaaaagctattttaaatcacacttaacctatgtcctggcgaaaattcaccaccctggactgggtccagtctgcccattcccctgttggaactctagtatcagtcgtcgccattacgcaactccacttgtgagctgacaaaccactgcactgatatctcgcggaccccccaaggggtctcacggccgacctgcccctgctgccaagacatcaccatatccttgtccacatacactttgaacctccctaaaggtgccctgaacccgggttccaccgtgcctttcttcctgacactgccccgttataacccttgcgtcaagagttcctcaacccggtttacctctctctcttacccacatggccttaccccctagctcgcctcatctttcccatgc

SEQ ID NO: 494627 - DNA, 89 bp, Homo sapiens
cgcctctgccaccacgggcttgcagcaagaccatgcaggatgttcctgtggctccatttggtttcaaaagcatttaggggcttccttgc

SEQ ID NO: 494628 - DNA, 762 bp, Homo sapiens
aggaggggagcgggacaggatcacttcaagctatgtgtgaggttgcagaaataagaaggaaatatctccatggtcattgctgaaaatgtcaggcgaggatagagttgatgaaagatcgtgcttaataagggaatatggccatgcaactagtctcagggccataggggatccattgccacccagctgtggtccttatagccagtagatctaggacctcaccagtgaagctgatgatgctgatgatgatgtggtgttatgaatctatacaactccttcaatttctgctccagcaatagctgtcaaagaacccttcatatcggcttcatcaaaaaagttgaaaggcctcaggaaattattctgtaaatcctccttcttcaagagattgtggcatctcagaagggaactatcagtgagaccacttgtatggtgatgaaggaggccttagaacccaatgggggacgcagagaaaaagtctcctgttaatccgaatggggactcctgactaaaaaaaaccaaacgatttggattctcccacttccagcctttcaagaagtaagaccaaacttggggtaaaacctttaaccctgtagaatgactgtcgcgcaacttattcaggaaggggaattgactcatatagcttgggatgcctacaacgaaggtatgcatctccgagaaaagaatcctccaaatttagaccttgtggcccgggaaactgttaaaagcgtaagcagtgctgggaaccacggggaacaatggggacga

SEQ ID NO: 494629 - DNA, 638 bp, Homo sapiens
aaagtctgtttttagctaaaaatcacagtgataactgctctgggaatcaaacctatcattgatcttgagtattttggtccgtctgagaggctccatacttgaatctcatcatcttgatagctgtacccgctgttgaaaatgttaggaatttcacacctttctctgcttcctgtaagccatgttccccagcgtcgtatttattgtccccatcgagctgttctactgccacataatccacaaatgattcaaatatatttttctttcctttgatacttagctggatatcataataatcttctcttctatcagaccgatagtctacttctttacactggatataggacaccattttgccgcggaataatttgggtatggtgccctctacacaggtgcctttcatcttattttccacattatcgagcaacactcgacaaagctcctgaacatcatgttgcatgaagctatctaaagtttcccacccaaatgactttgttaacttttttgttcctacaggtttatcactatgctgtaattcatagaacactctttgtaatgctaaagagacgcttttagacgaatcatccccctcggttggcatcatgtacacagcctttcgtagcttattcgtgaaaaataac

SEQ ID NO: 494630 - DNA, 342 bp, Homo sapiens
catggccgatcaggtacacggccaagtgcaagtcacatctccacatagacatctaccacccaccatggactactacagggcatacatactcctcctcgataggtacttctatacaggtaagacagatcctcctatcaggactctcaatctgaatctccaggtaaactctagaacaggatacagttacagtaccagacaccctgaacagagccatagatgtcggcttccacactacatgacgacaggtacaactctagtactacatacttgagtgcggaaatcatccgaggccagacgggcattgtacaatctgcagaaggacataaggcattgtccactgtg

SEQ ID NO: 494631 - DNA, 190 bp, Homo sapiens
cgttggacgaaggaatgaacggcgcagctcgaacgatgggggcgcggaggagtggagtaccccttgtctcgggtcggtctgagatcccctcgcggattggcgctcctatatgggcgctttaccttcatcttcggcgcgagaggccgcgggtggtgcttacttatttggcgaaaccaaacatatggggcat

SEQ ID NO: 494632 - DNA, 514 bp, Homo sapiens
cgatacactgaagatgaagtgtaaaaaaagagaggcacagaaataggtctcaccaaggaaaaatgataatagtagcttagatataaaactaaatcaacaagtaaataaactatacaggtcaactacaaaccaaaaccagccggaaagactcaacctgaaaaaatgctaaaaaataaggcataaatctgcataatattgagtttcatatccaatctctccttaccctgtacaatgtatgctttacctgatctggctctaggggcttacaagagaacgggtaccggatcccgtcttcaatgtgccctcaaatgtccagaacaaagttattgtcaatctgctgagggtgcttacggaagatgagctttagccatcattatgtctactaatccagtagttaaggacgtagcgccaaatatgactgcttccacttggacttctggaacgacttaaaactctgacagtgccttgcctggaccgtattatgttggaaaagagaaaaccagcaaaattattg

SEQ ID NO: 494633 - DNA, 504 bp, Homo sapiens
  misc_feature (375)..(375): n is a, c, g, or t
  misc_feature (397)..(397): n is a, c, g, or t
  misc_feature (401)..(401): n is a, c, g, or t
  misc_feature (407)..(407): n is a, c, g, or t
tttgagatgaggtctcactatgctgcccaggctggagtgcagtggctgttcacaggtgtgatccttccacctcagtctcccaagtagctgggactacaggcatgtgcaccacacccagatacatgttttaatcacaacagcaactttaattataagtcactctaagatgcagtgatacatacaaagcattctaaaaacaaaaacaatgtttaaaaagcacacatttttacttcaacataatttcttatgcatgtgcagccaatgggaaaatctattatagctattgttgccttttgaggttgagaggaaaggacagagggaaaaattatttacttagtattccttgtcgccatgatctttgtccataaaagtcangaacgcctgtttgtgtttctangggntcaggnttgggatacattacagaagcctgtaaattaaaacacaaacctaaataatagtttatggaactcatcgcaaatcaactcttgcccaacctttgactga

SEQ ID NO: 494634 - DNA, 868 bp, Homo sapiens
cagacatgcgccaccacgccctgctagtttgtatttttagtagagacagcctggccatttgaaccgaggaagaggctgcagtgagccaaggtcatgccactgtactccagcctgggcgacagaggtgagactctgtgtcaaaaaaaaaaaaaggaaaggaaaggaatttaacatttggaatttggcaataactccagcaaataattccttattttatattcccttaagagaattgaacattttttgtttgatttaaaacctgtgtacccgaattgtggctcagcagcatttattcgtaattagccaaaagggtggaaccggttcaaattgtccatgaatcttacgaatgggttaacgcaaaacatggtctctgggcaacagaggtgtgtggcctgtaactctagctactctgggagggctggaaggctgaggcaggaagcctgagcccaagggagtttccaggtcagcctgggcaactttggcaagaccctgtttccctttaacaaaacaaaggtggtgttacccttcacaatgaagtggtttttccccatttggtactggtacttgctatggattcgcattaacttgaaaattgaggttaattgacagaagacgataattttatttgattggtattaattagaaaatgtccggaaaagaggaattcacggcaatggacggttatatcgggggcccgggacaccggagggggtggtaacaaaggggggaagcccaagaggtgggtcttggggcggttaacagtggattgttgtgttggtgtggctcttgtgttcactttaaaacccattggtcttacagggattcaggtgaaattccaaggtgcctacaggtgtaaatgtgaaattgg

SEQ ID NO: 494635 - DNA, 126 bp, Homo sapiens
tctagaggatccacttatgtctgaccacgtattaagttctttttaaaagataaagtactataaagaaaagacagggagaaaaaaatggaattgggcaaaaacattaagggtgggtcagaacataag

SEQ ID NO: 494636 - DNA, 283 bp, Homo sapiens
cagtggttcacatctgtagtcccagcactttgggaggctgaagcaggaggattgcttgagcccaggagctcaagattagcctaggcaacatagtgaaaccccatctctaccaaaaaaaaaaaaaattcaaaaatttagaaaggggtgttggaataaccctgtggccccagtttctcagggggttgagggggaaagttcattggaccctagggggtaaagggtgaactgagccgtgatcgtgccactgaaccccagcctgagtgaaagggaaagatttggggga

SEQ ID NO: 494637 - DNA, 873 bp, Homo sapiens
ccacgcgtccgaacttttctaagcttcaatttctagttatctagaatggggatgattcacctaaatactcttatgcctgtatacttcagggtatatatataagaatgtatatgtgacttgtcaggcaatgtgctataaggcctaataataataattaataaagaatatgttcttagtgttgtatttatttcacttgatgtttataaagtaattatattttggagacttctaacagtatcactattctaagtgccttcctggattaagatggaaaacgagatgatatacataaagtgtacacagtgcttaccacgtagtcagttattcaatcacatattgtcctatcttctcccttctgttacataaagctaatttcgatgcaacttactttagacatgatactctcttaaagtcagatttaattatgtcacatgcattcaaaacattatctctcaaacaatattgccatatgagccctcagatttggagatagcagaactgtcaggtgatgtcaatcacatctttcctcaaagttctacaaagcctgggatatggccgagaaatcccagcatctatgccgcaatctcgcagcaacacagaaatggcaacccccggcagcagcctcaagccaccaggaacgacaaacaaagtggcacatgatccaccacagaaatcgcccggaccaaaactccatcggcagatgaatacaggtgaacccaggagaggacctgggacagaaaacggcacataccaaggcaaccaatcgcgacagccaaccgaaaagacacaccgacccacacaaacccacgcaacccagacacacatcaaccacacaccaacaaaacagacacgcccacaagccaacacgcacac

SEQ ID NO: 494638 - DNA, 146 bp, Homo sapiens
tccactagtgtaggcctccgctccgagcccgaccggactcccccgatcccagctttctatccttcgaaaacactaagactaacgtcactgcctaagcgtttactagagccaatcacctgtcatgcgtgaaacagggagaggactta

SEQ ID NO: 494639 - DNA, 402 bp, Homo sapiens
atgatcatcctacccgagatggtgggcagcatggtgggcgtctacaatcccagctacttgggaggctgaggcaggagaatcacttgaacccgggaggcggaggttgcagtgagccgagatcgcaccattgcactccagtctgggcaacagagtgagattccgtctcaaaaaaaaaaaaggaaagggaaaaaaaattagctttataccttccttccttggtttccaaccggccaggaaatttcttgaacattccaaatttcagtggattaactccaaaacaaattttataaggtataaattaaatttacttctaatagtaatagtatacttaaaaaggcctcagggtatattatctttcttaaacaggttacaattcagtgcaggttactttaaccaattatg

SEQ ID NO: 494640 - DNA, 109 bp, Homo sapiens
gcggccgcctactactactactactgctcgaattcaagcttctaacgatgtacggggacatgtttgatttttacactgaaaaataaaaaaatcctggtatgtttaaaaa

SEQ ID NO: 494641 - DNA, 105 bp, Homo sapiens
  misc_feature (15)..(15): n is a, c, g, or t
  misc_feature (40)..(40): n is a, c, g, or t
  misc_feature (67)..(67): n is a, c, g, or t
tccccggggttcaangttataaaatatgtttgtgtagagnacaagggacaatgcgtcatatgtggtncccccgaagatgcagtggtgagggtgtctatcagaaca

SEQ ID NO: 494642 - DNA, 446 bp, Homo sapiens
tcgaagatggccggtgggtgctctcagatctgaccaggagttggcttgggtggaaacggtggtttcatccaacatatgctatgggacatgattattattccattcaaatggattacagacttcttgaggagaggacaaacttatctctcatggtgtggttttagaatacgttgataaccaaggaagaaaccatgccagcggtgaccagttcaacttcttaaggcagagactaagcgttttgcatatcgtgttctgacccgggacatcagtagtggtgaatggcccagcatcggttccatctggtaacaactcccgtgctgtgtcttaaaaccacctcttcctatgttcagtctgtggttgggacagtctgacccaaccttgagcttggtggggtgaacatgtcattcagccctcatcaatcagcaaatccatctgaactggtggag

SEQ ID NO: 494643 - DNA, 271 bp, Homo sapiens
aatttgggcacgaggtaccggtgtagaaaaaccagtgtagaaagggttaagccccagccccaggtgtggccctcatgggggtgagggctcccttggggggcctgccagcaaagccagtgccataagggagttaaaggggttgtcccccccttaattcaagttcccctttcaggttgtcacaaaggccttgtgccgcccgcttggcccccctgttttgtggattcctttggaaagggctccgtgggcaggccaataaaaagttttgcttcca

SEQ ID NO: 494644 - DNA, 999 bp, Homo sapiens
  misc_feature (767)..(767): n is a, c, g, or t
cggactaggaccagttccttcagtacatactacttgacatcctaattatagaatgtatgtcgcaacctaatttactgacccctatagaagttgatgatgagtcatgttcgcagacttgataattctcaactctacgggccttcatggtagcaggaggaccaaataatatgagagactcccaagggaaacaattgagcctatcctctgccagttccttacttaagcttcgccccaattataccatcattcaaaggcgcctggggcatggtgagataacaaataaaggaaagtattcacatacatgtacgcccggcaacagtagttccaggacttgtgactcctctggacccctctgtctatggtggcagtcatgctatgatagagcatgagctaagggtagattggtccacaggcttgccatctaacatgtggagcagtcaaaatgatgtttctttagtctttagataggaagagaaagaagaagccatctttagttgtatattttgccaaaagtgacttcaaaaataaataacctggttttggacatttagatttctcccatttaaattttccttaaggaaagaattattttctacaatagaaaattaagcatgtagcatattgccaggcatatataggccccacaggtgcacattcactgcactgtgaggttaatcaggttcttggaactcccctccagtgccactcggcagtgattttagcagaagaatcactctacgggaatgtatgagtgccatgttgacgtncaggagtgacgttctacagtgaacactcaacatttttttggagccacctcataaatttgagcgggggtacaaaaaagtttattaggattggtttgggccaaagaaattcgcacggtgaaaatatggctatatgtattactggcagttttgtgggaaagttggattatgaccccacggagaagcactagatcacgaagggaaccagattatctagaaattcctatcttagtaa

SEQ ID NO: 494645 - DNA, 1147 bp, Homo sapiens
  misc_feature (928)..(928): n is a, c, g, or t
  misc_feature (933)..(933): n is a, c, g, or t
  misc_feature (936)..(936): n is a, c, g, or t
gtatacagacggtatgtgtacgatgaagggtatagctaactgggtgcaaggttggaagaaaagatgggtggaagacaagtgcaggtaaagaggtgatcaacaaagaggacttgtggcactggagaggcttacccagtggaatggacattcagtggatgcatgttcctggtcattcgggatttatacggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggagaattatgtgagatttccacattatgtttactgggttcaatactgtccttgcttgttttattgcaggcaagcaaggcaaatggcctaaaatgctgtggcttatattttgataagaaatcaaaaaaccattggttaaaagatgcaactcagaagtctggaagtattctgaaagcatccatttaccgtccagttgacaggtttgagtctcctgcttgtataggtgacttgtgcccatgggtacattaaaggaacatgctgcccagggcctgggcggacagctcagtgggcaggatgtgtgctgggtctcagccccatgtgcctgcttgctgggcagttagtatagggcaaagcctgcctgcggcgaccctggctgctaggccattctctaggaacagctgcgactcataaagaccaagaagcataaataaactttcaaaaatttatttggctctttcgttaaaaactgtgcaaattacnaccancanacacacacacaaaaactttgttggccggctgggacccgaaaaagttttaacccctccgtggggccgggggccccgtggtacgtggccccgggccaagcgggcccaaggagaccgcgcacacacggcgccggtccccccttaaaaaccgcggcgaccccgctgcgacatcccaaggtccgaggcaccgggctcacagagccagagctatacg

SEQ ID NO: 494646 - DNA, 828 bp, Homo sapiens
atggacatgcagcgaggtaggtctacggagacgctattgccccgtatcatagatgagctgatcgcctttcatgatcacgcgcctcataatcatgttccttatctgctgcctagtcctgtatgccctttttcctaacactcacaacagaagtaactaatactagcatctcagaggctcaggaaatagaaggccgtctgaactatcctgcccgccatcatcctagtcctcatcgggctcccatccctacgcatctttacataacagacgaggtcacgatccctcccttaccatcaaatcaatttggccaccaatggtactgaacctacgagtacaacgactacggggacttaatcttcaaactcctacatacttccccaattattcctagaaccaggcgacctgcgatccttgacgtgacaatcgagtagtactcccgattgaagcccccattcgtataatatttacatcacaagacgtctggcacctcatgagcttgtccccacataggcttaaaaacgatgccattcccggacgtctaaaccaaccaacttcagcgctacacgaccgggggtatactacggtcaatgctcctgaaatccagtggagcaaaccacaggttcatgccctttcgtcctagaattagttcccctaacatcctttgaaataggggcggtattaaccttataaacccctctacccctcagaattgagacgcacacgacaacaacacaatctgtcgtcgcccccatccaaaacttcaccaccatcgggggcgggcctggacatcactgctaggtgtccgaggaccgggcagccggtgttccccaa

SEQ ID NO: 494647 - DNA, 1738 bp, Homo sapiens
gtatacagacggtatgtgtacgatgaagggtatagctaactgggtgcaaggttggaagaaaagatgggtggaagacaagtgcaggtaaagaggtgatcaacaaagaggacttgtggcactggagaggcttacccagtggaatggacattcagtggatgcatgttcctggtcattcgggatttatacggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggagaattatgtgagatttccacattatgtttactgggttcaatactgtccttgcttgttttattgcaggcaagcaaggcaaatggcctaaaatgctgtggcttatattttgataagaaatcaaaaaaccattggttaaaagatgcaactcagaagtctggaagtattctgaaagcatccatttaccgtccagttgacaggtttgagtctcctgcttgtataggtgacttgtgcccatgggtacattaaaggaacatgctgcccagggcctgggcggacagctcagtgggcaggatgtgtgctgggtctcagccccatgtgcctgcttgctgggcagttagtatagggcaaagcctgcctgcggcgaccctggctgctaggccattctctaggaacagctgcgactcataaagaccaagaagcataaataaactttcaaaaatttatttggctctttcgttaaaaactgtgcaaattaaaaaaaaaaaaaaaaagtaagacaccgggggggcacaggggctcacttgctgggaatcctaagcactttggggaggccaaggcggggcagatcacttggaggtcaggagtttggagaccagctgggccaacatggacgaaaccctgggtctctactaaaattacaaaaattatccaggtggtgggtgggcacgggctggtagtcccagctactggggaggctgaggcacaagaatcacttgaacccaggcggcagaggttgcagtggagccaagattggcaccactggcactccatcctgggcgcaacagagtggagactctggtctcaaaaaaaaaaaaagtgtcgtcaaaggtgttggccagtgatacattaattaagtttaaacccttttttttataaaaacttaccgggaggtgccccaaaacaattggtttggtttatggaatcgattttggctgggacgggttgaatacctttggttgtcccccagcgtggtggaaggaatatacgtcttggggccaagatacccaagggaagggtctcccaaacggtggcgcttcaggacagaagacccttttttgtcccccctctgggcccaaaaggtaatgcttgatttacacaaaagagacttctgggtaggaggggagggaagctggtcggttcgtggggattccatcacacagcgggtcaatggggcgcggcgccaaggctacgggcgtatagggaaaccgcgtttcgcatggtcagggaatggcactgcgggggacgaggccatcgcagggggcgagaaaccaactggaagtagggcca

SEQ ID NO: 494648 - DNA, 261 bp, Homo sapiens
  misc_feature (236)..(236): n is a, c, g, or t
ctcaggcacacctacaccccttatcatactagttattatcgaaaccatcagcctactcattcaacctatagccctgggcgtacgcctaaccgccaacattactgcagagccacctactcatgcacctaattggaagcaccaccctagtcaatatcaacgcattaaccgttccctgctacactatatcatcattcacaagttctaatttctatctgacatatcctagtaaatcgctngtcgcgcttaactccaatgcactac

SEQ ID NO: 494649 - DNA, 350 bp, Homo sapiens
  misc_feature (89)..(89): n is a, c, g, or t
  misc_feature (91)..(91): n is a, c, g, or t
  misc_feature (129)..(129): n is a, c, g, or t
  misc_feature (179)..(179): n is a, c, g, or t
  misc_feature (214)..(214): n is a, c, g, or t
  misc_feature (255)..(255): n is a, c, g, or t
  misc_feature (303)..(303): n is a, c, g, or t
aggaggggttcttcaacaaccccccaaaggacccctgatgcccaaccacaagtcgggtttgcccttaaaccccttaaaccgcaagctanantgctgtaccccatttacagacatggttgctgagtgccntgtgtcctgatttttgcatgctggtcatgacctgaaggaaatctattagncgtataatgtatgtctggtgtttttaacgtgatcntgatcagctctgaggtgcaacttcttcacatactgtacatncctgtgaccactcttgggagtgctgcagtctttaatcatgctgtttanactgttgtggcacaagttctcttgtccaaataaaatttattaataag

SEQ ID NO: 494650 - DNA, 131 bp, Homo sapiens
agtatcgagtgtctagtcatccttccccacttggaacataccatatgcatcttgcaggcctggcataagcatttcctctgtgaaacctcctttgctgccactcaaggagagtcatctaacttccactttcg

SEQ ID NO: 494651 - DNA, 134 bp, Homo sapiens
gcagacatagaggaagtgccttcggtaaagcaggtgaagttaagggcaaatcatatatttaattaaaactaaagcaaggcattttctttcacttctttaaaagggaaggattagccccccttgacaaaggaaaa

SEQ ID NO: 494652 - DNA, 118 bp, Homo sapiens
  misc_feature (1)..(1): n is a, c, g, or t
naaggcagatagaatcgagctggtaccgtgcatcactcttgtagtacacataggggtagtattcttgtggactcaggtttaaaccgggaatatccataggagcatcaataatagctgc

SEQ ID NO: 494653 - DNA, 210 bp, Homo sapiens
gaaaccctaataacggagatcgaaatttttatcctgacgctatagagatagtaccgtaagggaaagatgaaagaataaaataaaagtaaaaaaaagcaaagacttaccccattctaccatttggcataagtggtttaaccatgaaaaaatctaacaaatgagaactttagcttagataccccggaaacctagacgtagctaccctatgca

SEQ ID NO: 494654 - DNA, 216 bp, Homo sapiens
  misc_feature (41)..(41): n is a, c, g, or t
gattctgtggccttctaagatgaagccaccctcagtccagngaaggtgtgctggtattttctcatgacagccaagagcagattgtgaaatcgctcagctcccaggtgagagcaagcaaaaatcttggctgcgggaaaggaagcaaaagagaaaaattaaaagccagcccagaagtgtaccttgactttataaaaacctaagcgtcattggttccga

SEQ ID NO: 494655 - DNA, 486 bp, Homo sapiens
aacagatcgtgagtgaactgggggatggggccaccagggagtgggagtcagtgccaccagtggcagtggggataggggtgacagtgacacgcgaacacgagccatgtgctgggcgtggcgcatgtggggctccagacctcagggtgccatcagccagggccaccagacgagctcctgggaactcaggccagcaccaggcaggctcatcggcgggggctccaccagcacagcagagaacttggtgtcaccgaaggcctcgttcatgcgcgtctcgaagaagcgctgcaggccgatgatggactgcacgtctgccttgtcctcagttaacttgtagaattgcttgaacatgcggaccacatcctgggcaaactcctgtggggagctgtagggaggtgacaacttctcctggaggcggccacgatcaggtcagatccaggtgccaccgggctggtccaggagaaggcggagcggcagcagctgatgcag

SEQ ID NO: 494656 - DNA, 493 bp, Homo sapiens
aggtgttcctcagattgacattcacttttgacattgatgccaatggtatactcaatgtctctgtctgtggacaaagagtttcgggaaaagagaacaagattactatcattaagtgacacgggccgatttgagcataggaagacattgaacgtatggtccaggaagctgagaagtacaatgctgaaaatgagaagcagagggacaaggtgtcaattccaaaaattcacttgagtcctattcctttcaacatgaaacgcgactgttgaagatgagaaactttctacggcaagattaacgatgcggacaaactaaaaaatccatggacaagtgtaatgaaattatcaactggcttgataataatcagacatgctgagaaggaagactttagaacatctaaaagtaaagagctggagaagagtccgcaaccccattatcaccaagctgtaccagattgcaggaggcatgccaggaggaatgcccgggggtaggaggt

SEQ ID NO: 494657 - DNA, 520 bp, Homo sapiens
  misc_feature (376)..(376): n is a, c, g, or t
gatacacacgtatgtcacgagatgacgtcttctgtgctgggactggctcatggcgctctatgtgatatctcgactccttacaagtgactattcacatgaggaagcagataactgctcctgggattattcctggtcaggagatgggggtggtctacgaagcgtcgttgggcgcacgtgatccgtcccgcctcaagcctcccacaagtgctagggattatacggcatagagccactgcgatggaaacagaggctgctgcttaagttgcccaaagtcttgcagagtgggatgtgagcagaggcatttgactccagggcctaagtccttaacacagctctgcagcatttaccctgatactcaaccccttccttccccaancccccaccatcaggcattaagactactgcctaggggcagggccttggttggcagtgtgtgtcttatcccagccactgcagaggcaggaggatcgcatgagcctgagatgagaccagcctgggtagcatagcgagaacctttctc

SEQ ID NO: 494658 - DNA, 122 bp, Homo sapiens
taaacggagctggactacggcgagggtctgagccgggagcatgcagctcttgagcctcgccaccttgtgggctgtgccatcatcaccaagagctttgccaggatccacgagaccaacctaga

SEQ ID NO: 494659 - DNA, 459 bp, Homo sapiens
cccgggggagagggggtctcatctctcagactactatagaagccaaagtctctacaggggcctacaaggcccttcattatcggtctctctacttctcagacctcatctactaggttggtggaataatggaatgaattactccctaaaacaaaagaacccaagtctgactaatcgggagaactatcaaaaaaggaacattccaggggtacatctcaaagatttcggaatcaggctttcgggggggggagtagaaaattggtgtatgggcggggctggggggcttatgcctataatctcagcacttaaggaggcggaggcggacgcatcacatgagcccaggagcttgagaccagccggggcaacagggcaaaaggccatctccacaaaaaatacaaaaatgagcggggtaggggggtgcacgcccgcagtcccagctacccaggaggctgaggtgaaggg

SEQ ID NO: 494660 - DNA, 349 bp, Homo sapiens
  misc_feature (19)..(19): n is a, c, g, or t
  misc_feature (61)..(61): n is a, c, g, or t
  misc_feature (343)..(343): n is a, c, g, or t
tcacccacaaggacatgcnaggagaactgtcgggaccccaggaaagactcattcccaaaanaccccaggccgggcacagtccgtcaagcctgtaatccccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagaagnaaatct

SEQ ID NO: 494661 - DNA, 118 bp, Homo sapiens
tccacagatcatggcagatggtgtgtccaaacatacactgccacaggaaaattgaatgccgtgatgattccaaccaggcctacgggattccactgctcaatcagtgcatggccagaag

SEQ ID NO: 494662 - DNA, 205 bp, Homo sapiens
tctcccaagcagccgtataccacaggtgcgcaccaccacgcccggctaatttttgtatgcgcgatcgatatgggggcttggccatgctgcccacgctgttctcaatcccctgaccttaagtgatccacccacctccgcctcccaaagtgttgggattacaggcgtgagccaccgcacccataatttaaaattttttttttttttt

SEQ ID NO: 494663 - DNA, 262 bp, Homo sapiens
acaccctctctccccacatgacattttcattaatattgaaacaagcttgttgattcgtataattacaagacgttgtacaaaatattcacagcgacctgttgagtgtagccttaggcctggaactgcgtgacaccgtatgcctactccgcgatcagaggataggaagtcccaccccggccttccagcagtcacgcgagccatgtgtctggcattccctgattccgctgtctcccaaccctcactggtgggcggaaggcggggt

SEQ ID NO: 494664 - DNA, 392 bp, Homo sapiens
ctagaggcctccctgcccagccagtcctcggcctctgacagtcccacagaacagctccagagcaacgtgtgacagcgctggcctctccacatttcctgaggactcttcctggaaaccctgacccacccccacaggcggtaacactgaggaccttgcaaaacctcacactgtgttctggggtctcgcactgccccacactgtgactgagcagcctctgaggcgtttaaggaggaagtcacgtgtgtcataggggtcacatatgaaccagacacattccccaagccctggagtctgaaagggggtcactacatttcatagaccatcacctgatcctgatttcctgtgtctactgagaagccccatgcagggcagcagtgcctgggaatgatcct

SEQ ID NO: 494665 - DNA, 1164 bp, Homo sapiens
  misc_feature (1065)..(1065): n is a, c, g, or t
  misc_feature (1071)..(1071): n is a, c, g, or t
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttggaggttggcgtgcaatctttagaatatgccttatatgctgatatgaatatgccttaaaataaagtgttccccacccctgccaaaaaaaaaaaattctttntataanctaaaaaaaaaaaccttgaggggggcccggtacccaattggccttagtgaggccgatacattcactgcccgccttttcaacggcctgactgga

SEQ ID NO: 494666 - DNA, 420 bp, Homo sapiens
  misc_feature (39)..(39): n is a, c, g, or t
  misc_feature (65)..(65): n is a, c, g, or t
  misc_feature (184)..(184): n is a, c, g, or t
aaccagctactgaagagtcttgttgggggtaaagattcngttcaaactcttttgtaatcaagttngctatctcttaagagatccctcttctccaaagttggaggcatcatgctacttgacttcaaactatactacaaggctacagtaaccaaaacagcttggtactggtaccaaaacagacatntagaccaatggagcagaacagagacgtcagaaataacaccacacatctgcaaccatctgatctttgacaaacctgacaaaaacaagcaatggggaaaggatctcctattcagtaaatggtgctgggaaaacaggctagccacatgcagaaaatgaaactggaccccttccttacagcttatacaaaaattaactcaaggtggattaaagacttaaaagtaaaaccctgtctctact

SEQ ID NO: 494667 - DNA, 1074 bp, Homo sapiens
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttggaggttgcagtgagctgagatcgtgccattgtgatatgaatatgccttatatgctgatatgaatatgccttaaaataaagtgttccccacccctgccaaaaaaaaaaaa

SEQ ID NO: 494668 - DNA, 101 bp, Homo sapiens
ctctgcagtagggtgtgcagtgtggtgtgatgtgggtgtgtgcgcgtgcacacgggttttttagtgtctgtctgctgtgtcagtgtgtggtgtctgggttg

SEQ ID NO: 494669 - DNA, 931 bp, Homo sapiens
gggattataggcgtgagcaccggcggtgcttaaatctatttatctgacgtcccaactaggaaatttttgtccaaatgagtatatgtgatttaaagtagacactcgaggtaacaataggatttatctcagttccctatctcccttcaatctattcttcatatggtcaataattcttttttcttcgtggacgaggggtcctctggcgcaaaggttggaaggtgccggggtggcaactcttgggctccaggggacccttggcctcctggttggtccaggggggattcccctggcctaaaggcctcccgggaaggaacgctgggaggatagcgcagggggcaatcgccggcaaatacagcaccgccgggaaaacatcgccggcaatctcaccacacgacacgacgcacacaggttttgcggccccagggtgggggtccacaaaatcgtcccggacctaagggtggatcccaactgggctataaaggctctcccacaaaaggtgtgtcgggaccaaacagggggaggaaaacccgcgctggcacccgggcacacacaggggaatttcgtagcaaacatcgtgcgtccttcgccaagaaacagtgcggttgctgccgtcttggcaattaaaaagggaacccaaaacatttttgtggtgggggggcccacaacagggacaccgaggtgatggatgcaaaaggccttgtgggccacccaattaattcaccaagatccttcaagggcagaaacagtggggcgtggggggctaccttgggactcccacaggccagtggggaacttccctggattacgtgggcaggcaccgctgggactcaccattgtggcacccaaggctttggccaagtgaagggtggcgcttcagggcctaaagaaggcgtttcatcaactcataaaaaggggggcgcttaagatccgg

SEQ ID NO: 494670 - DNA, 1186 bp, Homo sapiens
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacctcggacctcaggcacatgcgaatgacccggagtgtggacaacgtccagttcctgccctttctcaccacggaagtcaacgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 494671 - DNA, 1139 bp, Homo sapiens
gcgagagggagggcaaaagaggaaggctgggtgattcctggtaatgtgttattttgagaaaaagcttcggcagcacactccagaaaaaaacttcccaaaccctgggcaactgaggttctgatgtggagctctggatggaaagcgtgctgaagtcttgttaaactagcaagcttttgtttggaggtccaccgccgaaggcgcacaggcctgtgggaacacgagcgttgagactgggggcgtctagatgatccaaggctcggacctcaggcacatgcgaatgacccggagtgtggacaacgtccagttcctgccctttctcaccacggaagtcaagctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 494672 - DNA, 453 bp, Homo sapiens
gaggacctatgtctcgacgtagattgatctctgcaatatatgtagctgactctggagcctctgcattttctttaaaacattttaactgattcattcgttccgcagcatgcctctggtgctctccaaatgggatgtcataaggcaagctcatttcctgacacgttcacatgcacacataaaagggttctcatcattttgggtactttggaaaaggaataatctcttggctttttaatttcactcttgatttcttcaacattatagctgtgaaatatccttcttcatgacctgtaataacctcataattacttgatctcttctttaggtagctataatatgggggaataacttcctgtagaaatatcacatctgggctgtacaaagctaagtaggaacacacccctcgagccctctctgacagattgtttagatctaatccatcaatattccagg

SEQ ID NO: 494673 - DNA, 1172 bp, Homo sapiens
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaaggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 494674 - DNA, 522 bp, Homo sapiens
  misc_feature (5)..(5): n is a, c, g, or t
ccgtnttccctcacgcgcagaatcctggatcatgacgtaggtgcctatggaattctgcgaggcaataaaaaacgacaccggagagacaaaccgaaggctgttctgaacaaatcacagagtggcacgttctagagggtcgattactggaatcatagtcaaacaagtgaggtccaaagcagagctcaggagcagtcataaagttacggccacacagcccgcgtgaacgagagttgggtctggaacaccgcttgcgagcatctccctgtgagaaaaaacccaacccccccatccctcacaggaggagaaaactttcgggggagaaaggggggagcgcagcagacagagaacacaagaacccggagcgcacgctggtttcaagccagaggaacactgttgtgaacaaaaccgaccccagcagaccacccaggggaccgacgacacaaaccgcgggacaggggcggcaacaaaccgcaccacccagagccagaaaaccccgcggcgagcgacaagggcggccaacgc

SEQ ID NO: 494675 - DNA, 512 bp, Homo sapiens
gttgtagctcgttctatagcatagccaaagcatgactaagcaaaaagaacaaatctggaggtatcacattatctgcttcaaactatcctacaaggccatagtcaccaaaatagcatggtactggtataaaaataggcaaatagaccaatggaacagaatagagaacccagaaataaacccaaatacctgcagccaagtgatctttgacaaagaaaacaaaaacatggagtggggaaagaacaccctatttaacaaatcgtgctaggataattggcaagccacatgtggtagaatgaacctggatcctcaccttttgcattatacaaaaatcaactcaagatggatcaagatttaaatctaagacctgaaaccataaaagagcccaaatagccaaagcagtactaagcaaaaagaacaaatctgggggcatcacattattcaacttcaaaatatactacaatggtatagttacccaaatagcctggggccaagtttaacacttacaacggggc

SEQ ID NO: 494676 - DNA, 970 bp, Homo sapiens
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctgctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 494677 - DNA, 466 bp, Homo sapiens
gaattaggaaaaagagctctactggggagttagatcacctgggtttaaaagtcgatgccaaaatttactaactatatgaccttgggaaaattaatattatatattaatatatattatatcatataatatatattaatatatattaatataatatatcacataatatatataaatatatagcctcaggcttctcatatatcaaatggtaataaaaacagaacatagggatttttggattattaacgagacaatccatggaagcacttcacataaatgcctgtcacataatattcactttataaactatagctcttattgttccttaggattacagtgatatattaataacaatagctaatgagtttggcactgttttaagctcttcccaaatattaaataatttaatccccaaacaatcttctgaggcagtgatcttaacataataaactgtattctcaaatcagaa

SEQ ID NO: 494678 - DNA, 1766 bp, Homo sapiens
  misc_feature (571)..(571): n is a, c, g, or t
  misc_feature (582)..(582): n is a, c, g, or t
  misc_feature (617)..(617): n is a, c, g, or t
  misc_feature (622)..(622): n is a, c, g, or t
  misc_feature (1420)..(1420): n is a, c, g, or t
  misc_feature (1424)..(1424): n is a, c, g, or t
  misc_feature (1426)..(1426): n is a, c, g, or t
  misc_feature (1429)..(1429): n is a, c, g, or t
  misc_feature (1432)..(1432): n is a, c, g, or t
  misc_feature (1434)..(1434): n is a, c, g, or t
  misc_feature (1441)..(1441): n is a, c, g, or t
  misc_feature (1454)..(1454): n is a, c, g, or t
  misc_feature (1465)..(1466): n is a, c, g, or t
  misc_feature (1471)..(1471): n is a, c, g, or t
  misc_feature (1487)..(1487): n is a, c, g, or t
  misc_feature (1490)..(1490): n is a, c, g, or t
  misc_feature (1503)..(1503): n is a, c, g, or t
  misc_feature (1523)..(1523): n is a, c, g, or t
  misc_feature (1533)..(1533): n is a, c, g, or t
  misc_feature (1535)..(1535): n is a, c, g, or t
  misc_feature (1548)..(1548): n is a, c, g, or t
  misc_feature (1553)..(1553): n is a, c, g, or t
  misc_feature (1559)..(1559): n is a, c, g, or t
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaagtgaggggccgacggctgcggtagtgggaaaggctaccagagggaggtgggggcggggcaggaggagcaagagtgaaagaggtttggccgggacgcggtggctcacgcctgtaatccctgcactttgggaggccgagacgggcggatcacgaggtcaggagatccagaccatcctggctaacacggtgaaaccccgtctctactaaaaatacaaaaaattagccgggcgtggtgccgggcgcctgtagtcccagctactcgggaggctgaggcaggagaatggcgtgaacccaggaggcggagcttgcagtgagccgagatcgtgccancgtactccagnctgggcgaatgagcgagactacgtctcacataaanataangtgtgcaaagacccttggggtcctcctctcacattgaacccttttgagccatgtccatccccttccaccctgcagcaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagattttttantttngnagntgngngtgcacnctttagaaatatncttaaaaggcnngcgcngtggtcacgcctggtnatncccagcactttgngagggccagtgtggcggatngctgaagtcngnagtcaagaacaantgatnacatgntgaacccattttttctataaatccaaatttccagatgatagccatgccgttatcccataattgggagcggcggcaggaatgcgtgtacccagacgtgagctatctcaggctcagagcccaggatataatagaccatcaagataatatacaaaaaaggtgcccctgtagaaaaacacacacacaaggggcacatctagtgccaaatcg

SEQ ID NO: 494679 - DNA, 145 bp, Homo sapiens
caataaccgcgcgacgagcaggcccggcacgggactctcgagatagtgctgcgcgatgaacgcctccagcacctgcacctcgatcggcgcgtcgggcgcctcgccttccgtgtcctccccctcctccgcgcgttattgcctaatg

SEQ ID NO: 494680 - DNA, 447 bp, Homo sapiens
  misc_feature (1)..(1): n is a, c, g, or t
  misc_feature (6)..(6): n is a, c, g, or t
  misc_feature (28)..(28): n is a, c, g, or t
  misc_feature (48)..(48): n is a, c, g, or t
  misc_feature (68)..(68): n is a, c, g, or t
  misc_feature (81)..(81): n is a, c, g, or t
  misc_feature (189)..(189): n is a, c, g, or t
  misc_feature (238)..(238): n is a, c, g, or t
  misc_feature (259)..(259): n is a, c, g, or t
  misc_feature (320)..(320): n is a, c, g, or t
  misc_feature (330)..(331): n is a, c, g, or t
  misc_feature (345)..(345): n is a, c, g, or t
  misc_feature (367)..(367): n is a, c, g, or t
  misc_feature (426)..(426): n is a, c, g, or t
ncgaantcgccgtgaaaacgccccccanttgacccaatttagcagggncaaaatttccctgccaccanaatctctgagccnccaaagtagtaatggaaattgttttaagtgacgcccgtgactgatgtatggggatagttgaactgaacattccggagcaatggagtggagaccctggttgtagaattncttaagctgggaagacgtgccctggttcccataaatcctttgtgcaatnccatggttttcattggacagnctcttcaaaaaatcatagtccacatcaaatcccatgcccaaactgaacaaggagatattgncttggatgtnnccttaacgttttcntgaatttttgacagttttagtngcccacttgttggatctccatcagaaaccaaaatgatcagcgagacggagttggggctnacagcccaagtattgcttatt

SEQ ID NO: 494681 - DNA, 233 bp, Homo sapiens
  misc_feature (36)..(36): n is a, c, g, or t
aaaaactttcaggctgggtatatcattgtataaaanctttcaggccaggggtttacgcctgtaatcccagcactttgggaggccgagatgggtggatcacctgaagtcaggagtttgagaccagcctggagcctggccaacatgaaccccgtctctactaaaagtaaaaaattagggcatggtggtgcatgcctgtaatcctagctactcaggaggctgagacagaagaatcg

SEQ ID NO: 494682 - DNA, 333 bp, Homo sapiens
aataatgagccactgtgcctggccagttttcatctttagcatctcctattatacatatgttgcgtcttcttttcctgtcttatgtgctactctttcttgagcttttttcatctctttcatttcttttttattcttgaaaattttgtcattttgtttttcttaaggcaccattgtgtttatttgttctaaggttcttctagtttaatcttcgtttctgaagttactttttcttttgtttctaatatattctgagagaagcacattgtttctgagtttttctaatgctggtttctggttaatgtgtgttatgtgtttaatgtatttcagtttgtt

SEQ ID NO: 494683 - DNA, 457 bp, Homo sapiens
gccacgtcgtacggagagtgcgggtcacagaagtagtgaagaagtattctcagttacagtatgcgctaatcccatcacgcctttatatggagaaggaacgagagaaggaaagttatgtgatgatgaggcagaggaagagaaaggtgagaaagaagaggtaagatgaacgatgatgaagaaatagcctaagtatcgtagatgtgggttcaggatgaggaggatgatcagcggtatggataagaaggatgaaaacgtaagaagtatcgagagagaaattacattgattcatggaaggaacgtaaacgaagatcaaggcgtatctggatccagaaactcctgcatgacatcagcctcaagaggagtatggagaatgtctacagagatgcctcactaattgactgggaagagcacttggccagtcaagcacgttgtctgtggaaggtctgttggcaagtca

SEQ ID NO: 494684 - DNA, 332 bp, Homo sapiens
ggtcgactgctgctgatgatgatctagggactgcaattttagaattgctgagctagagtgatggatttactttcagttttgagatattcatgtctactggtaatgtctagctcaccaccaattttgtagcttctagtgctgtttcttcttttctctctgcttctttttttcttttctcttctaaactctcaattctactacgcttaatgaaaaacaaagcaaaaaacacttacatgaatctccccagccaaaaggaatgaacttttacatccttattcactgaggagtcctacctgttgagtattatatcggcttttctcatctatgttaca

SEQ ID NO: 494685 - DNA, 84 bp, Homo sapiens
attgtgaggttatgggggatgctcgctccaaccgactgctgtcagcttcaccgttccagtatgtaaatcctgagtcaagccaac

SEQ ID NO: 494686 - DNA, 350 bp, Homo sapiens
acataaagtccttttaaggagataatctaaaatgaaaagtggatccccagcccatttatcagtggtcagttaatgcctaagagtgagagtagttctattcacattcctcaagatatttaatatcggctgcgttatgtcttatgtctgcttcaatcatttattggcggcaaaggattatatagtctatgaggtgccttgctgtgtaggaggatgaaaggggagttgatagtctcatgggactaatttggcttcaagtttcatgaatctgtaactagaatttaattttcaccccaataatgttatatatagcctttgataaagagcaaataataaattaaacctattctttc

SEQ ID NO: 494687 - DNA, 381 bp, Homo sapiens
ctgaacaccttccacaacatcgccctggtgacagtgatgagcaccgggagtctgcaatggcgccacctgcatctctgacacactggaggatcctcctgtcggggctacctgctttgcatctgcatgacttcctctgccagctctcatgatactcgcgatcctcaggacgcaggtcacattcacctgtgggcagagggacaggtcagacacccaggcccacccagacgaccatccatgaactgtgctccccagctctcccgccggtctccgactagggcatggctgaagccttgccttccttgcaggggggccagccattgtctcccacctggggagtttcttcctggcatcatgccttctgaataaatgccgattttatcc

SEQ ID NO: 494688 - DNA, 440 bp, Homo sapiens
agcgggttatcagaagaggccgttgagcgcggcgcgtgaccaggctgtgcagcggttctcccacccagcaaccgtgcccgccgcagaccgctcccagccgcggagccgagcacagcgtcgtggcaggcgtccaccgcctcggcgtggccgcctcctctctctgcctcactgtgtggccctcacctcatgccgtaggctcagagccagacccaggccaggctcaggcccatccccggcacggcagcgagccaaagtgaacaccggcaacgcgagtggaactcgaccagaagcaaagggaccgaagacagaagggaaacagaggaatgagagcgacgccgacggagagataaaaaggaacgaggacagataagaaaaacaaagttatagaaaccgttatgggaaaagaaaaagaaaaggaaaagaacacaagagaaaaagac

SEQ ID NO: 494689 - DNA, 400 bp, Homo sapiens
  misc_feature (344)..(344): n is a, c, g, or t
  misc_feature (375)..(375): n is a, c, g, or t
tcttaatttaaaaaatgtggttataggtatattttacagagcactaattacaaaatgagagacataataattgttaaaaccttgcttagaaggttccccttttatttgggggcatattggcagaatgtgtaaagggagaaaggtacagcctaagggaagaacatgtttgggttgcatgggactttattttctggtccactttcattttttccagtccctcctgtgtttgcctctgccgctagtgtaaactgggatttcagtcttacagtagtctgtctacccagtggcattgtgcttgtttgaattcagttcagagtaggaggttggggtttggaactaggaantcaggaggaccccagacccccagctctggcntcgggacttggcttttgtggactct

SEQ ID NO: 494690 - DNA, 239 bp, Homo sapiens
gtccacccctggagccccaaaatgtttagcccttctttaacttttttttcctaaaacacattgctactcttcctttcccatgttcgtttctggagcagctttactccaagaggaaggaatcagtaatcaacacaagtaataggtctgagtagcagatttcaaataccacaacaagggcaggcaaatagaaatatgctgagcaggtcaggcgcagtggctcatgcctataatcccagcac

SEQ ID NO: 494691 - DNA, 1064 bp, Homo sapiens
  misc_feature (135)..(135): n is a, c, g, or t
  misc_feature (406)..(406): n is a, c, g, or t
gctcctttcgtcgcctgatcgccgtccatcatgggtcgcatgctatgttcccgggcagaggtgcctgtcccagcttcggactggtacccatactcgactgcaagccgctccccacattgggattgaacgttgacnatcctgatcgagggtgaaggagcagtactttatcataacttggtcctacgtaagggcctttactctcggtcacagaactcggctgttacattccgtgatgagtagttctacactggatggttgcaccaaaagctcaccgctctattgttagtaccaagtgcaaactcataaagactctttgagagcaaattcccctcttaagttgcatgacacgggagcctatggcgtactctgtaatgcgtctcctcggacatgcattctgcatacccanttttagtctcataaggacacacgaccatgtcttgtcatcgctatccagaagagacgacaattctttagaagaacggaaatcaatgacacacggatcaaaggtattgctatacagttacaccgtcctcgagttcttaattcagatgaagccggattgcacccgtgtccggctcgactattactgaatgaaccaatgcgaggtcgcgtcccttcccatacttggagacctatggaagtcatgctaacagcctctgacctgtgtcgcataaaattttgtccgtgtacctccatgcattaaaaatgatttgttttactcatgacataatccctagaaaatcgcatgacgaccataagttcgggggcgcaccgctggccccaggaaaaaagctatggcaacaccttgcggggggacgcgggcaccgaaaggcaaggaacaagggcaaacagggtgtccaggagggaccccgtgcaaaacatgggatggccattccgcaaaaaacccggaggtccacggcgctgaaacaccaggaggcgcggaagggtattacggccatcgcgaccacgcgcgcagcagatcgatgtacaaccgcaaccagctgcgcacccagagacggcggacacggacatcaccacgacgcaacacggcacagagcgagcat

SEQ ID NO: 494692 - DNA, 711 bp, Homo sapiens
  misc_feature (8)..(8): n is a, c, g, or t
  misc_feature (103)..(104): n is a, c, g, or t
  misc_feature (121)..(121): n is a, c, g, or t
  misc_feature (123)..(123): n is a, c, g, or t
  misc_feature (159)..(159): n is a, c, g, or t
  misc_feature (169)..(169): n is a, c, g, or t
  misc_feature (176)..(176): n is a, c, g, or t
  misc_feature (233)..(233): n is a, c, g, or t
  misc_feature (266)..(266): n is a, c, g, or t
  misc_feature (275)..(276): n is a, c, g, or t
  misc_feature (354)..(354): n is a, c, g, or t
  misc_feature (400)..(400): n is a, c, g, or t
  misc_feature (420)..(420): n is a, c, g, or t
  misc_feature (487)..(487): n is a, c, g, or t
  misc_feature (562)..(562): n is a, c, g, or t
  misc_feature (620)..(620): n is a, c, g, or t
  misc_feature (646)..(646): n is a, c, g, or t
  misc_feature (700)..(700): n is a, c, g, or t
tttttttngcccagagaggggccgggacttccctcagaatcacacagaagcggggttgtggggaacccacttgcccccacaccagggtgctctctgctcctanngggaggtggggtggttncntccttgttcagggtgaccatgggaagcccatttggngttagatgcnccgagangccaccgggaagaccatgggggcctgttccgttccctgctccccatacaggcgaggntgcgtgctcacagcttcctgttccccaggttgncctgcttgnnacgcacccggtggctgctccatccacacgcaagattgctacttcagatgctccgcacgctggagatgctggtcaggtnctcccgcatccgaaagctgagcgagcgggagctgcgatatctgtgncttggtctcagagagctgtnggtggtgtgaagctccggagtgagcctcgacggcccgggccaggcagtgcccgggccctcgcatgcncagccggagacacccgcagcagaggaagctgagcacggctctgcacacctccctgctgcggaaggagtggatganggggttgaccgccgagttgaggacggccagggccaggatccagtgcatgccccgcagntactcctgggcccagaggttggagcnaaagacgtgggccagcagcagcccgaagagtgggccccagcacaccagggaggncagccggatca

SEQ ID NO: 494693 - DNA, 428 bp, Homo sapiens
tgattagtcaataggctggttgcagaaatttaggaatagacatggcattaaatttttaaagatttgtggtgataaaacttctgctgatcgtgaagcagcggagcaattcattgatgagtttgccagcatcagctggatgcagtggcgcatgcctgtaatcccacctctttgggagggtgaggcgggaggattgcttgagcccaggagtttgagaccagcctgggcaaaatagggtgacccaattgctacaaatctttttaaaaaaaattagctgggtggtggttcatgcctgtagtcctagatactccagaagctgaggctgaaggaccacttgagcccaggaatttgaggctacggtgggctctgatcatgccactgcactgcactcctacctggatgacagagtgagaccctgtctcttaaaaaat

SEQ ID NO: 494694 - DNA, 452 bp, Homo sapiens
  misc_feature (38)..(38): n is a, c, g, or t
  misc_feature (423)..(423): n is a, c, g, or t
cctgtctccgttctctgcagatcttgggatctggtgcnatctgagagccatcccatgcctggtgtggttcatctttactgcttgagcagcccatctccaggcagttctatccttgggtctcattgtcagaattacttctcactctggccctcccgcatgtcccgctttcctgctgtaattctcttcctagcacttatttctaacatactatgtattttacttactcatttggtttgctttcttcttcattagaatataaactctacaaagacagctatttttatggttttctttgtgtggtttttttgtttgtttttttaccaataccattttctttgctttttgtggtggttggtttgttttctcattaaactttatcagctcttcttccgactccagccctgctcttgtattttagcctgnctcttgccttgggaacaggcttctgctgt

SEQ ID NO: 494695 - DNA, 311 bp, Homo sapiens
taatagcggtccatatcaatgcagtaggaaacactagatcaataagacatagagagcagggacgcacagagtataggggggctacagccatactacaacagccccatacagttccctaagtgtatcccctacaacataccccatacagtgatatctagaagcctctgctatagtactccaagagataagggaactcactagcttctctatctctggccagctagtgatgctagaattctagtatcatagtagctagatatctacagctcacggctcatacaaaatataggagctatttgattcatagtatc

SEQ ID NO: 494696 - DNA, 557 bp, Homo sapiens
  misc_feature (111)..(112): n is a, c, g, or t
  misc_feature (127)..(128): n is a, c, g, or t
agcggaggagatccaaagtttggtgtctctctctctctgtctctttctttctctttctccccccaaaccactctcactccctccctccctctctccttcccctatttgcannatcatatttcctccnnctctgcttcttttctcttctgccctccttgtgggcagtcatgaaaatcattcagactgtgttgattagcagatttattattctattgagaaaaaagccacctgggaaatgttgttgtgagattatttttatatgaaggaataagctgaactcaagcagatggtaagaatagtacaaacacccttaaggcaccaatctcactggacaccacagtattctgaaaggcgatttgacacttaattcccattttcttaaaataacagttttggtgacttaaaacatatttgaggagtatcactatggatgtgtggaaaaaaatgtttgccagtactcaggcaaaaaatagggtacattaagcagggtggctgtgcattcactgggaatttcctggggggggtgagaaagcgaatttctaactcgcaagagtgac

SEQ ID NO: 494697 - DNA, 212 bp, Homo sapiens
  misc_feature (1)..(1): n is a, c, g, or t
nctgtgtgtgtgtgttagggatatgtatttggggtgtgtgtttgggatgtgtacatatatagacacgtgcttaatgatgaggacaaatttggagaaatctaccattaggcaattttgtctttgtgtgaacatcatagattgtactcacacaaacctaggttgtatagcctacaatgcacctaggctctgtggtacagcctgtggctcctaag

SEQ ID NO: 494698 - DNA, 964 bp, Homo sapiens
ctgcccgcaacatactcgtcacagcaacctggtctgcaaggtgtctgactttggcctgtcccgcgtgctggaggacgaccccgaggccacgctacaccaccagtggcggcaatgatccccatccgctgagaccgtccccggaggccatttcctaccggaagttcacctctgccagcgacgtgtggagctttggcattgtcatgtggcgaggtgatgacctatggctgagcggtcctactgggagttgtccaaccacgatggtgatgaaagccatcaatgatggctttccggctccccattacccatgggatctgccctctccgatcatctaccagactcatggatgccatgtgctggtcatcaatggagcgtgctccgccccgcactccaaggttcgtctgaccatcgtctagcatcctggtacaagctcattcgtgtccctgtactccctcaggaccctggctgacttttgacccccgtcgtgtcgtatcctggctccccagacgcgagacggctcgtgacggggtgctcccttccgcgcggtgtccgagtggctggagtccatcaaggatgcggctcgtctccggagccgttcatggcggcccggcgtacacctgtcgcatcgtcataacgtggtgcagatgaccaacgcacgcctctcgacgagcgatcgcgcgtgcggctgcccggctaccagaagcgcactcgactacacgcctgctgggacatcgggaccacgtgagccttggtgggtgatccccattctgagcctacaacagcggcctggagccccctatcgggccctacgaatgcgttgccagcatcacgtattgcgcctctccgctctgctcccatgcttgggccacctgggggacgttaatctccattctcgctcctttccttccgcctgacacgtccgcttcgacggctctcagatgcacccctggccccacctgagagatac

SEQ ID NO: 494699 - DNA, 1398 bp, Homo sapiens
ctggtgaggggcccgcttgcctcggctacctgcgtgcaccaagccagaccgctgcccggcgccctctgtcctgacttcaggggctgccctgctcccagtgtcttcctgatggtgtggaagacgcacatggccatcccgccccttcacccgagggatgatgccacaccaatgctgtggcaccctggactctgtgggctgcactctgtgcccatgtggacactgctgggtaggcccagtcccccctcaccatggggcatgtgcacagcagcgatgggatcctgacttgaattttcccaacttgtaccccactccttgctgcagatggggcatgtgcccatagcactggtcctagcttccacacgtggtcggctgacgacggacgggagcccgtatgtcatcccttggaccctcaacggcctcccatcagttgactacgaagactcctagtagccccttaattacagtgaaaaagccatctagtgtacacctgtgattgcctaccgagtacccaattatccacttgaaccacttggcgagggctatggcgcttgagacgagttcggacattatgggcaagcagagtagcgtagataacccctacacctggctggtaccccctctctagaaccccaaaacacacccaaagcaaccactgggagcctccaggtggacacccacatggcatatggcaaacctatgcatggttatagagccacataacttgtgccctacggaccttgcgccatgaaggagtccaccgcatagatttgcttttgcctcgccgtagtgatgcaccattcttgcccaagagaactggggggcctaggccaagggattgagcgcgggcaccaagaacaaaggcaacagggatgggcatggctagggcggccaaacatcaagaggtgcccaccaccaaatccagagacacaatacaagagcgacaccccagacgcaataggagtggcacagagacccacaagccagacgacccgtggaacagtacacgcccaccatagcccagcacgtagtgaccaccgcggtgtggcacaagatgagcagcgccatagtagtagaacagaaagaccagatccacccccccgagaagaggagaatggagacaaacttccccctcaaccgtataacaaaactacgagagagcaacagcatagtacagacaacgaagacatgcaaacaccagagtaagcgacgagaaagaaacaaaaacaaaggcagcggagtcagaaaaaggagcctgcacatcgactcaggaaccaccgagcgaccagctagacaagcagcaacaccagaaaaggactggcccacgcagtacaaaagcagagctcagtatagaaaaccaagcacgaatatcatcagcctaccccagaacgaagccacaca

SEQ ID NO: 494700 - DNA, 428 bp, Homo sapiens
gtctacatcgtgcatttcacgcaggccgccgccctcgaacgcgcccaggcactgacgagcgtcaatttctgttccaaagaagagtaggaagcgatcgccgaggcgctgggtggtttccgcttcaccaccgggttcggaaaaacactctcccgcctggttcggcacggcatcggcgttcaccatgcgggcatgctgcccaagtaccgacggctcatcgaagttctcgcacaggacgggcttctcaaggtgatttgcggtaccgacaccctcggcgtcggcatcaacgtcccgatccgcacggtgctgctcacgggtctggccaagtacgacggtgtccgtactcgacatctgaaagcccgcgagttccatcagatcgccggtcgcgcgggtcgtgcaggctacgacacgatgggcaccgtcgtcgtaca

SEQ ID NO: 494701 - DNA, 1390 bp, Homo sapiens
ggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagca

SEQ ID NO: 494702 - DNA, 1096 bp, Homo sapiens
  misc_feature (823)..(823): n is a, c, g, or t
  misc_feature (827)..(827): n is a, c, g, or t
  misc_feature (864)..(864): n is a, c, g, or t
  misc_feature (899)..(899): n is a, c, g, or t
  misc_feature (901)..(901): n is a, c, g, or t
  misc_feature (905)..(905): n is a, c, g, or t
  misc_feature (919)..(919): n is a, c, g, or t
  misc_feature (923)..(923): n is a, c, g, or t
  misc_feature (926)..(926): n is a, c, g, or t
  misc_feature (930)..(930): n is a, c, g, or t
  misc_feature (936)..(936): n is a, c, g, or t
gcggccgcctactactactaaattcgcggccgcgtcgactggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtacccgcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaanaaanaaaaaaaagaggccgggtgtggtggcttatgcctatnatcctagcactttgggaggtcggggtggacggatnangagntcaggagttggagnccanccnggcnaacatngtgaaaccccgtctctagtaaaaatacaaaatttagtcagacatggtgggcaggagagagcatgtgcaggggaacatccatttataaaaccatcagacctcatgagacttattcactaccatgagaacagcatgggggaaactggctccatgattcagtt

SEQ ID NO: 494703 - DNA, 509 bp, Homo sapiens
gcggccgcctactactactaaattcgcggccgcgtcgagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagca

SEQ ID NO: 494704 - DNA, 540 bp, Homo sapiens
  misc_feature (333)..(333): n is a, c, g, or t
  misc_feature (356)..(356): n is a, c, g, or t
  misc_feature (360)..(360): n is a, c, g, or t
aagtctggtaggtcacacagaggaccaagcccagcagtactatgtgtgtagtgctgcagcagggcctgaggagaaggtgctgctgggcagctgtggcctctcttcagccagacccccagagcattgtagtcagcagtaacacatcaaaacaggtatctagccttcctgggcctctgtagtgaatgtacaaattctaatgtgattttcaaaattagtctagcccgcaagtacaaaaccatgcttagaagaaagaacaaagggaccgggcacagtggctcacgcctgtaatcccagcactttgggaggccgaggtgggcggatcacctgaggtcngagttccagaccagcctggccancatngtgaaaccccgcctctactaaaaatacaaaaattgcccaggcatggtgatgcgcacccataatccagctacttgggaggctgaggcaggagagttgcctgaacctaggaggcggaggttgcagtgagccaagattgcgccactgcactccagcctgggcaacagagtgagactctgcttc

SEQ ID NO: 494705 - DNA, 3638 bp, Homo sapiens
  misc_feature (3365)..(3365): n is a, c, g, or t
  misc_feature (3369)..(3369): n is a, c, g, or t
  misc_feature (3406)..(3406): n is a, c, g, or t
  misc_feature (3441)..(3441): n is a, c, g, or t
  misc_feature (3443)..(3443): n is a, c, g, or t
  misc_feature (3447)..(3447): n is a, c, g, or t
  misc_feature (3461)..(3461): n is a, c, g, or t
  misc_feature (3465)..(3465): n is a, c, g, or t
  misc_feature (3468)..(3468): n is a, c, g, or t
  misc_feature (3472)..(3472): n is a, c, g, or t
  misc_feature (3478)..(3478): n is a, c, g, or t
ggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcgctggaatgccgcctctttttccaggtgcaggtcttcagccgtgacccggtaccccagctctaagggaggtggcagcatcaaaggctcccctcgcctgcgtggcagcaggggaatcttgcgtctacggggcctagaggcctgggatctgggggagccacccctgggggcgagtgtctgccctggtgctgtatctgccgccttttcacaccgggtgtgacccgaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtctggttatatctgatttctgagctctgggcatggaggtctgtctgcagaggcccgggcctgggcacaaagggagagaggcctccattgtcccgcaggggccaaaatgcagaccgtgcatccccggtgacctcggggaccgttctctgatcatcaggattttcttggactctggggtccttgtcctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtacccgcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaanaaanaaaaaaaagaggccgggtgtggtggcttatgcctatnatcctagcactttgggaggtcggggtggacggatnangagntcaggagttggagnccanccnggcnaacatngtgaaaccccgtctctagtaaaaatacaaaatttagtcagacatggtgggcaggagagagcatgtgcaggggaacatccatttataaaaccatcagacctcatgagacttattcactaccatgagaacagcatgggggaaactggctccatgattcagtt

SEQ ID NO: 494706 - DNA, 422 bp, Homo sapiens
  misc_feature (333)..(333): n is a, c, g, or t
  misc_feature (356)..(356): n is a, c, g, or t
  misc_feature (360)..(360): n is a, c, g, or t
aagtctggtaggtcacacagaggaccaagcccagcagtactatgtgtgtagtgctgcagcagggcctgaggagaaggtgctgctgggcagctgtggcctctcttcagccagacccccagagcattgtagtcagcagtaacacatcaaaacaggtatctagccttcctgggcctctgtagtgaatgtacaaattctaatgtgattttcaaaattagtctagcccgcaagtacaaaaccatgcttagaagaaagaacaaagggaccgggcacagtggctcacgcctgtaatcccagcactttgggaggccgaggtgggcggatcacctgaggtcngagttccagaccagcctggccancatngtgaaaccccaactgctgccactcaccagaacaatgggagtagggtcagaaaatgtcagata

SEQ ID NO: 494707 - DNA, 3512 bp, Homo sapiens
  misc_feature (3239)..(3239): n is a, c, g, or t
  misc_feature (3243)..(3243): n is a, c, g, or t
  misc_feature (3280)..(3280): n is a, c, g, or t
  misc_feature (3315)..(3315): n is a, c, g, or t
  misc_feature (3317)..(3317): n is a, c, g, or t
  misc_feature (3321)..(3321): n is a, c, g, or t
  misc_feature (3335)..(3335): n is a, c, g, or t
  misc_feature (3339)..(3339): n is a, c, g, or t
  misc_feature (3342)..(3342): n is a, c, g, or t
  misc_feature (3346)..(3346): n is a, c, g, or t
  misc_feature (3352)..(3352): n is a, c, g, or t
ggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcggggcctagaggcctgggatctgggggagccacccctgggggcgagtgtctgccctggtgctgtatctgccgccttttcacaccgggtgtgacccgaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtctggttatatctgatttctgagctctgggcatggaggtctgtctgcagaggcccgggcctgggcacaaagggagagaggcctccattgtcccgcaggggccaaaatgcagaccgtgcatccccggtgacctcggggaccgttctctgatcatcaggattttcttggactctggggtccttgtcctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtacccgcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaanaaanaaaaaaaagaggccgggtgtggtggcttatgcctatnatcctagcactttgggaggtcggggtggacggatnangagntcaggagttggagnccanccnggcnaacatngtgaaaccccgtctctagtaaaaatacaaaatttagtcagacatggtgggcaggagagagcatgtgcaggggaacatccatttataaaaccatcagacctcatgagacttattcactaccatgagaacagcatgggggaaactggctccatgattcagtt

SEQ ID NO: 494708 - DNA, 112 bp, Homo sapiens
ttaaacgagtggccagtgttaaacgatggccagtgtaaaacgagcggccagtgttaacacgacggccagtgtacacctgcagtggcactgtaaaccgacgtcctgtgttcaa

SEQ ID NO: 494709 - DNA, 3238 bp, Homo sapiens
  misc_feature (39)..(39): n is a, c, g, or t
  misc_feature (69)..(69): n is a, c, g, or t
  misc_feature (123)..(123): n is a, c, g, or t
  misc_feature (2965)..(2965): n is a, c, g, or t
  misc_feature (2969)..(2969): n is a, c, g, or t
  misc_feature (3006)..(3006): n is a, c, g, or t
  misc_feature (3041)..(3041): n is a, c, g, or t
  misc_feature (3043)..(3043): n is a, c, g, or t
  misc_feature (3047)..(3047): n is a, c, g, or t
  misc_feature (3061)..(3061): n is a, c, g, or t
  misc_feature (3065)..(3065): n is a, c, g, or t
  misc_feature (3068)..(3068): n is a, c, g, or t
  misc_feature (3072)..(3072): n is a, c, g, or t
  misc_feature (3078)..(3078): n is a, c, g, or t
aagtttaaaacccctggtggttccccctttgtccccccnttaattaccaggggaactcctgaacatgtncccccatagcctagggtgaacaagtaggatcctaccccgaaaagtagggtggcnagtaggatcctaccccaaaaaccgtccctgcctgataacaggacccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcgctggaatgccgcctctttttccaggtgcaggtcttcagccgtgacccggtaccccagctctaagggaggtggcagcatcaaaggctcccctcgcctgcgtggcagcaggggaatcttgcgtctacggggcctagaggcctgggatctgggggagccacccctgggggcgagtgtctgccctggtgctgtatctgccgccttttcacaccgggtgtgacccgaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtctggttatatctgatttctgagctctgggcatggaggtctgtctgcagaggcccgggcctgggcacaaagggagagaggcctccattgtcccgcaggggccaaaatgcagaccgtgcatccccggtgacctcggggaccgttctctgatcatcaggattttcttggactctggggtccttgtcctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtacccgcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaanaaanaaaaaaaagaggccgggtgtggtggcttatgcctatnatcctagcactttgggaggtcggggtggacggatnangagntcaggagttggagnccanccnggcnaacatngtgaaaccccgtctctagtaaaaatacaaaatttagtcagacatggtgggcaggagagagcatgtgcaggggaacatccatttataaaaccatcagacctcatgagacttattcactaccatgagaacagcatgggggaaactggctccatgattcagtt

SEQ ID NO: 494710 - DNA, 400 bp, Homo sapiens
tggcccgggttactgcacgacttctattatcatacattagatttgctgttctgactttcatatacatagaacggacatagtatctgcatcttttatatctggcttgtatcactcaaaataatggccacttgcagaaagacactacagtcattacccccgaagatgccttcatgcctattcccactctacatcctcctcccagaaataaccactattctgacttctattatcatatattactttggcctgtacatgaatattcatctaaatccaatgagaccagtatctgcttaaacatatctagcgtactttcactcaaaataacagacaaacactttaaaaacacaagacagacatgtgtcacctaaagacgtaacagtcaccgatggaccgcatatgc

SEQ ID NO: 494711 - DNA, 866 bp, Homo sapiens
gggactagccgggttgtattggaaacgcggagtgagtgccgtgctgtgtaggggctaacaagttggacacccagaaggaggtgcaagctccaaagcagcaacaatgatatatatcttgtggagagtgtcacacagaagacatgatactaacaactctagggatccaatcagattgcatgcaagatgtgtggctacagaatacttgtcacaagaaccaaggacctacaaaagatgtggtcgttatgatgctcgatgattgctgggaatcccagcaggactgtctttaaattatacctgtggattggctcctcttcccatttctgatgggtggtcatagctgtgcgattcttgctatacagtagttcccccttatactgcggggagatacttttccaatggccccccagtgaacctccgtgaaaacctcaatacagtagcagatcttttataacatttgtttttttccatatatatataccctattgataaatgttataccttgtactaaaattaaaggccatgcgcaaagacgagtcacttacattactgttaataggaaccacctgcattgagcatacgtactacataacacagttctgtcgacatgttgggttggccttctcctgggcttcccaaaaaatcaatctttgctgtacatgtaacttcacctatttttagaatggtggttggactaacagggttaacccaaaaccctctggcagggaacctttggcgctgaaggggcgcgcacaactggtcattcacgcgatcacagctttctgtccattataacttatttcagacgaccctatatactgggaccctcccaactatttggttcaacgcactttggcccgatccgtgat

SEQ ID NO: 494712 - DNA, 196 bp, Homo sapiens
ggggggcctttttttttggggggaagttttttttttttgggggccccccctttacctggggggggttttttgggggccccccccccccccccccttttggggggcggggtttttttatttttttccaaaaagggggggggttgccccccccccggggggtttttcccccccccccggggcccctttttttttttta

SEQ ID NO: 494713 - DNA, 2741 bp, Homo sapiens
  misc_feature (2468)..(2468): n is a, c, g, or t
  misc_feature (2472)..(2472): n is a, c, g, or t
  misc_feature (2509)..(2509): n is a, c, g, or t
  misc_feature (2544)..(2544): n is a, c, g, or t
  misc_feature (2546)..(2546): n is a, c, g, or t
  misc_feature (2550)..(2550): n is a, c, g, or t
  misc_feature (2564)..(2564): n is a, c, g, or t
  misc_feature (2568)..(2568): n is a, c, g, or t
  misc_feature (2571)..(2571): n is a, c, g, or t
  misc_feature (2575)..(2575): n is a, c, g, or t
  misc_feature (2581)..(2581): n is a, c, g, or t
tggctcttgagggccctcgccctcgatgatgtccctcgtccttcgcctgtgcagtgcgcttttgatgaggccctgtgggagaccgcgtgatcttgggggaggcctcccgttgccccccgtagtcccttgtcccgaagtcccctacacgtggccatttgttttcccccgccagtgaccccgtaagaaggctatgccctgacggtcctgtcctgcacctcagctgatgctcatggagcgtttctgtaggacctagtcttggcgagatcgggatgagggctggccccctcctcggcatatagctcctgctcgggccccgattagctgtgggagctggagctggagctggcattacgtttgaggcaggatctggtccgggaggtctgggatctctggttatatctcacttctgacctctgggcacgtgctgcagctgtggctgaggccaagaaatgtgaggggcctccatccactgcattgagtagtgaccccgacgtggggttcaatgtggaggggggaggggctgctgcggcagctgcaggagccgaggtgccaggccttgttcttctcatgccggcatccctgcttgcagctgtgaaggtggcaggaatcagcgaggtgacctgggctgagtcccgggagtgggaagaggtggcaggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcgctggaatgccgcctctttttccaggtgcaggtcttcagccgtgacccggtaccccagctctaagggaggtggcagcatcaaaggctcccctcgcctgcgtggcagcaggggaatcttgcgtctacggggcctagaggcctgggatctgggggagccacccctgggggcgagtgtctgccctggtgctgtatctgccgccttttcacaccgggtgtgacccgaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtctggttatatctgatttctgagctctgggcatggaggtctgtctgcagaggcccgggcctgggcacaaagggagagaggcctccattgtcccgcaggggccaaaatgcagaccgtgcatccccggtgacctcggggaccgttctctgatcatcaggattttcttggactctggggtccttgtcctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtacccgcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaanaaanaaaaaaaagaggccgggtgtggtggcttatgcctatnatcctagcactttgggaggtcggggtggacggatnangagntcaggagttggagnccanccnggcnaacatngtgaaaccccgtctctagtaaaaatacaaaatttagtcagacatggtgggcaggagagagcatgtgcaggggaacatccatttataaaaccatcagacctcatgagacttattcactaccatgagaacagcatgggggaaactggctccatgattcagtt

SEQ ID NO: 494714 - DNA, 816 bp, Homo sapiens
  misc_feature (39)..(39): n is a, c, g, or t
  misc_feature (128)..(129): n is a, c, g, or t
  misc_feature (131)..(131): n is a, c, g, or t
  misc_feature (134)..(134): n is a, c, g, or t
  misc_feature (142)..(142): n is a, c, g, or t
  misc_feature (149)..(149): n is a, c, g, or t
  misc_feature (161)..(162): n is a, c, g, or t
  misc_feature (165)..(165): n is a, c, g, or t
  misc_feature (167)..(167): n is a, c, g, or t
  misc_feature (179)..(179): n is a, c, g, or t
  misc_feature (193)..(194): n is a, c, g, or t
  misc_feature (199)..(199): n is a, c, g, or t
  misc_feature (209)..(209): n is a, c, g, or t
  misc_feature (212)..(214): n is a, c, g, or t
  misc_feature (230)..(230): n is a, c, g, or t
  misc_feature (232)..(232): n is a, c, g, or t
  misc_feature (248)..(249): n is a, c, g, or t
  misc_feature (251)..(251): n is a, c, g, or t
  misc_feature (259)..(259): n is a, c, g, or t
  misc_feature (275)..(275): n is a, c, g, or t
  misc_feature (321)..(321): n is a, c, g, or t
  misc_feature (341)..(341): n is a, c, g, or t
  misc_feature (346)..(346): n is a, c, g, or t
  misc_feature (351)..(351): n is a, c, g, or t
  misc_feature (354)..(354): n is a, c, g, or t
  misc_feature (374)..(374): n is a, c, g, or t
  misc_feature (382)..(382): n is a, c, g, or t
  misc_feature (387)..(387): n is a, c, g, or t
  misc_feature (403)..(403): n is a, c, g, or t
  misc_feature (412)..(412): n is a, c, g, or t
  misc_feature (458)..(459): n is a, c, g, or t
  misc_feature (461)..(461): n is a, c, g, or t
  misc_feature (475)..(475): n is a, c, g, or t
  misc_feature (478)..(478): n is a, c, g, or t
  misc_feature (482)..(482): n is a, c, g, or t
  misc_feature (486)..(486): n is a, c, g, or t
  misc_feature (491)..(491): n is a, c, g, or t
  misc_feature (496)..(496): n is a, c, g, or t
  misc_feature (502)..(502): n is a, c, g, or t
  misc_feature (531)..(531): n is a, c, g, or t
  misc_feature (640)..(640): n is a, c, g, or t
  misc_feature (810)..(810): n is a, c, g, or t
aggctcagttaggtgttaccataagtattaacagaaganaaagggaaagcacaaacattttccctctaccagaaaagggtctgatgtaagataaactagcctgttggtttaacaatagctcattaaanngnccngacaatcngggagangatgtacttggnngcncngtcctctgacgncccattcccaaggnncagcnaaatactganaannnttaactggctcaaaantnatattgagagataaanncncttagtcncagcttcgcccccccntcccgcctccctgccactagctagattagtaattctgatgtttccntgtcatagtcctctgtgcgnccccnagggnctnccaactggtgcccctttgancagagtgnttttnaataatagattctccngtgcaccanctgttttttccagtataattctggtatttgtccctagaaatacagnngncaaagccgcctggnggnagtntctngtatntaggncataanatgttttggcagccctagatttcccagtntgagtctttttcatcaggaaaatcacattctggctcagtccaaggtaacactggaggcaatgatattgatggcttgttataagcaggaggcaacagtgaaagtattgantcctggctttcttctttcatctgtttgaagaaaacatgggacaataaactgcttgctgatggccttttctcaggatcttgttgcaacagagctgtaccaagctaaagaaggcaggagagaaagtttttgaggatggtgtgtgtaatcggtcactatttactgtgtgagtncactgg

SEQ ID NO: 494715 - DNA, 2893 bp, Homo sapiens
  misc_feature (2620)..(2620): n is a, c, g, or t
  misc_feature (2624)..(2624): n is a, c, g, or t
  misc_feature (2661)..(2661): n is a, c, g, or t
  misc_feature (2696)..(2696): n is a, c, g, or t
  misc_feature (2698)..(2698): n is a, c, g, or t
  misc_feature (2702)..(2702): n is a, c, g, or t
  misc_feature (2716)..(2716): n is a, c, g, or t
  misc_feature (2720)..(2720): n is a, c, g, or t
  misc_feature (2723)..(2723): n is a, c, g, or t
  misc_feature (2727)..(2727): n is a, c, g, or t
  misc_feature (2733)..(2733): n is a, c, g, or t
ggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcagtgtagtggctgagctgggggatgccctggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtacccgcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaanaaanaaaaaaaagaggccgggtgtggtggcttatgcctatnatcctagcactttgggaggtcggggtggacggatnangagntcaggagttggagnccanccnggcnaacatngtgaaaccccgtctctagtaaaaatacaaaatttagtcagacatggtgggcaggagagagcatgtgcaggggaacatccatttataaaaccatcagacctcatgagacttattcactaccatgagaacagcatgggggaaactggctccatgattcagtt

SEQ ID NO: 494716 - DNA, 2573 bp, Homo sapiens
  misc_feature (2236)..(2236): n is a, c, g, or t
  misc_feature (2238)..(2238): n is a, c, g, or t
  misc_feature (2258)..(2258): n is a, c, g, or t
  misc_feature (2261)..(2261): n is a, c, g, or t
  misc_feature (2263)..(2263): n is a, c, g, or t
  misc_feature (2288)..(2288): n is a, c, g, or t
  misc_feature (2345)..(2345): n is a, c, g, or t
  misc_feature (2352)..(2352): n is a, c, g, or t
  misc_feature (2375)..(2376): n is a, c, g, or t
ggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcggggcctagaggcctgggatctgggggagccacccctgggggcgagtgtctgccctggtgctgtatctgccttcttttcacagcgggtgacccgaagagacagcctgaggtccgtcctcactcactgtgtttgaggaactgtgggccagctggcagtgggatgaggctggccccctcctccgctttagttcctggaggccttccgtagagctgtgggagctggagctggcatttcgtttgaggcaggatctggtccgggaggtctgggatctctggttatatctcacttctgacctctgggcacgtgctgcagctgtggctgaggccaagaaatgtgaggggcctccatccactgcattgagtagtgaccccgacgtggggttcaatgtggaggggggagggctncnctgcggctcatcagcaggtnccngnccttgttcttctcatgccggcatcnctgcttgcagctgtgaagggcgcgggaatcagcgaggtgacctgggctgagtcccgngagtggnaagaggtggcaggaaggggatcnnaggaggagaacaggggtcctggtggtctgtgcttcttcccagacacgggggtcagcccaggtcacctcgctgattcctgccaccttcacagctgcaagcagggatgccggcatgagaaggacaaggcctgcacctcgctcctgagcgcccaggcctccccgcctccccattgcttatgtgttgggtcttagatgcga

SEQ ID NO: 494717 - DNA, 2675 bp, Homo sapiens
ggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcgctggaatgccgcctctttttccaggtgcaggtcttcagccgtgacccggtaccccagctctaagggaggtggcagcatcaaaggctcccctcgcctgcgtggcagcaggggaatcttgcgtctacggggcctagaggcctgggatctgggggagccacccctgggggcgagtgtctgccctggtgctgtatctgccgccttttcacaccgggtgtgacccgaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtctggttatatctgatttctgagctctgggcatggaggtctgtctgcagaggcccgggcctgggcacaaagggagagaggcctccattgtcccgcaggggccaaaatgcagaccgtgcatccccggtgacctcggggaccgttctctgatcatcaggattttcttggactctggggtccttgtcctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcggagcacacagcactggcttactgtggtacctgtgcagtgaaattgaagagacaatccagcagcccaggtcgacgcggccgcgaat

SEQ ID NO: 494718 - DNA, 377 bp, Homo sapiens
ctgattatagtaagtcacacaataaaatgctacattttgccgtaagaacaaggaggatgctttaataaattgtgctattctattatataatattagtgaagcctttcatattatattttttattaattttaacaaaataggagatcattgtgttacctataattagagtatatagagtttactagggttataatatcctcagactatccagtagaaggccagaaagattacggatcagtgctagaaaaaaatcacgatcaaagcttcaacataagttgtctctggaagatgggctacttttactgtcttctatttactcttctacatttctcattttctgttagaaatatatctactattttctatttactcttcta

SEQ ID NO: 494719 - DNA, 428 bp, Homo sapiens
ccgggctcgtgagggtggtttgacaaagcttttcgctgtggccctgagaggggttggtggcagctctgcagcttggtggctgtagggtggcttgcttggttcttaggagtactttctggggagccaatactcttcaaggagatgttgtctgagtccaaggccactgctgtgagtttgagctttcgtccttttcccgatctgtctgattgacaggggctcgagtagtccgcccactggctaccttggtaggctccttcagtctggaaggcgtaaggctcacctcctttgtgctgaggagacttgggtcaatgctgctgctcacagggcgaggtcaccccgccgccggtcacgctaatagaacttgacttggctggcggggcaggctgcggtacttgatgttagaacgggctccaggaccaaggaatcct

SEQ ID NO: 494720 - DNA, 522 bp, Homo sapiens
tgagaagtgcctcatggcgtgggagtccattattccactactgcaagagaagcaagagactaagtaggttttggaacagagactcttctgcctccacagggcatggaaccctgaaccagaatgatcctgcagtgccggagaggtcgccgtgggaaaacagcacaacagcacctcttgtgtgtgtactttctacccccgcccccagttgttttcagttagtatttattccttggagtctatgagactgtaatcatctctcagcagcatacctccgtattgtgaaggaacctcttaaatggaacactaaaagacttgaaactgaggggcaagataacccccacatgacacgtgacatcactttggggacagcccagttgccattgtgggacagaaccccagtcctgcgtttcagggacatggggagacatgaagaaggcagctgcagcttgctgtggagaccccgtggctctgcactttacccgtgagggcattaacctgacccagcatggaaggaggtgtggg

SEQ ID NO: 494721 - DNA, 329 bp, Homo sapiens
  misc_feature (127)..(127): n is a, c, g, or t
  misc_feature (320)..(320): n is a, c, g, or t
  misc_feature (324)..(324): n is a, c, g, or t
ccaacctcttcatcaaggttgatgttggtggagataaatgcgtgcacttgagggtgtttcaacccctcccccatgaaaacaagcctttgaccctgtcttcctatcagaccaacaaagaaaggcacgntgagctctcctacttctgattcggggctcctttgcacctgtgtttgggaccacgtagtaaaacccccctcggtgatggagagaagggagttgagcagcttctgttgtgattctcaaactgcgttgtattttgcatccttccaaataattattttcagaaaactgtatatgatctctctaaatatatatttttngggncttta

SEQ ID NO: 494722 - DNA, 383 bp, Homo sapiens
gggagatggcagacatggcggcagtagtggacagtatacacattgtataaggacgaatcagtgatagacagcctattacggtattatgatattttcgaaaactacatatatgtatatacatgtaaatatagacacatatatgtatatacatatatacacgcatgtatgcatatatggatatatatagctgcagtatatgcatgtatatatgcatgtatatatgtggatgtatatttatgtagttattgatgaactacgctgtgtctctcttttctccatttccacagctgtacgatggatatggtatttaatcaggcgagtttatacatcatatatatcatatcaggacgaatatatatacacctcctatcattaaattgatg

SEQ ID NO: 494723 - DNA, 1380 bp, Homo sapiens
agcggcttgtccgcccgctccccccgtccccccgaagcgccggcgtccggctgcactcgcgctcgttccgagtttcacggctcgtgctacgctagcgccgtcgtctgtctcccttgcagtcagctcggagtcgatgattatctaaccgggatcctacatccagagcgaccgatggagatggttctccgaccatctacgaaggatccgggtagaatcagtcggacgagtgttgtgccatggcgcgtgagtagcgggagagatggatgcaggtaaggatcagcatagggctatatcaatatggaatcgcatcgtgcaggcgtcaatttgggttagtggaaatactctgctctttcccgaacgtggcataaggcgcacgctgacggtggcggataagggtaaaccagaagaaatggcgagccatgttgaaatacgaagctcgcgtttgatgcagaagtaactctcgctccattggacacgccactgcgatcccatggccaagtgcataaatcaaagttttttaccatcgatagccggacaagtcccataacaaatggaaacgctatcaaattcaacgaagattgatcacttgacacatcatagttcattcatagggagacacctgtcgtaatgaaaccacgaacgattctcacgacaccaggatggtaacaaatccctttgtttgatcgaacttgggggccatggacagcaaaacaaaagtgcaagagcatacctgccttgtggagacttaagattgttctagtagaatcttagtcaaggttatggtatggtattttggggttggaaagatgacttaattggagaattcccatggaattggggcatggtggtgttgcatccttaaatttgttggcgattttaggcctgtaaggataggaagtcggtgtttgtttagactccactccgatcacttgagtacgaatattttccattctttgaggagagattcgggtttttaccgacgacagtgggtgccaccaccatggtttcaaaccacaacatagttgcggcgaaatttcacttcgccactgcggattccttaattccaccccattgggtccatcctacgctacagcgtggtgacgttttgcgttgggctatggtttcgagttccacaacgaaacataaattcacccgaagtggaacttctggaaggaatcgagtaagttgggcggaacgtgggatttgttcctagtcctttggaaggtcattcgtgttccactttgtgaatattttggaactctcggatgtactttctaatcgtggggacgtggggaaggggccaattaggtgtgggtgatagggaatgaaacacttcggtttaattgctaagggtgtgggttgtaaaggaaatttacgctg

SEQ ID NO: 494724 - DNA, 111 bp, Homo sapiens
tgcaggattgtctgcgaaacctcatcccggtcgacctgctcaaagattgccgccgatcaccaccgtgcctggcggtgtctcgaccagtaccttggtcttcacgtgcttagt

SEQ ID NO: 494725 - DNA, 248 bp, Homo sapiens
tacaggatttacttcgacggtgttctgaggctgaaagagtagaaactagggcagtgaaagagatctgatgcccggtaaaggggacagacaaaactaggggagatagtggaggacggcattccttcctactctgctttctcagtggcctccattggcagcgcctgacccatagagatgcactccaggaacaggacacggacatgaatcaagggaaagggaaaggccaggctcaagagggcttaatgctt

SEQ ID NO: 494726 - DNA, 99 bp, Homo sapiens
gattacctagacggagaaacttaattattctccctggatctctgtgtgtgtgagtgtgactgtgaatacctttctgccccgcagaagtttgagatctct

SEQ ID NO: 494727 - DNA, 319 bp, Homo sapiens
  misc_feature (19)..(19): n is a, c, g, or t
ccttctggacacccgcttngagaggaccatgacttagtgtcccccagtccaattgccgatggtgatgccagccggcaaaggcaccgactttactcttggatcgggactggcttcctccggcaagaccagccattgggaagagaggtcctcgtggacatatgggtcaggcatagcagagagggtcacagagtggggcaagtagacccatggaaccgtatgggccaggccctcacaagaccaaagccagcaccaaaggagtcagggaaggggttggtgagtcaagggaccccaagggcccaggaattatttcttgacagaa

SEQ ID NO: 494728 - DNA, 182 bp, Homo sapiens
  misc_feature (20)..(20): n is a, c, g, or t
  misc_feature (61)..(61): n is a, c, g, or t
  misc_feature (72)..(72): n is a, c, g, or t
  misc_feature (87)..(87): n is a, c, g, or t
  misc_feature (100)..(101): n is a, c, g, or t
  misc_feature (119)..(120): n is a, c, g, or t
  misc_feature (133)..(133): n is a, c, g, or t
  misc_feature (135)..(135): n is a, c, g, or t
  misc_feature (154)..(154): n is a, c, g, or t
  misc_feature (173)..(173): n is a, c, g, or t
  misc_feature (179)..(179): n is a, c, g, or t
accaggttctaaatgtggancccatctgctttgccccatttttcgggccctgccccccttnctgcgtccggngtcttctgccttccnccctcggtctctnnccccctccccctgtgtcnnccttcttcctggngngggggggtttgttgttgcntgtcagtgtgttggtttcntgtggncgt

SEQ ID NO: 494729 - DNA, 341 bp, Homo sapiens
  misc_feature (212)..(212): n is a, c, g, or t
tgctggtacccctattatgctttggagctacgttggcaacttggagggcactgctgacagatgctgggttggcagtgcactttcagtgaccactgtgttcacagtgcatcaaggtggtaggcactttggagtggcagagatgttggcagtgtgcactctgcccctactggaagcagactgactaggctctggcctgtgtctactcctctgcnaaccctgtttacacctcatgcatgccccctgctagagtgccaatgccatggggcatgcaggagtgagaacggagtgttgccagttagattacaaacttgaccactgatgaggtccaagtgcaagctggc

SEQ ID NO: 494730 - DNA, 1055 bp, Homo sapiens
  misc_feature (6)..(6): n is a, c, g, or t
  misc_feature (78)..(78): n is a, c, g, or t
  misc_feature (155)..(155): n is a, c, g, or t
  misc_feature (315)..(315): n is a, c, g, or t
  misc_feature (317)..(317): n is a, c, g, or t
  misc_feature (337)..(337): n is a, c, g, or t
  misc_feature (342)..(342): n is a, c, g, or t
  misc_feature (352)..(352): n is a, c, g, or t
  misc_feature (356)..(356): n is a, c, g, or t
  misc_feature (364)..(364): n is a, c, g, or t
  misc_feature (373)..(374): n is a, c, g, or t
  misc_feature (378)..(378): n is a, c, g, or t
  misc_feature (386)..(386): n is a, c, g, or t
  misc_feature (388)..(388): n is a, c, g, or t
  misc_feature (390)..(390): n is a, c, g, or t
  misc_feature (542)..(542): n is a, c, g, or t
  misc_feature (545)..(545): n is a, c, g, or t
  misc_feature (557)..(557): n is a, c, g, or t
  misc_feature (559)..(559): n is a, c, g, or t
  misc_feature (567)..(567): n is a, c, g, or t
  misc_feature (572)..(572): n is a, c, g, or t
  misc_feature (582)..(582): n is a, c, g, or t
catttngcgtcctggtcaatcatgacttcacccctctggagatcctctggaccttctccatctacctggagtcagtgnccatcttgccgcagctgttcatggtgagcaagaccggcgaggcgagaccatcaccagccactacttgtttgcgctangcgtttaccgcacgctctatctcttcaactggatctggcgctaccatttcgagggcttcttcgacctcatcgtccattgtggcaggcctggtccagacagtcctctactgcgatttcttctacctctatatcaccaaaagtcctaaaggggaaaaagttnanttttccggcaataccccggntcttntcaatatatntctnggcagcancgggaagcnntagnaagcggcnanantagtagcgctttcccatccagggtgcacttttttagaacccacctcttgtgctccccatcccgcctcctgccgggtttcagggggacagtggaggatccaggtcttggggagctcaggacttgggctgtttgtgagttttttgccttttggnacnaggaaaaaaaantntttccacnctttngtttttgatnctgataactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaaaaaaa

SEQ ID NO: 494731 - DNA, 133 bp, Homo sapiens
gcaaaacctcttctctactgaagatataaaaaattagccaggcaggattgtgtgtgtctgtggtcccagctaccagggaggctgagataggacgattacttgagcccgggaggcgagttgcagtgagctgaga

SEQ ID NO: 494732 - DNA, 498 bp, Homo sapiens
tgagggagcttgaggagagaatcagcgaaatggcagtgctagcagtcatgcatgtgtctccctcagatcctggaccacctaacgatgatcgacaacaaaaacgagtctgagctggaggcccatctctgccggatgatgaagcacagtatggaccagactgggagcaagtctgataaggaaacagaaaagggagcatctcgaatagtgagtggcctgacttgaaagattgaggaacatgaggctacaccggaagtgatcttatctaaggtgtaggtcaccaggatatgctttccgaaggtccaaggtgaaggctcatggactggttgaatcagtctcctgctgtggtgcagtaaccatttccaccttgaaattttaaaatctaaactaagtataaccatgtgttttttggtccccaagaaagatcctaagcacttggtcaccagataaatagctagttctgcttaacatggaaagaatatgtccgtgccttctccatca

SEQ ID NO: 494733 - DNA, 1084 bp, Homo sapiens
  misc_feature (6)..(6): n is a, c, g, or t
  misc_feature (78)..(78): n is a, c, g, or t
  misc_feature (155)..(155): n is a, c, g, or t
  misc_feature (315)..(315): n is a, c, g, or t
  misc_feature (317)..(317): n is a, c, g, or t
  misc_feature (337)..(337): n is a, c, g, or t
  misc_feature (342)..(342): n is a, c, g, or t
  misc_feature (352)..(352): n is a, c, g, or t
  misc_feature (356)..(356): n is a, c, g, or t
  misc_feature (364)..(364): n is a, c, g, or t
  misc_feature (373)..(374): n is a, c, g, or t
  misc_feature (378)..(378): n is a, c, g, or t
  misc_feature (386)..(386): n is a, c, g, or t
  misc_feature (388)..(388): n is a, c, g, or t
  misc_feature (390)..(390): n is a, c, g, or t
  misc_feature (542)..(542): n is a, c, g, or t
  misc_feature (545)..(545): n is a, c, g, or t
  misc_feature (557)..(557): n is a, c, g, or t
  misc_feature (559)..(559): n is a, c, g, or t
  misc_feature (567)..(567): n is a, c, g, or t
  misc_feature (572)..(572): n is a, c, g, or t
  misc_feature (582)..(582): n is a, c, g, or t
  misc_feature (774)..(774): n is a, c, g, or t
  misc_feature (789)..(789): n is a, c, g, or t
catttngcgtcctggtcaatcatgacttcacccctctggagatcctctggaccttctccatctacctggagtcagtgnccatcttgccgcagctgttcatggtgagcaagaccggcgaggcgagaccatcaccagccactacttgtttgcgctangcgtttaccgcacgctctatctcttcaactggatctggcgctaccatttcgagggcttcttcgacctcatcgtccattgtggcaggcctggtccagacagtcctctactgcgatttcttctacctctatatcaccaaaagtcctaaaggggaaaaagttnanttttccggcaataccccggntcttntcaatatatntctnggcagcancgggaagcnntagnaagcggcnanantagtagcgctttcccatccagggtgcacttttttagaacccacctcttgtgctccccatcccgcctcctgccgggtttcagggggacagtggaggatccaggtcttggggagctcaggacttgggctgtttgtgagttttttgccttttggnacnaggaaaaaaaantntttccacnctttngtttttgatnctgataactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccccccaaaccncccccccttctcccntgaaacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaaaaaaa

SEQ ID NO: 494734 - DNA, 797 bp, Homo sapiens
catctcaaaaaaaaaaaaaaaaattagctgggcattggtggcgggcacctgtagtcccagctacttgggaggctgaggcaggagaatggcatgaactcaggaggcaaagcttgcagtgagcagagactgtgccactgccctccagcctgggcaacagagcgagactctgtctcaaaaaaaaaaaggaaaagaaaaagagggttccacgatcattgcccatggaaaattattccccagctagtaaagcacttcccattaatgtgatctacagtcttttaaaagggagcttctcaagaataagatggtgggtacaattggcttattggagaagggaaaaaaaaaccacccgatttttttaccaaggggaaaagaaggaatgtgatttctcatgatggaaagcttgattaagaattggcatacagttttggctccccaagaacccaaggccggctcgtggcaagaaacgaggggggttttcccgaaattgccagaaccgaaggttgcccttataaaggccaggttgcccgaattggttcccagaattgttaaagagaataggtgatgccaggagggaaaagctgggtttggggaacaaggggagcatgttttggtaaacaccgcgttaacactctattggtgccctttggaaagaccagaaccggggcagcctctaagtcaatcattggggtattatacagggcatgggcagctatgaatctggaatgtaagaggctacacgaattgaaagagcaacaagcagttggtttaaatacccgagaaaggttgttgccaaatga

SEQ ID NO: 494735 - DNA, 401 bp, Homo sapiens
taccatcgttataagcttctcacatcctcctcctgctctccagtcacgtcctcctcttcaccttcctcctcctcatcctcgtactcctcgtcttccactaccttagcatcttcatcatactcctcctcatcctcatcctcctcctcactcctcctggccctccacgttgccctcagcatccgagtccggggcctccttgttgtcccggtcatagccgtcgcgtgatgtgagttgcgagaggagcttgaacacattccctcggtagtcgttcaggtaggttacctcgcaattcaaacggtctaagctcttgaggtacactaccctcctcagtggctctattgtgctgaggtctataattatgtagccacttaaatttagatgcgtgaggtacggacacttaa

SEQ ID NO: 494736 - DNA, 5460 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 494737 - DNA, 4300 bp, Homo sapiens
ctgagatgttaaaccagagtgcttgaggatcagggctggattctgcctcatcaggctctggctcctccggggtctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 494738 - DNA, 3479 bp, Homo sapiens
caatcattgtttgacagaggattgtcataagcttgtatgactttatcatttatgtgagctctcactttttatgtcatttgtctctctagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 494739 - DNA, 157 bp, Homo sapiens
cagagtgcgcgttgtagatatctattaaagggtgtaccacagtgatgcctgattcttcaaaatacagtggtttctttacgctgtatagcctgcggggtcaacttgaactcaagccgccagagcgggatcgtgggcggcgagagcgcgctcccggggg

SEQ ID NO: 494740 - DNA, 5391 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtactgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 494741 - DNA, 126 bp, Homo sapiens
acgactaccgcacttatgcagcctccgtggatgtggatacgggacggtgacgcctgccgttcccggatgccggcacgacgcaagctggacggctactaactgtgcgtgtactctctggggactcct

SEQ ID NO: 494742 - DNA, 2677 bp, Homo sapiens
  misc_feature (79)..(79): n is a, c, g, or t
cttttagtactccagtggaggcctcccggccaaggctctctatctgaaacagcgaaatcatgttgccaatgatacagcnatacaacttgatgatctcgtccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 494743 - DNA, 5406 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 494744 - DNA, 999 bp, Homo sapiens
gcctttctagaccattcttatgtggcgcgaatccaagtaaggtagagatagaagttggtcgtgcagtgttgcccatgggatgcttgtttcctcctattgtgactgcagactcacccaggtaagagaatgcgctagggagtgaacaaggaagcggttgctagaacgagaataagaggagtggcatgtcctcggcatggctcctttgaatcgcgatgcctttcagggagggagtcaggagggagctgagttgtcaaggcgtagtggaccgccgagctccttgcgcagggccctcttcacttcttgaagcggggtgacaaggaatgacggcaaatgtgtccttctttgtgggccaacaagacaacgagaggaactttggttaacgaaggatcaacagttggacacgtccctacattaaaccaggggaatttccaatggtacgcgttgggtctctgggcttacggacctttatcttgcctgtgagagtataaagacaatgagcaccatcatagcacgcgcaactgggactcgtaaggaaaaacatgatgatttctatagccaaggaccatttggtcaggacgctcacccaacgcagtgcgctgcagttgcttaggcatctcatcttggtgacccgtgacttcatcccacggctcacaacgctgggatagaaggcacaacccttggaggcggggacgtgcataatgggcctactacaaaaggccactggatatcccaggcccgtgaacccacgagggactggagtgaaaactacccacgtgtactagcgcacggggcagatgctgagcagccagccaagatgatgccgtcaatgacaagagccagcgaacagtatgccgtgacgggcaccagcaatgaaccggaatcaaaccatggagacctgggatagtgcacagacgaagggaacatacgggcacggctgacggagacacacgcaggcgtagtggccggaagagcctgacggcgcagtcgggggcacggccc

SEQ ID NO: 494745 - DNA, 356 bp, Homo sapiens
gactctacctgatctctcataggttcgcaggagagagcatgtgcagggaacatccatttataaaccatcagacctcatgagacttattcactaccatgagaacagcatgggggaaactgcctccatgattcagttatctccacctggccccacccttgacacatgggaattgttacaattcaagatgagatttgggtggggacagagccaaaccatataattcttccccggcccctcccaaatctcatgtcctcatatttcaaaagcaatcgtgccttcccctaagtcccccaaactcttatttcagcattaactcaaaattccatagtccaaagtctcatctgagacaaggcaag

SEQ ID NO: 494746 - DNA, 5420 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 494747 - DNA, 5396 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 494748 - DNA, 823 bp, Homo sapiens
  misc_feature (169)..(169): n is a, c, g, or t
cgcgcggccgaatggcggcgacaagggcccggtggctggacctcggtcgcgagactgccatggcccattgtgaggaatgaagaaagggctccggaagcgccgaggcgcggcctcccaggcccgcggcagggactcggaggacggcgagtttgagatccaggtcggaagnatgactgcccgtggccctggaagtctgggacctggaatgaccccgtggctcctaccttccccacctcggaatgcacctcggatgtggagccggacacccgggagatggtgcgtgcccagaacaagaagaacgaagaagtcgtggaggcgttccgagtcctagtgggcactgagcgtacccgtgtgttcgaaaggcgatcatgacaggaatggggtacaaggtgccaacacccatccagaggaagaccatcccggtgatcttggatggcaaggacgtggtggccatggcccggacgggcagtggcaagacagcctgcttcctcctcgccaatgttcaggagcgggctcaagtaccacagtgcccagaccgggtgccctgggccctcatcctctcgccgagccgagagctggccctgcatgacccttgaagttcactaatggagctaggcaagtacacgtggcctctaagactggcctgatcctgggtggagacaggatggaagaccagtttggagtcctggacgagagatcgcgacataattattggcaggcccggacggtaggagcatgtggctgtggaaaatgagcctgaatctgcagagtgtggaatacgtaggtgtacgggtgaaggctgaacggcttttatgaaattggg

SEQ ID NO: 494749 - DNA, 386 bp, Homo sapiens
gttctagaggatccctgatcgctgtatcgagggagggagaattcaaggacaggaggcatctacccttgtgtccctcttaagcacagggaatgaaaaatggggaaaggcagatttcggctatatccattttctggggtcaccagtgactctggtgggtggcatttggaggaatctaggaaaattcaggaacatgctccctccacattctccagattcaaggtcgtaagaaatgatggcctctcagggaatggggacagtcttccctttggttggggagtgggtgcccactctttaagtattagggcatctcaagatgcagaggtacttgtggaagacccatttgttcacttgcaaagtcccccatgtctgtggggacttacggtcta

SEQ ID NO: 494750 - DNA, 336 bp, Homo sapiens
gacaacatagaatgtggatatattcaaactttcaaaaggacagtgtttagaaagggtaaactaggacacagaaaacactgtgaattacccacgaccccaagtgcttccggctccagggaaataaccatttcatgtgttttgctgggaggtcacaccaatttttccccttatttaactgggtgcaacaatggacttcattcactatccccaaaaagctttctttttcaaaaccaacggaattttccccatttaatttttgggtcccaattggcagttcccatttctaatgggtttgtccggggttaccgaggctccgaatttcgctaactcatgggt

SEQ ID NO: 494751 - DNA, 5955 bp, Homo sapiens
  misc_feature (308)..(308): n is a, c, g, or t
  misc_feature (323)..(323): n is a, c, g, or t
  misc_feature (329)..(330): n is a, c, g, or t
  misc_feature (5770)..(5770): n is a, c, g, or t
  misc_feature (5824)..(5824): n is a, c, g, or t
  misc_feature (5865)..(5865): n is a, c, g, or t
  misc_feature (5879)..(5879): n is a, c, g, or t
  misc_feature (5897)..(5897): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctgactcccaagatgctccatatcatggagtgttgggcagcaattttttaacttttggtaccagctgggtattcagccagttagagaaaggttaattactgcttacagagcttccctttttcttggctcacagacttggagctgtcttttattcctttggaatggaaggaactctccttccctgctctccacaaacagctcctagggagcagaaaaatctcatccttccttgttttgagattttggtcatgatttccctccaattatcaccagtcgtttcaagaagctcttgagcatcctaccactntgctgaccaaaagcacacaagattgcgcccagagattggctgggcttcagaggntctcacactacaactaagattgtgttcatttgacctaaggnagttgggaaatctntaagggttgctgcttggnttgataaagccccttttgtccccagcttacaattgctttacattcaatccgagtaggg

SEQ ID NO: 494752 - DNA, 234 bp, Homo sapiens
  misc_feature (39)..(39): n is a, c, g, or t
  misc_feature (46)..(46): n is a, c, g, or t
  misc_feature (88)..(88): n is a, c, g, or t
  misc_feature (91)..(91): n is a, c, g, or t
  misc_feature (137)..(137): n is a, c, g, or t
agctcggcccgtagcgggtttgcttcaaacaattatcgnttattgntcacttctatggcgggcgcagtttgataactatgtgagcatnggnccggcgtgcttcaaccacgccccaggcggacgctcacccaagctgntcctacgttgctgccgttgtcttatagataccgggagggtcggttatgccatcattgtcccggcactggttgaatgggggcatgttgcaaccagtcg

SEQ ID NO: 494753 - DNA, 150 bp, Homo sapiens
ccgatagccgaagtggatagaatacttggtacaccctggtgaggtgcatgaggtcatgtcactcaatttctggcagcaaactccgcagaaagagtccaaatttagtatcaagtttctccggaagtcattcctatacagtggcaaacgcgg

SEQ ID NO: 494754 - DNA, 162 bp, Homo sapiens
tctagaggatccttgagatgacaggaggaagtacatgctcagtgcaccatgaatgttgagacagagatgtgagacacctcagccccacctctctgcaacaggaaagatgattggggagggagcacaggtcagctgtgggaagtcgggtcatgtgtggacatg

SEQ ID NO: 494755 - DNA, 416 bp, Homo sapiens
attcctgagtataacccccttatcgtgctgacagcgctccaaacacggcattctcaggtgccattttgaatacgccccagggcacagtagccaggattcacattgtccaacgttatcatgtccatctgcaccatgttgtagcaacaaggatgcatgttattcatgactctgctcagggctgtgtacacgtttcctggccgccagaagatccacatctcaaacacgtgtgccttctaccgagtccagtgctcactcatactatgaagacgttctggctgagtcgcgctgcatccctgatagctgtgggctcacctacatcccccgtcgtggctcctaggacaatcgtggcgccctgcactcatgagggcttccaatgtgctgcccccctcttaatactcaccaataaattctacttc

SEQ ID NO: 494756 - DNA, 309 bp, Homo sapiens
  misc_feature (4)..(4): n is a, c, g, or t
  misc_feature (6)..(6): n is a, c, g, or t
  misc_feature (110)..(114): n is a, c, g, or t
  misc_feature (150)..(150): n is a, c, g, or t
tttntncccccccccccccccccgttgggcgccccaaaattttatttttttccccgggcatggttccggggaacattttcccaggaacggcctcggtagtaaaccccccnnnnngccttggagccatcttccttgaatcgcattttttantggactttgcgccgcttggaaaggtggcaccaggcccctggtcttcaaaaattgtttcctgtgaattttgtgactccaaataggccagtttgtgataagcttactctatgagttttcatttttttaaaaaaaagggaaggtatttttatattttctgta

SEQ ID NO: 494757 - DNA, 168 bp, Homo sapiens
tccagagttcaggtaggctagtgtctgatctcctaaccaccgcaagcaagatatccttccacaggtctatccacacagttaggatcaggctcactgctattgttgggatttgtagttactcatgccaggcacaggcacgcaaacgcacatttgcctgcaagtgtacac

SEQ ID NO: 494758 - DNA, 800 bp, Homo sapiens
gtgacgcgtgggtcggactgcgtggtgtccggacgcgtgggtcgaccacgcgtccgtggagtacagtgcgagtttagttgaagttgcaaagtcctggagcctccagagggctgtcggacgcgaagtagcagcgagcagatagagtccgcacgctccggcgaggggcagaagagcgcgagggagcgcggggcagcagaagcgagagccgagcgcggaccagccaggacccacaggcctcaccaggctgcccaggaagagccccagacatggagacaccacgctcctgtgctgcgaagtggaaacccatccgccggcgtaacccgatgccaaacctcctcaccgacgggtgctgcgggccatgctgacaggccgcaggaacacctgcgcgccctcgagttgttcgtaccttcaaactgtgtgcccacacggaggtcctgccagaccatgcggacagcatcgtcgccctcctggcactgcttggagctctgcgacggacacacgaacgctgccaggcaggacgctctccaccgccgagccactgacactctagccctaaagaacccggcatccctgatccacgagcgacgcccgtgcaaaacaagcagcacgccttgccccaccgcctgcgagcagcccacacgtgcgattgcctaccgtggggcccctcctcacggaatcgacacggaacgactaacagcacgccgcctagaaacgggcaccgagctacctccgccgcgccccaccaccaccacgccagcgcatcaccaccgccggcagccccaaggcacacctagcctgcc

SEQ ID NO: 494759 - DNA, 146 bp, Homo sapiens
ccctagttacgctcctgtccgtggtctcatcctgaccgtattacaaagttactttaagacctttgaacagtttaaaatggtttcatctagctctgacttttcttgctagccagatacctcgtgcggaacctaccgacagaaaatta

SEQ ID NO: 494760 - DNA, 343 bp, Homo sapiens
  misc_feature (177)..(177): n is a, c, g, or t
gtgaggatctgaggtatgctgccagtttatgagctatgagtaaagatgtaacaggcagcgaaaagtttgtgaatatacagtgtgccactaaaaactctctcggagattaaaaaaaaaaacaaagtaaacaaattctgagagagaatgaagagacatatcttgagtcttccagaaagngcaaataaaaaacggcaaatgggttgggtcccaggcgttcaccatgcctagagtggtgctgctatcaccactgtctcccctccctgccagtggctaggtagaggtaggggagaagggtcatcttggacatgctgcaaatacagcatttgcgggtgcaggcatacct

SEQ ID NO: 494761 - DNA, 125 bp, Homo sapiens
gtgaatacattgacttactgtacataaaaacacatttgtacttagggaagggtacgataagcatagtgatgactggttccgataggcctctatcagtatctctctacttacaccattattatcca

SEQ ID NO: 494762 - DNA, 357 bp, Homo sapiens
gataccacagctgaactttcttctaagtgccacagtgaacgagcagatcgtaagacaatctacagaattagtctgcacagcctatggtgaagtgcatgcaatcgtgatgaatccaatcaatgaatacaaagatccagagaacattcttcaccgatcgccgcatcatgtgcagacgcttctttcctgactatcttatttcattgagttagctatgacctacctttacagttgagtttgtatcataagattgtaagtcccgataatgccatgctgcatttggtctcaatcacagggaactaagtcatgctgacctgagctagtattgctgtgtatctactcttgagatgatctattttc

SEQ ID NO: 494763 - DNA, 324 bp, Homo sapiens
ctcggccgtgttagcacaataaggaagggtcccaggtagtgagagccccaagtagagaacaataatgaacaattactgtatgaacaactgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 494764 - DNA, 724 bp, Homo sapiens
ggaggcggcacgacggccagcgctgatccgctccggggctctttaccccggagtctgggccgggtgcgcgggaaacggtataccgagcggagctggtacgccctctgccttcgtcattatcctgccggccggtcggtttccggatgaaacgaggagccaggaggagatatcacagctttcccagatcgggaggaacaatatggaacatgtgttctataccgcgtgactgaagacaatcaaagtgagctgtcctgacagtagtttgcgaaccagcagctagcagtttgtccagcctctaacatgggtccagcactttccagagcaaactcacgtgtttacacagaactcttggccttacgaagttttataacctcaagcttgttgatttaaaatattacctgcaaaagaaaagtacccggcacccactttccacagaatggccatggatgagtattatgtggatggtcattctgggtaacatcatacgctttcatcttggcctttctgttggtgcacaacgatgtttgccaatcctttggtacagccgtgggctcatggtgttggtgacccttgaggacaggcatgcaatttttagctgcaatattttgaaaccaccgggtaccgcggtaaactaggcgccaaggtaggaggaaaacaattcgccaagggtatcctttgccgtgaaccctgtacgatcgagaccggtggagcactctcatggctg

SEQ ID NO: 494765 - DNA, 383 bp, Homo sapiens
gcacgagaaaaaattagctgggcatggtgatgtgagcttgtggtcccagctgctcgggaggctgaggcaggagaactgcttgagcctgggaggcagaggttgcagtgagcccagattgcaccacagcactccagcctgggcgacagagcaaaattccatccgaaaaaaaaaatttggtgagaggtgggagataagtgagtaaagaacttaaaaaagcccaaaaacaattatctgggcatggtggtgtgctgcctgtagtcccagctactgaggagacagaagtgagaggattgcttgagcccagaagttcaaggctgcagagagctatgattacaccactgcattccagcctaggtgacagagtaacaccacccgtcgtaaga

SEQ ID NO: 494766 - DNA, 310 bp, Homo sapiens
cacaatcaagggacatgcatacatagtgaggtcaaacacaagaagtcacccatactgaaaacaccgcgaaaaacagccggcaatttatcggtacgaaagcactgaagtacctcgccccggtgacaaatacagccaaattgcgccaggactctgcgccagcccctctctatatatagaagagacaaccattcatctccctgacggacccgccctgagaacaaggcgagcaagcaacgcgaaatcatcgagatacataaatacgacgacacgcccagacggggcagcccagcacctgcaaccacccaatctc

SEQ ID NO: 494767 - DNA, 439 bp, Homo sapiens
  misc_feature (171)..(171): n is a, c, g, or t
aaaaaaaaggggggggtggacaaagtattagtatccccagttccacacaggcccaaattaaaggggtgttaagtttaaggggggtctatttttgcttttcccctgggggtgaattcccattatttggggtaatcagtgggtagggaattgaaggccagtaataaaaccccnaaaaaaaaaaaaagcctgatcttcccacacccccccaaaatatagttaaaaacttgtcaaaaagaccttcatatttaccaaggattcagccaattaaaaattattactgtcctttagattcctactggtttctagctgaagtgtttgggtttttgttttgtttttttcacagctgttgttagtttcccccgttctttcttaccgcactgaaatccagtaaatcactcagctctttgtccgtccctaaggcagccattcgctgttggta

SEQ ID NO: 494768 - DNA, 316 bp, Homo sapiens
ggcccgctctcgtgagactcattgacccctaacctgggcaactgcataagccacaggtgtggctctaaagaagacaaaagataaataagaatggatgcaagcagaaaaatcccactttaaaggcaaaaaatggaagttcccattgtggctcagcaggttaagaacctagctcatatccaggaggctgcagggttaattcctcactggcttaaggatctggtataggggcaagctgcagcacaggtcacagatgtggctcagatctagcctttctgtgtctgtagtgtggtccagaagctgcagctgtgattccacc

SEQ ID NO: 494769 - DNA, 156 bp, Homo sapiens
ggtcgatgagcagattgcttaacggtcaggaccaggaccagcagctacttttgtggaatggactcccacacatgtctcaagacacccgtcttgtacactcccacctgggtcccctaaggagtgcagacaccttaattggcaattgcacaccctacc

SEQ ID NO: 494770 - DNA, 399 bp, Homo sapiens
tggtgcctagaggatctcccgtaatatgtaaccaaggccaggcacggtagctcacgcctgtaatcccagcactttgggaggcgagacaggcggatcacctgaggtcaggagttgggaccagcctgaccagcatggagaaacccctactactaaaaatgcaaagattagccgggcaaggtggctcatgcctgtagtcttggctactcgggagactgaggcaggagaattgattggaccggggaggcagaggtttgcagtgagcctagatggcaccgctgcactccagcctgggcagcagagtgagatgctatctcaaaaaattaaataaataatatataaaaagaacaaaaaagacttaaggaaataaaaacattatttttatttcagtgcttatctatc

SEQ ID NO: 494771 - DNA, 964 bp, Homo sapiens
ggaaaagactcatatcatgcatgtcgtcttcggaacacgtagattcgggcaagtccaccactacgggccagtctgatctataaatgcggtggatatcgacaaaagaaccatgtgaaaaattcgaggaaggaggctgctgagatgggaaagggctccttcaagtatgcctgggtctggataaactgaaagctgagcgtgaagcgtggtatcaccatggatatctccttgtgggaaattggagaccagcaagtactatgtgactatcgattgatgccccgaggacgacatgagactttatcaaaaactatgattacagggacgatctcaggctgtacgtgtgctgtccgtgatgtggctgctgggtgttggtgaatttgaagctggtatcatccaagaatgggcggacccgagagcatgcccttctgggttacggcactgggtgtgagacaactaatgtcaggtgttgaacaaaatggattccacgtgtaggcagcctacagacagaagagatatgaggaaattgttaagggaagtcagggacttatcattagtgaaaattggtaaaaccccggaacagtagtcattgtgtgccagtttgtggttggaagggtgatggacatgctggagcaagtgtgagcatgcttggttgcaaggatgggaagtcaccgtaaggatggtgatgcagtggaagcacgctgttgaggtctggatgttcctacacattcgtcaatgaaagcctgtggcgtgtctcaagtgctaaaatggtggatgtctgtctggtggcaggggaggggttcaaccggtggggggttgtagtaagtcagggataattgggaggccaggttgggaggcgggaagggctggaagtgagagggggagttggaaataaagaggggcgcgtttaaagaaagcttgttggaatgtataataggagaatttttggtttcatattggaggtatagcc

SEQ ID NO: 494772 - DNA, 370 bp, Homo sapiens
gaaaatttgagttttcttaaatgatagaaatagattgatataattcggtatctacattttatattcccataataaaaaagaacataccctgtaatgtgccttccataaatgcatccagtaaatggagaaacaaactgggacacaaagctgttttggagttttatgtggaggggaaaaaaaagtatctgttatttatttctgaatgtgtaaatttcaaaaaacaaccttcaggttatataaagctttactaaatttcagacacatttcataaaatataagaaaaaaatattgttatcctcctgttaccttttaaatattttctatccagtgtgtcaagtctatatataattaaacagcagattaatcagca

SEQ ID NO: 494773 - DNA, 220 bp, Homo sapiens
atctacagcagccaaaggcttgtccctgactttatatggctgcgctggcgagcgactgagtcgtccgtgagaaaaagaggcgaggcttttccgagatcgtctcaaccatggcgccttcggtcgcagtttttggggttctcggtttgcaagaacccttggtacagagttcgcaaagcctttctaaccagctccgagcccggcagcgaaacccttaagttga

SEQ ID NO: 494774 - DNA, 144 bp, Homo sapiens
atgatgctcagctggagtgcagtggtgcaatgtgggcccactgcagccgggacctcctgggcgcaagtgatcttagtgggtaacacaccaagactccatctgtaaaaagttaagataaaggattactgaaagatgtcgtttcta

SEQ ID NO: 494775 - DNA, 1059 bp, Homo sapiens
cgaaagccaccttcccaacaaggtgggcccctttctctataaaatccgtgcctcttctcttggtctctccagggtactcagtgacatcggcacttggtccgctaccacaccgtaggcggcatctcggcgccagagtctgatcccctgaccgcgattgatgtatctgcttccttccgaagcttctagccaccatctgcagaggctggaatgtggggtctgcccagatcttggcgctgaattgccaagacaccctgggaccagagactggacgtgtacccaggcccgccttcacaggacacacggggcctgttgggtacgtgctgaagccagccttcatgcgagaccccaacggcacgctttaaccgccgcgtcctggctcaggggtcctggctgggcacggaagcggctcaacatcaggcgtcattttcggggcagcagctgcctaaagtcaacaagaataagaattcaatttgtggaccccaaagtgatcagtggagatccatggcgtgagacctggacgttggccagccgccagactgctgtcatcaccgaacaatggtttcaacctcatggtgggacacaggagtttgcgtttgaggctagtatgtgccatgacctctgccctcatccgcttcttggtggaagattactgatgcgcatcctccaagatatgacttgcattggccagagtaccatcgcaccttgaacagcctcaagcaaggataccgccaatgtccacctcatgtctaagaacggggaccagctatccatcagccaccctctttgtgaagatctccctcccaggagcttaggatggaggatagccagtaggggtctcccccatgagtggtctgggctcactatgtcaagcatgtggggatcagggtctaggatgctggctgctcccagcctacattgctcagaggataggccaccctaaattgcacttcagcctctaacatagtgtctgctgctgcctcctaggggaccaggagctagcgcagtcaacgtggagctgtccttctattccgttaggaataacactgcagcgctctccac

SEQ ID NO: 494776 - DNA, 919 bp, Homo sapiens
atctctgtctccgcggggtggagtcctttctcccgcgtaggggtgttgtcaagagagttcgttcccgcccccaccttttttcttcgttgtggcagcccctcgtttgggggggtgtagacggctactctgctcctatggtgcggcagcagccccgccctgctttgtgtggtgcgctccccgcccccgagggagttttttttttctcctctgtcctcccctccggaggtaggagcactgtctgttggggggtgtgcccacccagcaggcagcctctctcttctctctccatgatcactctggtgtgggtccgtctctctcctacgagagaatccactgggggcttggttctctcgccccgctctcaccgtggggttttttttttatgacacccaattctgtttttgtttttgttatgcacaccggtcggcccttgctctttgtctttctgactgaggttgcccacctggtttgttcctgcgctccccctctgtctttgtgggcgcccccccctcccggtggttgtttcgtcgggacgcacccctcggtgttgttgctctctctctggtgaccgtactttcactacaggggacgctgttcttcgttcgcatatctcctctcgctctcgtgagggagcctctctctcgtgacccacccccaccgagcggggctgctaggttgtttttcttgtgccgaccgacgatatttttctttcgtgcggtggtttgtggggagcgacatctttgtctgggtctccttcgctccccccccctcctctcctgtcccctcgcccctctctcctccgcgagcggggggggcgaggaagaaataaatagatgttcggtgtttttgggggaacccccctttttttttggggtgaaaacttttaaggggtttttttttaaaaccaccccccccccca

SEQ ID NO: 494777 - DNA, 214 bp, Homo sapiens
attaccttgcctatatactttacgacacgacacatgccttaccttgctgacaactgctgagaaatcctagaccacgttttcaaggctgggctcaacactgtcacctctacctacccctttgctgatgccttcctggcacctggtgcattctgaccaccttggtaccgtgtccttccacttgaccacgcgtgacggcacaactatacacacttta

SEQ ID NO: 494778 - DNA, 201 bp, Homo sapiens
gtccgcatgcagtgggcacagaaagacaaacttcacatgctctcatctatgtgggggagctaaaaattaaaatgactgaactgatggagatggtagagtagaaggacgtctaggggctatcacttgtagaagcagtattaaaaaaaaaaagtagaaggatggtttgcagaggctgggaagggcagtggagtggaggtgggg

SEQ ID NO: 494779 - DNA, 752 bp, Homo sapiens
  misc_feature (1)..(1): n is a, c, g, or t
  misc_feature (119)..(119): n is a, c, g, or t
  misc_feature (673)..(673): n is a, c, g, or t
  misc_feature (726)..(726): n is a, c, g, or t
  misc_feature (742)..(743): n is a, c, g, or t
ngctgcgcgggtgagcttcagggggttggatgagaataggtctgtatgtcgtaggcagatggagcttgttataattatgcctcatagggatagtacaggaaggggtagactatgtgttntgtcagggggttgagaatgagtgttaggcgtattataccatagccgcctagttttaagagtgctcggctaagtactattgacacagcgctgggcgcttcgacatgggctgtactgagtcataagtgaagtccgtatagaggcatctttactataagactagtcgtgtaagctagtcataatgagatgctggctcaggagtttgatagttcttggccagtgagagtcagtagtagaatgtttagtgagcctaggcgtgctgtaagtgtactgtagtgctatgagtagggcgagagagctgcttaaggtgtatcatagggcgtctggtcctgcgatcaagcgctctgcatggttgcctcagcgggtgctcatagccacggtgcggcttactgtagattgggtttggctatcgtcttattcgtagttggtctgctcatgctgtgggcatgcttagtagcatggtgatgtagcgagactctataaggagtacgataatgggtaagatgctttgatggtgccgtcgtatagttgatgtcacgtcgtggaataaatgtgngcagaatgggcgttaagctctagagagtatgtcagtgtctggaagttcagtgntatgttcagtcaattnncctgccaag

SEQ ID NO: 494780 - DNA, 206 bp, Homo sapiens
gaggagaaaaccgaaaaggttattgtagaattgattataatgcatggtagaagcctattctcagacctttagatgcctattaacctgatgcactggtaccaatgcccccattcgggtgtgacatcttcccttcaccacttggcacaacacagatattagagtcagctccaaaagctaacccatggtggttccggagagattcccaa

SEQ ID NO: 494781 - DNA, 142 bp, Homo sapiens
agttactgctaacttcagcagttatgtatatgtaaaaaatatcaaattggaaataaaatgctaatggtaagggtaagttaagacttaatatttgcaggattacatattttataaagtcggaataaaacaaaattataaaggg

SEQ ID NO: 494782 - DNA, 156 bp, Homo sapiens
catcagtctatcccggtcaagccgaagcccttcagctcgcggcaaccagcctgatcggaggtggtcgtaacgagaacaactcatcgggtgaagctaaagcggcccgatccaccaccaccggatcgaccgtgcctaagctagaaaccttcacgaccc

SEQ ID NO: 494783 - DNA, 822 bp, Homo sapiens
  misc_feature (232)..(232): n is a, c, g, or t
  misc_feature (386)..(386): n is a, c, g, or t
  misc_feature (401)..(401): n is a, c, g, or t
  misc_feature (424)..(424): n is a, c, g, or t
cgtccgttgctggccctggccggcggcctactgcgctgcttgctgctgctgctgggccaatggcggcggcgtgcgctggggctcccgggcccaggatgcggcggcggcgtcggcggacgggccccccgcggcagacggcgaggacggacttaggacccgcacagcaagcacctgtagcactggcctgacatgtttcacgcatcgggatccattagcgccgcgacactttcgntacatgttcttcgcgcccatggttgttgtgacatctgtccagtcggctgtctagccgaactttggaaatgacctgaggagaacaaagtacaacagtcattgtgcaagatgtccaagagtctatggtggcataaaacgatggacatgacagcggnaccacgtccgagcgntgtgcgtccgcaccgaggcgggntgcagtaggatagcccctaccttaaagtcttttgccagagccagtggccaagtagagctgttgaagttaccaggggtcctctgggacttccagaacacgtggaaacactggattgctgcagaacactgtaacgtaggagcccagtgacaccagagtccggaaggtggaaccgatccagtgcccccgagactcaagcaatgggcatgtatgagctctcaggcaagcaactttgagctgcacgttgtacaaggcgaccacgtttatcaagttcttcgctccgtgcttgtggtcactagcaaaagctcctggttccaagctgtggagcagctggatctggtgccttgaacattccgaaagctgtcaatgattgggcatcggtcgattgtacccagcactat

SEQ ID NO: 494784 - DNA, 195 bp, Homo sapiens
cagtctgtcatgtttgcatcttgcatcatcatgattcatacttcaaaacttctcggcatgaaaagaattgcccttcgcatacaaagaaatgttcatacctcaagtaggcaatacatgagctcaaaactgcccatctcacacatctgcaagaaccccaccacagccaaagcaccaggtgacataaactctaaaacc

SEQ ID NO: 494785 - DNA, 228 bp, Homo sapiens
  misc_feature (212)..(212): n is a, c, g, or t
gtcatgtggaccgaggcccactccaccctccatgccccagtgagggccaagaaagccgtctctacccattggcgaccccatgtgggcgctgggagtggctgccctaggagtgttgggcaatccctggcctggaagccttgtgttagtgtcttggaaagcagtggacgagggcctggaggggacggggcagccagtgccggggctcagctctngaggctccctggctgt

SEQ ID NO: 494786 - DNA, 751 bp, Homo sapiens
cgagcgagcgcccttattattttatttattatccgtatattaaagtttgtatcccttagtaagaattttctaaatcacaaaatagggtggcaatattgaggtaatagaatttatggcgtgctgaacatactagaatataaaggtaacttactagtggtatcgtcacatactaaagctttctaaaccagcgggtttctcacagacgagtatttacttttctttgaaagattaaattttagagacagcatagcgctgtgtaccaagcatacgcatggtaaccacaagtgcaacttttcgggaaatcctccccaaaagatattttacctcaaaatatcatatagcacatattttctccctacaaaaatagcttgtcagacatcattaatgggatgtatataccaactatgtacataagagccaccttgtaggctacgagtttaacgtggtttaaaacacagcgttggaggcaaacagtagcaacagcagcagcaaaggcaccaaacggacgaaaagacccagatattttcctcacgtcatagtcagacggtggttgtctcaccccttacataaacatccaagtgagatttctcacagtcgctaccctgtggcaacaacttaaagattctctagacaaggtctgggttaaagcctttagttacaaacagcttccttggggcatcaccggtatctggtagggctccagaaatactagattggagataggagggctcacaggatgagtctatatgtg

SEQ ID NO: 494787 - DNA, 158 bp, Homo sapiens
acctgtggggggggaatgcggaggtttgtgaagttgaacagtccatccatctgcactgagaggctggatcctgagtcccggggcagcatggatcccaggaaccttcctcctccagtggcagcacagtgactctacgcctgtgtctggacctgtgccct

SEQ ID NO: 494788 - DNA, 313 bp, Homo sapiens
ttatttaagacttcccccttaatttatttgcccccaggatgggtcagtttgttcagtggtcagcaggcccccccccccccgccgaatgcccttgccattgtggtcagacccccctcccaacacaacacgctggtggtttgtgtcagcctttgtaacgtgggaggctctcccgtgtcttccgggtgaactgtatttggattgggcgcattgtcacggtccgcccctggggtgcaggggccccttcctttgggcacccctgcattttgcatccccccctttaaacgctgtaataaacagactgttttccctcgga

SEQ ID NO: 494789 - DNA, 625 bp, Homo sapiens
ctgccgccggtgagcccagcactgcctgggagggccccgacctctcctgactggtggccctgggggctcatctgggctggctgtgccggtgcctcccctcacccccgtgcgccttccctccatcctgttccatgggacctcaccctcgggggagtcaagaagaaaaccttcaccccaaatatcatcatgtctggaagatcaatggaagatgcccaatggaagcaatgtaacttgtcaaggaaggatgaagctgtgaaagtggacagagacctgacaactgagaggggcatggacggattggcgaggccgtccatgaatgtgatccagtctcactccatctttgagcatgggcccatgccgaaaatgattgaagaaaaaatgggaactgggataagaccagttggatgtgtcagacttgggaccttctcatatcatcaagcattcaaagagagagaagagagagaccagacgaagaaactaaaccagatcttgcgatatgctgggagaagtgacgatttcctcgatgaccccgggccttgaggaacggacactcgaaaatattgcctgttgcagcttgccggctgggatcactcaaggatggcgttttaagggcaagaacaatgac

SEQ ID NO: 494790 - DNA, 213 bp, Homo sapiens
tgggccacacgactagaaatagagctactccagcctgggcataagagctacgccagcctgggcaataagagctactccagcctggcctggatattatacaacagatgcctaaatttatcaatgggtctaagacgagaatcacaagggaaatttaaaaatatcttagatgagtgaaattttttgtttttttttggtggagtctagctcttattg

SEQ ID NO: 494791 - DNA, 384 bp, Homo sapiens
gtctgtcgtcatctggtggtggaaaccacttctaggtttgaagagtcgcagtgcacgctctgcggggagccggaagggagagatggggagagatgatcccaacgcgtgactctaaaggccgaatactaaaggcttctgtatactcagggccacagaagctcaaccatgtccactggaaaggctcttactcgcaatttaaaacacaaaaatgaaaaaaagatacagacagcccaactaaatccttgaaatgcagcgtggcgtgaaaatggagcggcattttagttaacgagggtctggatgccattcacaggaatgcagtttctacagggttctgctttgcagagacctctcctgataataataataaatttactcagaacaaaa

SEQ ID NO: 494792 - DNA, 1042 bp, Homo sapiens
  misc_feature (1042)..(1042): n is a, c, g, or t
ggcagtgcgtcggtcccgccgaggtctgtctcttgcttcaacagtgtttggactgcgcaacagatccgtgcggtactctcttcctagcctccgacctgctcctccgtattatcctctccgcttgtcaatgctccgtggtaccatcttctcgtgctcgatctcctgtcttctttggaccatgtccacgcaccgttttggtggttagctcgctttcttgcgaaaccaaactcatcgagcttccgcgaggattcagtccaggagtttcattcgcgacctgtagcgtggtagcgcagcgcggtgcgaagcaacgcacttggtacaagttatgtacggcgtgcaagtgccctccgtcactatctcacagtcgtctgcttgggcctgcctaatgtgtcgaccccgctcgactgacctgtgagcatcctgtgagcaggctgattgaacggccaagatatacttctcggacgaaagtttagggtgcgagcggatgacacgaccgccaacggtgcgtagacgaagactcgttcttgcactgaaatgactgtcgacaaaacacacagcggatggtcaggtggctcaggcgagactctctgcccttttcgccacggcgtaccaatttcaaaagaaaaaagtgcctaagagtgtgcaataaggaatgcaatggttgtgagagcgtttggataagacaccccactatggaaatgagagcccaacttgggattaatgcctttggccttgaatttagggcccccctggggtcaggtaacaaacacaacgctttttgacaaatcttctatggggacccctgcttatttatgtgaaacatccatttcaaaatgtcctcccttaggtggaataacttattgacgccaggcttaaccacgtagaaggcaaccttccgagagctcacgtcctttgatttgtaggctttatccccctttgggggaaaagaaccttgcctatacgttttttccgcctatatgcaaggttggaacgcggtacaatgttggtacacagcatatcacttcggaacgagaaaatgtcn

SEQ ID NO: 494793 - DNA, 633 bp, Homo sapiens
  misc_feature (252)..(252): n is a, c, g, or t
tttctacgcaagtctcctgtgtttaaaacacgcggcaaagtagggcccctgagtctgtcatttgttgactgtttggaactagtgaaagccagcattggtgtaatatttttcaatggtctaattagaaagaataaggacaatgtgataaacacctgacccctattagcggggactctgaattaactggagctttgatttcgaggtctgctttcagcagcaagaggcaaattggctagaaaaagagtcagcctnggggaactcgggacacagccaaccccaggaatgtgcctttgggtcagagcccagcccagctctgcttccacagggagagatggggagagatgatcccaacgcgtgactctaaaggccgaatactaaaggcttctgtatactcagggccacagaagctcaaccatgtccactggaaaggctcttactcgcaatttaaaacacaaaaatgaaaaaaagatacagacagcccaactaaatccttgaaatgcagcgtggcgtgaaaatggagcggcattttagttaacgagggtctggatgccattcacaggaatgcagtttctacagggttctgctttgcagagacctctcctgataataataataaatttactcagaacaaaa

SEQ ID NO: 494794 - DNA, 129 bp, Homo sapiens
tctagaggatcccgtaaagtcataaaagcagaagtttcttcagtgatcttctctctaagaaacatcatcacctccatgtgccttacagaggccccgtgcgttctagtgcattgcaacacggtctctaca

SEQ ID NO: 494795 - DNA, 139 bp, Homo sapiens
gcccattttacttttgaatttaggttttactaattggcatttggaaggtcagcaagggcacaagccttactttggttaccgtggaaaccactgccgcccctccccgatgtgggggggtcaataaaaatggtggaattca

SEQ ID NO: 494796 - DNA, 565 bp, Homo sapiens
  misc_feature (252)..(252): n is a, c, g, or t
tttctacgcaagtctcctgtgtttaaaacacgcggcaaagtagggcccctgagtctgtcatttgttgactgtttggaactagtgaaagccagcattggtgtaatatttttcaatggtctaattagaaagaataaggacaatgtgataaacacctgacccctattagcggggactctgaattaactggagctttgatttcgaggtctgctttcagcagcaagaggcaaattggctagaaaaagagtcagcctnggggaactcgggacacagccaaccccaggaatgtgcctttgggtcagagcccagcccagctctgcttccacagggagagatggggagagatgatcccaacgcgtgactctaaaggccgaatactaaaggcttctgtatactcagggccacagaagctcaaccatgtccactggaaaggctcttactcgcaatttaaaacacaaaaatgaaaaagtgagtatagggttaacttggaacttttatgaaacacttaattcccttatttggtggttaagggaagtatgacaaggttttaaaaaatttcctgtgtcat

SEQ ID NO: 494797 - DNA, 172 bp, Homo sapiens
  misc_feature (26)..(26): n is a, c, g, or t
  misc_feature (83)..(83): n is a, c, g, or t
gctcgatttgccagccagccctctgnagtctggatcaaaggttctcaacatgaggtccctgaaccagcggctgcttttgctangaactgggaacttgtgggaaaggcagcgtctcagaccccaccccagatctactgaatcagaaactctgggggtggggccagcactttgt

SEQ ID NO: 494798 - DNA, 278 bp, Homo sapiens
ttttttttaaaaaaacattatttcaaagagggctgtagagtttccacatattattcccatatttgcagtttctggagaaggaattgaaaaatttaaaaattgttttaaaaagttcctggattgacagggcaaccaggaaaattatggccttttttaaaaacagttggtttatttttgggttttttatacaatgttttttttttagcccccattaaaggattgtgttttttctttcaaaatggatattattttaatttttttaaaatggtttttatgga

SEQ ID NO: 494799 - DNA, 422 bp, Homo sapiens
  misc_feature (63)..(64): n is a, c, g, or t
  misc_feature (74)..(74): n is a, c, g, or t
  misc_feature (97)..(97): n is a, c, g, or t
  misc_feature (136)..(136): n is a, c, g, or t
  misc_feature (179)..(179): n is a, c, g, or t
  misc_feature (183)..(183): n is a, c, g, or t
  misc_feature (364)..(364): n is a, c, g, or t
  misc_feature (376)..(376): n is a, c, g, or t
  misc_feature (378)..(378): n is a, c, g, or t
  misc_feature (389)..(389): n is a, c, g, or t
  misc_feature (400)..(400): n is a, c, g, or t
ccgaggtcgggtatataagcttgatccgaattcgtcgacaacctggttgatcctgccagtagnntatgcttgtncaaggacttagccatgcatgccncagaatcactgcattgcaggaatctgcgcatggctcatnacatcagacgtaatctgccgcaaaaatcttgcggtctccgcanaatnggataacttggcgaaacgccaagctaatacatgaaccaaccggatgttctctgttccggcggcagggcaacctgctgccatgggacgtccagcgaatgaatgaaagtaaaaccaatgccttcaccggcagtaacactcagaagtgttgattcaattcattccgtgcgaaagccgggttaanacccggcgtctntngacgaacaacngccctatcagncagcgatggccgtgtagtggac

SEQ ID NO: 494800 - DNA, 902 bp, Homo sapiens
ggagagaactagtctcgagtttccgatttctattttcccaaaaaaggatattttttttatccacaagtacctcgcaaataggaaaccaaagagggagccccaggcttgggacaaatctcagtggtataccccttccccaaacaaaacagggtggagagaggtggcccctatacaccctttatagtggctcgatctcgggccccctttgcatcacctcttgctgcagacatccatagggagcagggcccccacacatctccgcgtgggacacgtggcggatcaaatccgagctccaccacagcacgtgccctagtgcccaacagcccactttctttcccccaacaagagaagatactctgtgacggcgaaacgcggcagcactccgcgtgcgcgccgaagaaaacaagcggacgcgccaacgcgagaacgagaactagaaacccaactctgagcgcccaccctgacgccagacaccaagacaaccacaaaacctgcacacgcgagagtctcctcaaaaacacaaatgtggccacacacatacttgggcaacaaccccaaaacatacccacccaacacccacccaaaaggtgtggcgtcccccccagcagcagagccgttgacgctatgtcggcctcgacaacaccccaagcaacggcgccaaacacaccacaggtggcacaaaaaccccccaagaaaaacccccctattctgggggagaagcaaacgtcacataggacacgagtcacacgccgcgaccccccaacgcagcaacccggccaagaagaagacatcaggcagacagaaaacccaggccgagacccagaaccggacaagcagacccaccacccccagagtagccgaaatcaactgtgcgcaccacatacaccaccacccgcaaccca

SEQ ID NO: 494801 - DNA, 174 bp, Homo sapiens
agccggcaccgtctattactttctcggtggtctcatatcccatgtcggccattatgaaggtctcctcaaggttctcatagaaatcatcatctatgtgggaagcaccaaatacatcagcaaagctctccacgatattgtttctagtctttgcaagtccttccttgagtcttgcaa

SEQ ID NO: 494802 - DNA, 217 bp, Homo sapiens
  misc_feature (85)..(85): n is a, c, g, or t
  misc_feature (94)..(94): n is a, c, g, or t
  misc_feature (105)..(105): n is a, c, g, or t
  misc_feature (118)..(118): n is a, c, g, or t
  misc_feature (147)..(147): n is a, c, g, or t
  misc_feature (160)..(160): n is a, c, g, or t
  misc_feature (174)..(174): n is a, c, g, or t
gctgaggaccctataaatgtggcattgatccactacaactccggccaagagtaaaaacgccgaggagactattcaagacgccttnagtcgccgnctctttgcatnatgagctgcattntatttctcaattggtaattctcgtaattnagaatttcgtacngtgatactactatnatagacaatcatattctctatatcaatgaccaacaatttattg

SEQ ID NO: 494803 - DNA, 561 bp, Homo sapiens
ccgctctagaggatccgaagctgctaacaggatacttgacttcttcctttcaattggatacctttatttctttctcttctctgatagtctagctaaaacttcctagctatgttgcataatgatggtgaaagtgggcatccttgtcatgtttcatatcttacaggaaagactttcagtttttccccattcagtatgatactagttgtgggtctattatatatatgtagaggtatgttccttctatccctgctttttcagaggtcttttattgtgaagagatgttgaattctatcaaatgctttttcatccatcagttgagcatgataataaggtatttgtccttcattctgttgatatgatgtgtcacattgattgatttatgtatgttcaaccatccttgcatcccgggcaataaatcccacctggtcatgatgactgatctttttaatgtattatcgacttgggctcgctaaatatcttgtcgaggatttttgcatccatattcatcagagatgctggcctctggtttactttctcgatgtgtctttatctggttagggc

SEQ ID NO: 494804 - DNA, 814 bp, Homo sapiens
atacaaaagaaagatgcctgctgtcaccattttatataacatactggatgccttagctaatgcaagaatgccaaaaaatcgggggaaaaggaaaaatacaaagtatagtaaagaaggaacaatattattactattttggggtgattggggggtgtgtgtatgaaatctagtgaaacctagagattaattattaaaattaataagagtaaaacaagattgctgaattcaaatatctaagaaatctttcgtattcctgtttagaatacaagatagaaacaatcaggaaataaaattttggaaaagctgtaacaccattatagaagccccaaaacatatcaagtacctaggaatacatttaataagagaaacaatagctgaagaaaatgtaaaacgttagatattaaagaaaaatcaattaaaaagatatatggtgtggacaaaggagtattatatttatagagtacaacttcagtcagtatctcagtatgtaacttcttatagaactttatgacgtgattctaaaatgcaatgggttcagaggtcaagatactctttaatctcagtgaaacaaaatggaaggaatctgccatcagacgttaggatattacaaacgctacagtcatagcatagcatgagattcggcattgcgctggacaaaatagaccagtgtaacagctaaaagagtccggaacaccatgtaatgtactgtctatgtgatatgtgatcggagaatctgcgtggccagcacgccaatttgggaaatgacttgactttataaatggaaccatcttgtccgccggcacgcccgcgcgca

SEQ ID NO: 494805 - DNA, 152 bp, Homo sapiens
gtgctgcgtcgttctagaggatcccgggcagtacggatgtgccaggttggactgtggctggccagtgactgtatatgaaactgggacaaagcccatcttgggcacgtagcctgtggggtggcaggtgctcaggcttgggtgacagggtggat

SEQ ID NO: 494806 - DNA, 112 bp, Homo sapiens
tataacctctttaatgcgtgaaatcataagaataatcatcaaaggcaagagggttgggtattttcccgttggagacacatctggaatttgctgcaataaaataataataaga

SEQ ID NO: 494807 - DNA, 979 bp, Homo sapiens
gccggggcggggatcgggcggcgaccttgcggcgtgcggcaagcgcccctgggcccgccgccccctcccctcctgcgaggggagccgctgcatgtgggccgggggggcggcctctgcggtcgcggagtcggcgtgcgatcggcgtgcgggacctccctccagtggcgggcatggagtgctgatgcccgggttgcgcctggggcgtggggctccgtggtggcgtacctatgcccggaggcgccggtccggtgatcgaggcactggctcgacgggcccgggctgcgctgatgctccaagttgcgtggtggtcggcgacgagggcgcggtgggcaagacttgtgccgtacgtcagttgagcttatgcccaacagactgcctttctccggagggagtagcagtgccctagccggtcttaccgaatcgacttactggcatgctccaaggcgggtcacccgatggagggggcaaaagcgagtaacgcatccgtaaggggaaaacttcatattgagcatccggggacctgagatcgagagatagagaggcttatttgagcccgttcttgagagggccccatattacatcttaatcccgcaaaatgatcgctgacatagttactttccacttaattatttgccttatcatcacgggagtgggtaaaaagtcccaaggcccatacaggttattccagacgacaattggttaggacaaacgaagggagggcttgggggggtaaccccggggaaaaaccctattaaacggcggacacttacggggcagaggcccaagacaattggtttaaccccccgtagtctatcaactatcaagagttaggggaaaacgatccgagggaattattgaagtcgttcccggaagaaattggaccccccgaaaaaaaacgtatattagggcaaaggaacccttgacagctggactagttgaaaacaggaacaaaaacccctaaaattggtggtaggaacac

SEQ ID NO: 494808 - DNA, 164 bp, Homo sapiens
tctaaagaaacacacacacatttattttaaaatttgacataatccttgggcaattattagcatttttcagaagtttccgacactgatatctcaactccaaaccaataacaatagcttatttgattggtggaaggattatagaggggcccatgatccagatgaat

SEQ ID NO: 494809 - DNA, 148 bp, Homo sapiens
tatcctgggcagcttctagccttctggaataggatcatggtgggacctggaatctgtattttaatggaccctaatgagattctagatgtagaaacatgtttgagaggcaatggacctcatggacttcttccaaacttatggagccatt

SEQ ID NO: 494810 - DNA, 275 bp, Homo sapiens
cggggggaaaaaaccccggaaaaaaggggttttttttttacccccaccaagggggccccgtgaggggacaattttttcccctttttttgccgggaaaaaaccgtttaattttggccccataaaaaaaacccgggggggtttaggggtttttaattggtttttttcccagggggttttttttttaaagttttcccccccatttttttttttgggttcccaaaaaattttgaaaaaaaaaccttttttttttggggcctttttaaaaaatttggggg

SEQ ID NO: 494811 - DNA, 517 bp, Homo sapiens
  misc_feature (19)..(19): n is a, c, g, or t
  misc_feature (47)..(47): n is a, c, g, or t
  misc_feature (405)..(405): n is a, c, g, or t
  misc_feature (488)..(488): n is a, c, g, or t
  misc_feature (510)..(510): n is a, c, g, or t
atttcggcacaggggcagnatacgcgccattgcacaccaacctgggngacagagcaagattgcatctcaaaacaaacaataataataaataataaaaacctgatatttggctgggcgccgtggctcatgcctgtaatcctaacactttggaggattgctggagacaggggtttaagaccagtctgggcaacatagcaagaccctgtctctacaaaaaaggcaaaaattagctgggcgtggtggcttgtgcctgtagtgccagctatctgggaggctgaggcgggaggatcactagttcaagctgacagtaagctatgattgcaccgctgcactccagcctggggtaacaaacttaagaccccatctctctgttcttcaaaaaaagtgattacttcgcaaagatgntttagactccaagaagctttttgcatctcttttccaacccaaccattgaggtactgtgtaggctcctccttgaataattaacngggtgagctgaggttgcggccnttgcatt

SEQ ID NO: 494812 - DNA, 808 bp, Homo sapiens
tagtattctggctcacgaagagacccaggagttgtctaacatcttcagcatgtccgtgtgtcagcgttcacctgtgctgagtagctcgtatgggactgggtgtcgcgagaggcacaagtgactgatttcccgtggtatttgatcgagctcgactgcaccttggggtaagactctaccgggagaggttatgaatcggctttggggctccagcatggagggacgtagccatcctgtagtcctcgctagagatccccgtaagcttacatgtcgaatcgcgcgggggacatgtctgctggcttttccacgactcatgtgctgccgcgggatcgtatcttggcaatagagtcgtagataatctctagtaacatagatcgtgggacaaaaggtttggaagatcattaatctctgtggcttgctgagtgagagagaacactcgtcggtggtcttatttgaatgctttttattgtaaacctgaaagcaattggctcattgaataggggggagctggggtaacgaaacacatgaggagataagggtaggctttgaacaggaaaaaactttatttaggcattgatatggtaccaacgctttgaaaaagataagctagccgtaaggcccaatccaaaaagttaactgttttgaattgcacaaggtagatgaaagttagtgaggcgcttcgaaaagtggggccctcgggcatagggaagttgtacccggtttgggggtatggggtggggggagccacaccatttttcgaaggcggggttaaacttaagggcaaaagggttgggaaaatgggtaaggcgga

SEQ ID NO: 494813 - DNA, 321 bp, Homo sapiens
agacagtcttgctttgtcactggagtgtaggggtgcgatcatagctcactgcagcctcgaatccttggactcatgtgaccctcccacctcaggctcccgagtggctcagaattcaagtgggtgccatcattcccagctattttttttattttttgtagagatggggtctccctatttcacccaggctgctctcaaactcctggccacaagcagtccttctgcctcagcttacgaaagcactgggattacaggcttgagccactgtacccaactgctcacagtaccattctaaggataaaatgaattaagaacagtacaagt

SEQ ID NO: 494814 - DNA, 1232 bp, Homo sapiens
gataaacctacgcccaaaccactccaccttactaccagacaaccttagccaaaccatttacccaaataacgtataggcgatagaacttgcaccctggcgcaatcgcatctagataccgcaagggacagatgaaaaattataaccaagcataatatagcaaggacttaaccccatatcacttctgacataaatgaattaactagacatacacctttgacaaggagagaccccgctaagaaaccccgaaacccagcacgagctacctacgaacagctacacacgagcacacccgtatattgtacgcaaaccctagtcgggaacgactcactacggtagcgagccgaacagctaccggagcctggcagactagcctggcaagcaccacacactagcaatcaacgagcaccctcacacccatgaggccaaacagaaaacccatcgaaacatgcccctcggcgacaacgtaacatgacacgcaccacaaagaaggacacacggaatcacaagagcacacacagggacgcacaaaccacgggatagccagcacgccggctccacacaacaatacagaaagccccacccaatacggctagcggcccctcaaagaaggacaagacccaacccaaagaggaacggaacacaggaggatcgccacgaccgtccagacacacccaacaaagttaaccgttagagaaaatcgccccacacagccaattcttaacatgggcaaactacccgtcgacacaacccgccaaaattgtgcggaagcacacgaagtcgtaactcaaacacacgctaatatacgagacagagcaacactcaacacctgctaccagagcacgtacacaataaacacttgacaaacaaaagatcacgtcgccaatacccgaccaaataacggcagccatgagcagtccaaaaaaataaaacacagacaacacatcgacaaccagcaacaaccagacaaacagcgaccaacaagtaagacgagccgaagaacgaaggcacaaacaaacgcaacaagcagaagaaacaacgacacaaaagggatacacacacgcaaagacacaaaggggacagagcaccaagaagaacgcgacaaagggcatacgaacaccagaacacaacgagaccaagcacggcaccagacaccaacaaccacagcaacagagaagaacacgaagaagaagacggacacatacgaagcaacgcaacgagagaacaacaacagc

SEQ ID NO: 494815 - DNA, 208 bp, Homo sapiens
gactactagaggatccgctcttctccctgacacgtgaggtgggatctttacctctagatgagatggtcatgaagtgagtgtcctggggagaatctaagccctccgatgtgtgttctaaagttgttttatgctataattattaccatttttaatgatgttgtgtgtcctcccatttgttcagtgagacggttaaacctttcccccactc

SEQ ID NO: 494816 - DNA, 137 bp, Homo sapiens
actgcgtatgaaaaacacacaatcaccttattgtggcattgcgccgtacattcgagagtatgaggaccctcgagatgtccctcctccaactcgtgctgaaacccgagaggagcgcatggagtaggaacatgacgggc

SEQ ID NO: 494817 - DNA, 896 bp, Homo sapiens
ggatatcatatacccgtggaacataagatgatattgggactgcgcgcaaatataactcttgtgagcaaaaattgggcgactcaattgcacccctctgtgtgaggggcccctccacattttgccgtatggagccccgtcctctttttcgggaaacacgctctctctcccgaatgccaaacttctttccggctgagaatctaaaatgttgtgggaaagtcaaactatagttctgcttacagaaggaagctttgtctgccctgattaactttattggggttccccgcccggcaagaaacaagttgggcgagcccggcggaggcgagaaaaaacattggcgacgcacgaaaaagagttggcaaccaaggccacgaagggtaatggtgggaacgtttccgtaagaggccccacgaagaacgacggtacccccccgcccctgtcggcagctgccaagaagaagcagacacgtccccagccgacggtaacacttgtggcggcagggcacccccaacagtaagtatatggcggtacactctagcgaaacccaagcgggtctaccaaagcaatctctgatgagaagaggaccccttgatattctctgaggaggcacccagcctggcagccattctccccagtattggtatgcagcacgcagaggctagattccccaagaaaaagagggtgccagctcatgatggctgttcgagaccgtagtcagacaataaccaggcggacatcccctggggggacaaaaaaacaacaagggagttatcatttcgagagtcctcctacaagcagtagaaaattcattgagacaagttcttttctacagggaggaatattacgacacacaaaaatttccctttacgaaagcccaccgagaaacccccacataacga

SEQ ID NO: 494818 - DNA, 416 bp, Homo sapiens
cactgtgtactggctgctcaaatggatatcagcaaactgtcaaatgaaatggaaaaaaaaagtgaaacataagtctctactagatggaattacatttatggcataatgaaaattggggactacctcctataccactggaaagtacccctgtgtgcaagtattccaaaaactattagatagttaagagctttttttttctttttgcttctacttcacttatcactttttcctttgttttcttgactagtgaagtccctctgcatgtgggaatcagttaggtgtttgcagatatagagcgagggtaaattattatttatttcacttttaaattccatcctaatttgtatctacgtggtataattcaactgtaatttttccttgaattttgctttgtcgtaattaaagttaagtaattt

SEQ ID NO: 494819 - DNA, 501 bp, Homo sapiens
  misc_feature (440)..(440): n is a, c, g, or t
caaaaggtttattgaaatgcctgtagataaaatatgattatcatgaaactgatatggcgtttacaacatggggtcttttgctcttaaaatgaagtgaagctccccaagtccattgaccaataggaaaaatattatatcatcctgttcagataaagatctttaaaaaggtaaatctcttttgaaacggtcttttaaacgtgtccagcccgtttggctccccccaggtggagatgctgtccttctacaattgtgagtctgatgaatgggattatctgaatagtggctttcttcatggaataccacccggttccacaagtcgcccaaataatgcccttatcataaccattacgagtagatgcttctgtgtgagtgccaccttggtaataaactccatcgagatggacagcgtgacactggtttatacaccaaccagatccatnctgttcaggacaggtgccaataaacttatgattgtcattgtcccaggtactgaactgcatg

SEQ ID NO: 494820 - DNA, 100 bp, Homo sapiens
ctacaacctctctgctcagacagtacacattgatacaacttatcaaagccagccctctgtatgtagccatttcagcaaaataagccaattatgggttagg

SEQ ID NO: 494821 - DNA, 275 bp, Homo sapiens
gcttgcctccgcaccacagatgcttgtcttcttgtgattgttaccgtataattgtcaagccaaaggtttgaatttacacgtggcatcggcttggtattgataatttgattcaggattctgggttctaaccacctcctcttgcctgttcacttccttgcacccgaacacaatctttaaccccagggggccctccagtcatttgaccagaccgtgtgttcctaccacctgtgctcatccctcctacacagcattgtattttaaagagtgcgctcata

SEQ ID NO: 494822 - DNA, 160 bp, Homo sapiens
  misc_feature (92)..(92): n is a, c, g, or t
tgatccaactcttcctgtgtgaaaagaagaatgatggcaggaagaacataaagactttaaaactcctagccggggtttgtcggactctttgncagtagtgatttagccaaccaggcaacagagatacgatctaatctcctcgcccctctttcgggtcgcg

SEQ ID NO: 494823 - DNA, 320 bp, Homo sapiens
gattgtctccctcactcactactaagaatggccttctggtcaggcacggtgactcacatctgtaaaccttaaactttgggaggccaaggagggtggatcacctgaggtcaggagttcaagaccagcctggctaacatgatgaaaccccgtctctactaaaaatacaaaaaattagccgggtgtggtggtgggtgcctgtaatcccagctactcaggagactgaggcaggagaatcgcttaaacctgagaggcagaggttgcagtgagccaagatcacaccaccacactctagcctgggcgacaagagcgaaactccatct

SEQ ID NO: 494824 - DNA, 111 bp, Homo sapiens
gaaatattatactagcatttaccatcttacttctaggaatactaggtatatcgctcacacctaatatcctctctactatggcctagaaggaataatactaatcgccgttca

SEQ ID NO: 494825 - DNA, 361 bp, Homo sapiens
cgggagcgtatgttcacgggtgatataatcagctagaccgagtatcgcgccgggctgtgtgtggctctggggaacctgtcaagcagacccatcctggatagacgggcaaggtatgtgatgccagagagtcatacaagggttctggacaagtatgaagtctttctgccatcgtgtcccggaagcggtgactggaaggggtacacatggcaagaccatcacggacgccatcaacattggcattggcggctccgacctgtgaacccctcatggtgattgaaagcccttaagccatactcttcaggaggtcccccgcgtctggtatgtctccaacattgatggaagcgtcgcgcatgggtaccga

SEQ ID NO: 494826 - DNA, 411 bp, Homo sapiens
  misc_feature (32)..(32): n is a, c, g, or t
  misc_feature (42)..(42): n is a, c, g, or t
  misc_feature (71)..(71): n is a, c, g, or t
  misc_feature (86)..(86): n is a, c, g, or t
  misc_feature (100)..(100): n is a, c, g, or t
  misc_feature (215)..(216): n is a, c, g, or t
  misc_feature (231)..(231): n is a, c, g, or t
  misc_feature (237)..(237): n is a, c, g, or t
  misc_feature (411)..(411): n is a, c, g, or t
attgaatcttttcctttctatgacgatattcnctgtctccanacttctgattccaacttgtaacccatcgntagaaccaactcaanagtccatctcttcntgcagagcggtaacctcaggcggctgcccttctccctgcgtgacaccgcgtgtgtgcctctgccattgtcttagcatgctcaactggaagttggcttctgtgaacccttgcccannggtctccttttccangaccantgagctcaagggcatggacaccctcattcttcctggcactctacccactgtgggttgtggtttaatttttttttctctggaaagactatttcaggtttctcctggaccctctttaggttttttaacacaaattgggccccacattttctcaacaggtaacgggtgtaactcgtn

SEQ ID NO: 494827 - DNA, 426 bp, Homo sapiens
ccataatctccgtgctacttttaatcactccgtaacaggcctttttcactcgacatgcttcagacttggtgttcccaatgtcggtctctttcccctacagaagtcattgtcgtcaatcatcctttctgctgacagtcacctaccattttatacactaatgacctccaaatcctcatttctaattcaatcaccttctgcgttccagacaagcatgtccagcttcctccagctgaatgccctcacctcgattcactcagtggcaccaacagaacaacaaaaattcgctgggcttgatggctaacacctgtagtcctagctactctggaaggctgacgcacggcgaatcccttcagtccaggagtaggaggctgcagagagcaatgattatgccactgtactccagccaggacagcacagcaagaccct

SEQ ID NO: 494828 - DNA, 1559 bp, Homo sapiens
agctggttgtacaagtatagaatcttagttcaagcttataaatttggcccacagaatcctctaaatccccttgtaaatttaatctgttagatccaaagagggaactagctctttgtgactaccaggtaagataaaccttgtgagcagagagttaaacaaattattaacgatcccatatgtaggccttaaagagctagccgaccaatttaagataagcgttacaagctacagagaactgcttacctataaatgattcccgaaaacagtataacgtgaactctgatcacactcgcaatgttggaccaaattcgtagtccacccgtatagagagaacataattgtttaggatagtaaagtaagcaatgcaaaaaccaatttcatccatcctggtagttaaagcccctggctgtcaaagaatcttaataacgacatgacacatggacgcaagtgtaaccacgcaccgtatataatctttacgaaagtcttaatcctagacggaatggtctaattaattttacccccatcgacttagtgcaaaatccctaagcaactatgtgcaaattgctgccaataatatgggtacacagggttccacaaacacacaggtataacacagcgggaaactactgcgtcgggtaaattctatgaacacacactggcactggtttgtgaatctaaaaaaacactagtctgaccctttcaattagctaattcgagcccaagattacaatactatagaaaaattcagactaaagacaaagaaacatagataaaaatacgagacaagaaatccaagcactatcatagacagcgcaggttagcgtaacacttaaaagaaacaggatagacaacaactatggcgcaatcgaaatcggatcaagcaaaatcaacacagaaagaacacagaagaccaatttccacaacactacacaattatgccacacttcagatttcgaaagaccgaactaccacatcaaggcttcacacacactataaccagtacaaacagcgaaccgataatcggcgacactattacacagtcgccaacccgataagaaaaacaagtatcatagtcaattaccctcagcatacccatgtcaaccacagcgctaacataatgacaacaaacacaggacacacatgacagataagacactgtcaagacatcaccacaacaaacacaatttgaccaacctggtgtacaactacaacaggcggacaacaataaacaacacaaagacacagacacaacaagagcacgataagaaacacatacacatacatcaccaatatagaacagcagaggaagagaaacccaaaaaacacaagatcaagcgaaggaagaaaaacataggcgaaacagaacacaaggaccacaacagacaagcagagcacaacagagaaccaaccataccgacaaccccacaacacacaccacaaaaaaaaccacacggagaattacaacaaggaaaacaaaaacaagagacagacgacaaagacaaagaactaagaaacaccaaaaacaaacacaagcacacgacacataaacaggacaaaca

SEQ ID NO: 494829 - DNA, 177 bp, Homo sapiens
taacatcaatattgaccttagtttcttacacaagtgttgctaactcaatagtgaaggagacattattaaattttctgaacccatgagagatactagagatggggagtagaaagtatttgattcagagatatctgaagaacagaagaccagagattcctaaagtcacactccactcca

SEQ ID NO: 494830 - DNA, 676 bp, Homo sapiens
  misc_feature (3)..(3): n is a, c, g, or t
  misc_feature (82)..(84): n is a, c, g, or t
  misc_feature (91)..(91): n is a, c, g, or t
  misc_feature (93)..(94): n is a, c, g, or t
  misc_feature (129)..(129): n is a, c, g, or t
  misc_feature (140)..(140): n is a, c, g, or t
  misc_feature (152)..(152): n is a, c, g, or t
  misc_feature (154)..(154): n is a, c, g, or t
  misc_feature (174)..(174): n is a, c, g, or t
  misc_feature (178)..(178): n is a, c, g, or t
  misc_feature (183)..(184): n is a, c, g, or t
  misc_feature (189)..(190): n is a, c, g, or t
  misc_feature (194)..(195): n is a, c, g, or t
  misc_feature (218)..(218): n is a, c, g, or t
  misc_feature (223)..(223): n is a, c, g, or t
  misc_feature (228)..(228): n is a, c, g, or t
  misc_feature (230)..(230): n is a, c, g, or t
  misc_feature (232)..(232): n is a, c, g, or t
  misc_feature (236)..(236): n is a, c, g, or t
  misc_feature (256)..(257): n is a, c, g, or t
  misc_feature (266)..(266): n is a, c, g, or t
  misc_feature (268)..(273): n is a, c, g, or t
  misc_feature (275)..(275): n is a, c, g, or t
  misc_feature (540)..(540): n is a, c, g, or t
  misc_feature (672)..(672): n is a, c, g, or t
ggnattcagagcttacgcgtaatgatatataacaatagtagatagtatgattaagatagccatatgctgctatcaaagaaannnagagatnanntattattaaaagagaaggaaccacggatgatttgnggttatggccntgcagccttctngngaatcttaaaaggaaaaaanatgncgggnngtctnnagannctggaatgatgatacacgtacanaaatnactgnantnttcncccatatatcccttacggannaacaagtanannnnnntnttttttaaacaattcgacaataaaaaagtacaattttttttgtgctaaaaaaagggcaagacaacataaactccagttgtaaggactccatttgcatacttgatttaacactttttggtgctgcgaaggaaatgggactactgggctgttcgcagagcagcaacataatattagtgctttaagtaccagaaaccacccacagctttgtgcgcgccaagttgcgcgcgatgcgcaaagattcaagagacttcatttttagcttgtnacttgtcctaatgatagtagaccaggaagatccccatttaatagtacattccccatttttaaaaaaactgatgcctttttttttttttttttgtaaaattctgtatgtatgttaccattttttttcacatgntaca

SEQ ID NO: 494831 - DNA, 345 bp, Homo sapiens
  misc_feature (78)..(79): n is a, c, g, or t
cttttctgaggctcattcaggcctggtcccaccctggagtttctcctcacagaactcataagaggagaccagagattnnggaggtggcttctgctgcctctccagagcttatgctcacaatattctgaaacccaagagcagataaattagagcaataagctatatatttggaggtcttaacttctttcttttgaattaaaaccagtgcttgtagagacattccatcccagtagttactccacaagtcacaagaaagtaaagaacacaataaaagttcctttaactgcacttaacctttcctttctgtatcctccatctgtctacatttatcacttatgctataca

SEQ ID NO: 494832 - DNA, 122 bp, Homo sapiens
  misc_feature (48)..(48): n is a, c, g, or t
cgatcagctcggcccgcttataggttgtttattttaatggctgatctnatgtacacagaggccagtatgtacagacaaagtgagaggttttatttcttggtctcttcctccttggataaagt

SEQ ID NO: 494833 - DNA, 353 bp, Homo sapiens
actacgtctttgccatgcgaattttgctcgttgctgccttggccgtcagtgttgtcggctgtacccgctggtcgatggaccaccatttgaacaagcgcttaccgtgcctatggggtcggtgattgccagcgtgtcaccctggagttgtcccaggtcgatcgcgagagccgcactcgccgctacgtgcaaccggaggtttcgacgttgcgtgggcagtgcctggaacgccagaaactctttgtcgatgccgcacagacctatcagttcatcatcggccactacccgtcgagcgagtacgcctatcgagcccgtgcgcggctcgataccttgcagcaactggggcatctgccggc

SEQ ID NO: 494834 - DNA, 182 bp, Homo sapiens
tgtcttcgctgagtgagtggatactcggtcactgcacttctgctccaggtcaagcattctctgctcggctctgagtagctggattacaggtgcggcacaccggcttattatatgtatttttagtagacggcagagtttcaccatgtagggcaggctagtctcgaactccgtgactcagatga

SEQ ID NO: 494835 - DNA, 299 bp, Homo sapiens
gaaaaatcacttgctgacatttcaaatcaaaaaaattttacataaaagtctaaatttctgcattttcttgaaaaataggaagatttgtcaagagtaggttagtgttcccacgtcagctggagctgagcagtagctgtcccatgtcagcagggtcatgctacacagtgtcagggtgagtctgtgttctggttttcctgggacagcttggtttgttcccactgacctagcataattattaatagcatccccttttcttctgattttgagaagttttatatattcccttctgtcgtcttctc

SEQ ID NO: 494836 - DNA, 255 bp, Homo sapiens
  misc_feature (227)..(227): n is a, c, g, or t
tttttcaggttactagttaagtatgtattttgttcatcatttaattgtatacatatgtgcaaaatgtaataataagaaaatagaatatctttaatagtaatttatatttggaacataatgattttcatagtgtagtctggctcactattatggacttttactttgatttcagaaggatttgttcattaagttggtaatgaactgccaatggagtagaatgtttctangtagaatctgtgaagtgtaaatgtattt

SEQ ID NO: 494837 - DNA, 1176 bp, Homo sapiens
gctttccaagggagtggttgtgtgatcgcgcatcttagggaaaagatgttgctcgtgtcgtggcgcacactggtcgcgggcgaaccccgttcagacacgcccgacatctgtcgagcgtggtgcacagatggtctcggtggacctccgcagcagctcggcccagggcccacgggccatgacccgccgccctcggcaacctggcagtcgccgccgtggaacgagatacagtgtgtgaattcaggtctccgcgaagtattatgcactgtgtggcttctggtgggtgtcttaagtatgtggtctgatcacaccactgactgtggttgcccctggatttacgtgaaatgccgtatgcagggtggaccctccaagaagtacaagggcatactctaacggatatctcgagtgtagcatcttacaccgaggactggtgttacgtggtttggctaaatggatgggctcccgacttgtcctttggcgtacttcccgatgccagggacgtcttgctacgtgtcttggcttggtcagtgcaagctcctcttaagagctcgtggataatagccacataatgccttgcgagaaggagcaacttactgtagttctcgtgggcgcatatcacctaatattttgggctgcctcgtgccagtgcttgaatttcttggtgctggacaattggcgcctggggtccttatgggaaggcctgctaacgtgcttcggaattaccaaatggcgcaatcccaaggtaaaggggcaagcgagctctatgagggggacctggcaggctcccccagaaattgtactaacagggaaggcaaggggcctaaatagaggcattttctaacaaacggcggggtttggatccatctactgggattgagcaccatggataccccagttacacccaatgtagtggaagacgtcccgacgtggacttggagaacatgtacttgtttggaaaccaccgtggtaccaacgttttgggggggtcccctaaagccccccgacacgcttggcacttgtgtccaaacgcgcacgaaggcaggtagagttggtacaccatttttgggagacgcggggttcatataatctctggagagtctattaggcggcaacattgtgtgcttcacccctgggttaggtacttaggggaataattgccgttcgacttaataagacatg

SEQ ID NO: 494838 - DNA, 362 bp, Homo sapiens
ctatgcgcatatgattagtaggcatcgaggttatagacccggtgatgataagacgatgccacaaggtgccactggagaagagggaggacagcccaatggatagaatctggaaagacagccacacgtttccccctctgattctttaattcacccacaacatatgcccatggtgagttcttcaattgcaggcttattggtacaggaaatgagctcttgctcgagatttaagacggagtcaaatcatgggtctagccctaatgatgagtaactgatggtgaggatgagagttgtgacagtgctggtggtcatgaggaggatgaggatgatgaagaaaaaaactgcagtcacaaggacgattctcc

SEQ ID NO: 494839 - DNA, 191 bp, Homo sapiens
aagacgcatactcaggccccgaaatgcacagacacacagcatcatatgctaatgaggaattatcagcagatggtttataaaacatggcatttttatcttcttcacattttctgataatacaatggatgcaaacacgtcatgtggccgctctgaatggccacatgactcggtgtggagcttcggcgtgtgca

SEQ ID NO: 494840 - DNA, 1114 bp, Homo sapiens
  misc_feature (109)..(109): n is a, c, g, or t
ggtttggtagtgtgcgtggctgaatcacacgctcactgccgcctcgatgtcctgggctcagatgatcctccggcctcagacctcccaagctagactggtatcactaggntgtggcactgccaatgccgtggatgaatatattgttggagttgatgctaggaaagcgggatcggagttctcagccatgattgccgcaggacttggtcttgatccctcctagggctcaagtctaggctgtcccactctcgagacctcccacaagtgtgcttggacacttactcggtcactgagcgcactagcgacagcgtaacacctagcttcttggttggacttttagtttactttccttaggacggacaggagtcgtccgtctgttggcgtcagacgcagaggctgggggagcttgcagctggatgaaccatgcatggatgtcagctgggcagcccattaaagctgcctgggttcgtcagaatggatgcctgccagtccttgcggcctcctcataggtagtctggtaaccatagggtgacgacaatcacacgcgattgcccgaggcctcagaattatttggacatatcttttttctcgatgaggcagataggggggtcctctcgcattactagctcctagcgactggggcttccccaaagcgtatcatggcggtcgacgaattgatgcctccttggatttacagaccttgtccaacgttagcttgggagaccaagcaggcacttgtagcaagcgagtgccattgggcgttcctaatactttccgcgtaggcatgtctgggggggactcgtttgcatacccatttgccccaggtgcttgatccttcgagagcgtccttgaggttcacacgcattgccgtccccggatattccaggacttccgcaaaaaggttggcctagttacatctgaccctgggcctagttggaggcgcatcgtttgccagcccccatggtcgtccaaggctttaccggcactttgcggctttggggttaccccagtggtgagcggacattggtctcgccccgcggttcgccccccgggcaggcgcggtcgcccgcgggcgggaccctcgcgcgttggctctgtttgaccctcgagacttccc

SEQ ID NO: 494841 - DNA, 203 bp, Homo sapiens
agtaaacaaccaggaaaaatccaaagagtagcaagaggatcgggtgtatcaacaatgagatgtacaagaacttttgacacaatataccaagtttgcacagatggtaaaaaagatggtgaggtatctgaatggactttctcaaacggtaggcgacatagtctaacgaatagtgagccagatcacagactggcaacaatatgaac

SEQ ID NO: 494842 - DNA, 215 bp, Homo sapiens
acagcacacactaacacagcacacacaaacacacagcacacacataacatgcacacagcacacacatgcacacagcacacacatgcacacacagcacacacactcatgcgcagcacatacataaacacagctcgcagctgcgttcatgtatgtgctgcgcataagtgtgtgtcgcgagtgtgcatatgtgtgccgtgtgcaccgtgtgtcgtgtg

SEQ ID NO: 494843 - DNA, 1052 bp, Homo sapiens
gattgatcgctgagcaaacacaataatcttaacgcataccaacgccggcgcatggtggtgcataccctgtggttccaccactttgggaggctgaggtgggctgatcacaaggtcaatgcagttcgagaacaacctggtcagcatgatgaataccccgtttctactaaagaacttcgaataattatgtggtgccttgtgctagatgcctggtagtatcactcgagtgcatgcgcgagaggcgtcgtagtcatcgagaaactcggttgacagacgccaagcatggtgtcaccgtttgcggttagcaccagtattgtcaacagatgacgcctcgcattctggttgaacacagttcaggagtgccacctccctgcatagaatggcaacatgaggtcatcaagcaagatcaggactacgactgtcaatgcttgaggagtccgggtccactggggatcacagacctgctcgaggcgtgggcaaggtggagccgtccacgaactcttggactctccacccacgatggcgcagttccgggggcctgattctctgaaaggaaggagggccaatccattgcctggagggccaagttgaagctctgcctctttgagggtggtacacggaggcctgcctcgaaaaagatccccgatttccggccgcggcaaggcatgctgctgaagcacaagttcgtcacacgctacatcaagaagactccttctcaaggaggctcatcgaccgtataagcgctggcatgtcagagggtcctggcgaggagtcagcgtctgaggactcttaccattgatgggagggtaagaaggggagcgggcccatctgggtacgcctacatcgacgggtcacaccgaagcttcaaggggagggcgccataagaagcttgcgggcgcagagagggcaggtcagcgacaggccgcggattgaaaccagagaacaaaagggaaacggtgcggaagaactcgtcgggccggcatcaagaggcggtggggttacaaacatccgccatacaaacttcaagaacgtgaagaaccccggctccccggccg

SEQ ID NO: 494844 - DNA, 99 bp, Homo sapiens
cccttttctctttaaactcttcgtctgtccttttcgtttcttcttttcacttttttttttctcctctcctaccccccccggcccttctgtcgtcttctc

SEQ ID NO: 494845 - DNA, 668 bp, Homo sapiens
gtcgtaagggcggtgcccataaaattctagccctcgcctactccgtctaggactcggtctcgaaggggtcatgcgccccgtctgcggaaggcaatgatttttagggaatagttctaacgcactatggacgggcattagactcctacacctacgtagaagatatctcttcgttccctcactccggggaaaaggatgacgctatccacgtaacaaagtttatccgtcggttggggtccgataccaccttccttcgctcggtctcgtattgcaccgaaatcgagccaacgggtaaacccgacgaaggcaaatcgtttattgacttatattcgacgtcttgatcggttaccgaaatcgccgtctacgatcacgacgctacagccaccgatagtgtgttcaattcgggcactggtatgaccaacgctgcacgcgtcgtcgacgcgtcgaccgcctttatgttcgtcgagccgcccgatcatattcttgtatcgtagccccctgacacgtcctgcgactcgtctaagaatgccgactccaaagggcctgagttcgacgcatgcaccccgtccattaaacatagtaacagcaacggtctctagcttttgcggacggaggaataaacctgggacgttcgggggaatacggcctcaaaaaaagccgcatgcgaaatg

SEQ ID NO: 494846 - DNA, 354 bp, Homo sapiens
ttaattaatacccaagagactgacaaaatatgtacacacaaaaaatatgtgcttcactgttcatggaggcattattcataatagtaaaaaaaaaaacaaaacaaacagaaaaaaaaaaacaccccatatgtccaactgataaatgaatactcacactgtggtccattcatatgctaaaaactatacagcaataaaataaatgacatattgcattaacttacactacattggccaggtgtggtggctcatgcctgtaatcccagcattttgggaggctgaggcaggaggatcacttgaggtcaggagttcgagaccagcctggccaacatggtgaaactcgcgtcagaatagata

SEQ ID NO: 494847 - DNA, 114 bp, Homo sapiens
agtaagcaaaacctaggtgtgagcccggcccagaggcgctagcagtgggaccaacagtagatggcggcaacatgcttcaaccagcaaagctgcagcctcctggaaggcggcaag

SEQ ID NO: 494848 - DNA, 408 bp, Homo sapiens
cctgcttgaacagcgcttggacggaacacggcgctcgtgccacacaccgggcgagcgcccatagtcagccctacgagacctcttgaccggaccctgggactgacccaaggcctccggcggcgctccagcgccgggcacacaccgtcgccgccgccgtctctgcttagacgacgccatgacgaccgcgtccacctcgcaggggcgccagaactaccaccaggactcataggccggcatgaaccgccagatcaacctggagctctacgcctcctacgtgcacctgtacatggcttactactttgaccgcgatgatgcggcttcgaagaactttgccaaatactgtcttgaccaatctcatgatgagagggaacatgctgcgctgatgaagctgtagaacccgggtggccg

SEQ ID NO: 494849 - DNA, 316 bp, Homo sapiens
cacgaggagaagtgaaaaattacagatttgattggcatagatgcgattcggccagatgtgtctgctagctagcagctatagaagttagagtgcttttttatgtatttatttattttgagacggagtttaactcttgttgcccaggctggagtgcaatggcgcgatcttggctcactgcaacctccgccccacccccacccccgagtacaagagattctcctgcctcagcctcccgagtagctgggattacaggtgcatgccaacacatctggctaatttttctatttttagtagagacggggtttcgccacgttgg

SEQ ID NO: 494850 - DNA, 458 bp, Homo sapiens
ccacttgccagctgcaactttgacgcatattatcaggataggtgagattgatgggggccctttgaactcttcccagggaattatctttataatgttacagttttctctatagcatggtcatattgttaacattggttataaggtcatatggttagtatggttagtattggtggctcacagctgtaataccagcactttgggaggccaaggtgggaggatcacttgagccctggtgttcaaaaccagctctggaaacatagcaagaccttgtctctacaaaaaaaaattaaataaattaaaagattagctgggcatggtggcacatgcctgtagtcctcactacttgggaaactaaggtgggaggatcctttgagcttgggaggttgaggctgcagtgagctgtggttgtgccatggcactccagcctgggtgacagagtgagagcctgtctcaaaaaa

SEQ ID NO: 494851 - DNA, 1626 bp, Homo sapiens
  misc_feature (281)..(281): n is a, c, g, or t
  misc_feature (366)..(366): n is a, c, g, or t
  misc_feature (371)..(371): n is a, c, g, or t
  misc_feature (594)..(594): n is a, c, g, or t
  misc_feature (669)..(669): n is a, c, g, or t
  misc_feature (691)..(691): n is a, c, g, or t
  misc_feature (1064)..(1064): n is a, c, g, or t
  misc_feature (1475)..(1475): n is a, c, g, or t
gctgaccacgcaccatggtcggttgggaagcaacaagacgaccttacgaaaggcgggaagaactgggtagccatagaagaaatgtggttgatccattttctaatacatagcattggatatgcatgtgcaacacgccacctgcgtatgttccacatcattaacgaaaagtgattcgcgaataatgacagactcggtcgaccgaggcacgcctaatggatactcgacatagatttggcttcttggatgcgttcgtcacggtggtcgtgtgttctgtgtaaggntgatgatcgctatgcaatgtagtctctgcgaggacatctgatgtgaaaactctcgctacttataagagatagactctctaacccnctgantgtacttgacacgatgctgcaggtggctagacagagagcctgcacatggagctacacattcacaactgggcaaactaggaactcccttaactctctggttgatcaaatatactagtcgattcccgattggagatctagtagaccaaatcgcgcacgatgagattcgattctgtagagagcttctaccagatttgatctcgctaacatcgaccctaaccatctntggggttagcgatatgcaaattcgggctccttgatctcctgcgatagctcttgcggtcttgttaactctataganacatagccttgcagaaacagantcccacgagtgtaaccgtgatatgaacgctatcctatatatagcgcccaagtgctacattcgatagctatcgcggtcgcgggctctcacaactaccccgagacaattgaaaccgcagttggatgtccggccatgaagtccgatttgcatctcccgaaagaaaatggggtttgcaacgttagccccccatgtgcaatcgtttggccaacaagtaaaacgctcgggttccaaatcacacctttggggattcccccgaagaaacaagcctattttcgcgccagaatagtacccattaaggcaccttaacggacgtgtggtctgttctctctgaaattgtgaatgtcgccgtccaactcgaagtgaacattgatccntttaccgcaaagaggacatagaagagggtatttagagacctttgcgctggaacagaaagggccctcacaggatttattgcccatttcggtgtggaaaagaggggccgtccaccttggggaaggagcttttccccatggtggctggaacaagcgcgctaaggaaaaggatttccctggggagaaaaaaaatgtcgccacaatgtgggcggcaccttacatctacgacgggatgctttaaaccacaccgtttggaataccggtatagggcctgacatggtggggatttttttcacacacaggggcccgtgtggccaccaggaaaggttccaggtggtgcaaacatgatatcaccgcacgcctttgatacactataatatatggccctagccatatatacgaagtgcccgtaanctggggtcaagcaacatgacacgaccgtcggagagacactacttacggagcgcagacttcgatatatcacgggtgcagccaataaacacaggcgacacaataaatgacggcaacgtagatacatgatgaacttctcatcaacacagcgtgt

SEQ ID NO: 494852 - DNA, 100 bp, Homo sapiens
cgctgttgtgcacagcacgttcccatcaccattgtacttattgtttttagtgggaggtctgaagagcccttggaggggagaatataaagaaccaagacat

SEQ ID NO: 494853 - DNA, 348 bp, Homo sapiens
gggagtttatgtgaaagagtaaggcctctttgcagttgagtataagaggaaggcttgtgtctcgtgctcatccctggaaatggaatgtctcggtgtaaaccccgttcgtatgttctattcctcgcgataggagaaacccgccttatgtctgaaggtgacacttgctggcgccaatcctgctctttaatgcactgagatgtttgtgtaaagtcaaccttattcgtggcctatgtgcacctcaaggcctgctgaccctctccccacctattaccctatagtcctgccacatccccctctccgagtatggtagagatagtgctctatatatgcggagggacccgcgcgcgg

SEQ ID NO: 494854 - DNA, 233 bp, Homo sapiens
tgtctgagtccttctgtgcccaaatgtggagcaggctgcacagacttgaaccctggggttttgtgcctcctttttgtttcgatgtttttgaaacaaagtcttgctctgttgcctaggctggagtgtattggtgtgatctcggctcattgcaacctttgcctccagggttcaagggattctcctgcctcagcctcccgagttgctgggattacaggtgtgcaccaccactccag

SEQ ID NO: 494855 - DNA, 304 bp, Homo sapiens
tgtcaaactccataaccctcatgagatccactcacctcggcctcccaaagtatcgggattacaggcgtgagccactgcgcctggccctaaacaacctttaaaaagaacaaagttggaggactcacacttcctgatttcaaaacttacttcaaaactataataatcacaacatcatggtattggaataaggaaagacacatggaccaatggaataaagtagagaactcagaaataaactctcccgtatatcgtcaattgattttcagcaagggtgccaaaagtatttagaggggaaaggacagtc

SEQ ID NO: 494856 - DNA, 131 bp, Homo sapiens
acccacgctctgagcgcttgcggtacaccgagcctggatgcagccagcgcaagcaaaaagagcaaaatgagggccgtcctcatgctcgtcaactggccccacaaccaacgcatgaatgagcggaaacccag

SEQ ID NO: 494857 - DNA, 157 bp, Homo sapiens
caaaataaaaagtacaagctagtaagtaaaataaagcaggctaggcgggcgtggtggctcacgctgtaatcccaacactttgggaggccgagggggtggatcacgaggtcaggagatcgagaccatcctggctaacatggtgaaactcctctctact

SEQ ID NO: 494858 - DNA, 461 bp, Homo sapiens
  misc_feature (202)..(202): n is a, c, g, or t
  misc_feature (332)..(332): n is a, c, g, or t
  misc_feature (362)..(362): n is a, c, g, or t
  misc_feature (367)..(367): n is a, c, g, or t
tgtcattgaaagttgttataagcaggctggtacggtcgatccgggatttgacagcgtcggaatgctcaaaactttgggggagcaagcatgcaaaacctgaaagggggcccttccagaaacatgatgggctttattgatccgtgactgcgatgagagcgggtctttaaggccaagcatgtgcaacggggcaacctttccaaancgggttgtgccttggggttggtttggtgaaaacacttggggctgggggtcagcaagaacagacaaggacactgaaataacctgctctgagcgagtgagaacctactggatcatcattgaactaaaacacnaagcaagagaaaaaccttatgatagtaaangtttngcggactgcacttcatgaacggagatcacaacgcgttatcaatctggatccaaaattactcaccgagttttccgtatgagaataatgatatcag

SEQ ID NO: 494859 - DNA, 273 bp, Homo sapiens
taaggagataaagtttccccttttcccaaacagtttcacatttggacagcccctaattgatacaactttatggcagggttttagtgtgtgagtgggatcccaaaccctccatcctgtaaaaggggacagtcctattgtatgttagttaaccccctgatgatgtgagcctgtgagatgagcccatccccagttgttatgtttgaatttgctttgtgttgggacgctttaatgtagggtttccctaaataaatgaatttttatatactggactga

SEQ ID NO: 494860 - DNA, 197 bp, Homo sapiens
ggatgagtagtgctggtccccaaagccaccggacaagagcttcgtgtaaaaggtgatgcaggagcaggttaaccaccccaagttccagaagcccaagcagctgaaggacaacgctgatttctggattatccactatgccggcaaggtgacgagcactcacggggaggtgctggccagatcttcacaggagaggtgga

SEQ ID NO: 494861 - DNA, 326 bp, Homo sapiens
  misc_feature (5)..(5): n is a, c, g, or t
  misc_feature (21)..(21): n is a, c, g, or t
  misc_feature (141)..(141): n is a, c, g, or t
aatcnttggggaaaaaaaagntgtaattaaagagaaaatatggccggggtacgggtggccttatgcctgtaatccccaagcactttgggagacccgaggcgggtggatcacctgaggtcaggagttcaagacccagccctncaacatggccaaactctgtctctactaaaaatacaaaaattggctgggcataatggcgggcctgtaatcgcagctacaggctgaggcaggagaatcgcttgaacccaggaggatgcagtgatctgagattgtccgctgcattcctgcctgggagacaagagtgaaactctgtctcaattttagaa

SEQ ID NO: 494862 - DNA, 844 bp, Homo sapiens
  misc_feature (39)..(39): n is a, c, g, or t
  misc_feature (46)..(46): n is a, c, g, or t
  misc_feature (48)..(48): n is a, c, g, or t
  misc_feature (52)..(52): n is a, c, g, or t
  misc_feature (125)..(125): n is a, c, g, or t
  misc_feature (136)..(136): n is a, c, g, or t
  misc_feature (143)..(143): n is a, c, g, or t
  misc_feature (146)..(146): n is a, c, g, or t
  misc_feature (171)..(171): n is a, c, g, or t
  misc_feature (326)..(326): n is a, c, g, or t
  misc_feature (350)..(350): n is a, c, g, or t
  misc_feature (356)..(356): n is a, c, g, or t
cgcacacacaacaatcacccctcaaggacccgaaaaaanaaaaaangngggngggaagcttagaaactgaccgtgaactgtgctttaattaacccacccctacagtgctgagaataaaggattanaaactaccaanaacaatntantgcggccaggttccaaaaaaaaaanaaaatctaaatccaaaccagataagcagcttatccagtataccccctttccacttcttgcattcctccatgggaaccctgcttcttctgttgaacaggccagtacaacagcatcatcagaaattttgtcctggggggataaacccatacaacttnataaacttataaataccaacctanaccccnaaccaacccaaagtaagcttgttcgccttgaacccttgacctgaactgaacctactgaagctacactgttttatttatgtgaacttcctcctacacctcttgatagtgatattccacttttaaatagctaaatccccacgaagtggactttacatgtgtatattcatcaaaatcatgaactatttattctaaaccatcatttccctactttttttcaaaattcctttatttcttttaaccaaatacctcgagaataaaacccccttttgcttttctcactacccccacactcttccaaagcttccatgtgttactccccctccttacttaccccaaatcaattgccccttattgcccgctctttaattccaattcacatgcccctttttcctcccttttccgaaatttgaaatcctttttttccactccacccttacccccactaaattttctgttatttcctttatatccccgcctattccttcaag

SEQ ID NO: 494863 - DNA, 175 bp, Homo sapiens
accggacagaaaggaaaaccatgaaacgacttactggaaaagacaactgtgcaggaagggcaggcctccacggtagactgtaaaggtacccactggtgggtatggcagtcctataaggagggacagcatgcctggctccagacacacacttagagtgccagacaagaaccacacg

SEQ ID NO: 494864 - DNA, 917 bp, Homo sapiens
gctactttgacttcgtaactcgatgtgtgagagcggtggaccagggctgtggagacctacggcctgtggaagataacgctcctgtgggatgatctcgctgaaaacagggatccaggtcctgctgacggagtacagcttcgacagtcgccacaagcccgcgttcaccgaggaggacgtgctcaacatcttccccgtggtcaagcacgtaaacccccaaggccctcggatggcttccatttcttccagacgtgggcagtgccaatagatgcaagcagggctgtcctgcaaggagggctgtgagctcatcaatgaggccctgaatctgtgtaacaacgtctaccggagtcatgcacgtggagagctgtgcctgtctgcgcctcctcgcccgctccactacatcatgggcgactacgcagaggccctgagtaaccatgcatgaaggcggtgctgatgatgcgagcggtgtagatgggcaccgaggcaccccaacaccatccaggaatacatgcacctggccctgtactgcttcgccagcagccagctgtccaccgcctgagcctgctgtaccgcgctcgtactcatgctgctggtgtcggggaagacacccgagatggcgctgtggacaacaacatcggggctcggtgctgcacggcggtggtggagtacgacctgtcgctgcgcttctggaagaacgcgctggccgccacaccaaataccacgggccaagcccctcaagtggcctcaagccaccacctgatcgcccgagtctaccaaacgaagctgagtcgggcgcgcccgcgcacgcaaacggggtcaaccaccacagacgcgtggcggcgagctggaaaacacggagcccgcaccacggctgaccccagcgggccgcgcccagaacgacaccgcaggcagcaacgcgc

SEQ ID NO: 494865 - DNA, 658 bp, Homo sapiens
  misc_feature (208)..(208): n is a, c, g, or t
  misc_feature (245)..(245): n is a, c, g, or t
  misc_feature (252)..(252): n is a, c, g, or t
tgggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagcccactatgaggagggccctgggagaatttgccattttcagtggcacaacaagtggtcgtntactagctaagatgtgttgtactttggatctgcattntgctacnacccttccttgtagtaagacaccaactgcttaaaacataaggatgttcagttcctccatttaacagatatgaggagcattctaagaggtgcagcctctggaagtggatcaaactagaactcatatgccatactagatatgttgtcaataaactttagtgacgtgaacaaaacaaacaaagaagaccttaaatctatgaggcgatctactcctcgtcggaggtagcgggaagaaaaccagggattctagggaaacggagcctattggtatgctttggttggtctacccggtccccatcctgacctggcttaaaaaagggcgctcgattctgacgaggttaacccatcttgaggccgtacgcattttcataatcgatgggcaaggcgtaaagccggttttacagagac

SEQ ID NO: 494866 - DNA, 432 bp, Homo sapiens
gaccgtctctgtttttcttttctttttatttttttgaaatacatttctttattttcattcccatatagcagagatggaacaaggatagtgatgctggaaaatcctgctttgatcaaatcatcacataagttaacgtcagaaaacctgtatttgaatctgactcctctatccttgccctgggaaattggacagattgacccagttgctgtgagggctgaattagatgatgctgaaagtgcttggcctgcagtggatatgcaaaacaatagctgttattttagacagtctccaagcagggaaaaaagtcttcatgccttctaactaatcatacaaacgtatgcagtgtgtttaaactctggcttcagagtttaacaaatacaaatctaatcgaaaaaattagtcaaactctatgaacaaatttataactaatac

SEQ ID NO: 494867 - DNA, 212 bp, Homo sapiens
gcagattacctgaggtcagtagttcagaccagcctggacaacctggtgaaaccgcgtctctactaaaagtacagaaattagctggttgtggtggtagtgggtacttcttattccaagttactcagcaggctgagattaggagatttgctttgaacccaggagattagggttgcagtaagccgagatcatgccattattactccagcctgggt

SEQ ID NO: 494868 - DNA, 511 bp, Homo sapiens
  misc_feature (511)..(511): n is a, c, g, or t
atctaacccaaactaactctgatagagcttatgcgaatttgatctatttctggacctgtgcgctcttcatacgttgcgtatgtagtaatgctaagtgtgattctattgttaacagggccttatatttttattggtgtatatacatttaagtagcatggcttataaatacaactacttcattagttgctcaactaacaaagcttatatcatgcacatgtgttggattttctacatgctccaaggcgctaattgaaacttaatgatttaaggcattttcaggggtaataccatgcccctcttaatttactggttaactctcactaacatggaaagccagggcagaatttactaatcattgtcggaatttgggtgtttttaatattatcactctctctctttagttctgtttgcaattaggagaataagaatctctttcggagccagagatctatgctgggcacggtggctcatgcctggaatttcagaactttgggaagcttatgcttgcacn

SEQ ID NO: 494869 - DNA, 177 bp, Homo sapiens
taaattctattgttttgaactctgatttaaaattaaatttcagctgggcgtgttggctcatgcttgtaatcccaacacttagggagtcaggagaatcacgggagttctttatttctagaccaatctgggcaacagagagaccccatctcttttaaataaaaagttaaattgcttaaa

SEQ ID NO: 494870 - DNA, 852 bp, Homo sapiens
  misc_feature (294)..(294): n is a, c, g, or t
agcggcgtcagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtatggtggtgcatgcctgtaatcccagcttcttgggaggccgaggcacaaaaagtggttggacccagggagacggaggtttgcagtgaagtgaagatcgtcgccattgtcattccagcctgcggtgaacacagtagaganctgtcgatcttcaacatagagagaactaccataaaatattatactagatagagttcttcgacacctgaacttgtgtccgcgatgattgggcagagtgcactccttatgaggcgtgggctcctgtactccctgcatttttgctcccatctaaagagcgtggagtgctggatggatgagcagagaggtagtagtccggggagtagaaggtcagcacacacgggcgagtcaagcccgcgttacctccgctaatacccattgccaatatttcttgaagatccctttctccccttatctttgccaagtaagttttacccgaccccatcactctttcactccccttgtcccttaaaataattccacgttgtcttacctaagaatctctcttttgatcctgttcctttgattaacaccgatcagtgcctactaactgggtctaggacagacctctgttgagcagtcagagtcttccctgaatccacaattgcccctttccttggttgaccaggtatgactactggtcacacctttaccttgactatccctaacttccttctacta

SEQ ID NO: 494871 - DNA, 346 bp, Homo sapiens
  misc_feature (7)..(7): n is a, c, g, or t
  misc_feature (33)..(33): n is a, c, g, or t
  misc_feature (180)..(180): n is a, c, g, or t
  misc_feature (263)..(263): n is a, c, g, or t
ctttatnatattaaaggcccacctttgcctcanccaaaaagttggccttaaacaaaatggaacaacctgagaatcagtgctttaccttttttgaaattgcagaaatcccagcagaaattactaaaatctgatagtgtatcactgtaaaagtcacttttggtgtaggatttcagtcctttncagctctttttttgaccctgccgctgtgttttggtgtcaaggaagttctaggtttgtcctagagaaataggcacctctttttnctaatacaaaacatctgctagtttgatttacagtcttgctcaattaagcttaaggaatagggaagctaagaggaagtaaaatt

SEQ ID NO: 494872 - DNA, 852 bp, Homo sapiens
gggaaacagaagagtgagaagatcggtcggacatttgcgagaaccagaccactggacaaccatatgcagctgggcaggatcatgctacaatccagaatttgacgaaacctgaagccaaaggaccggaggaactccctgaaaagctaaagctctactcagagtttctggggaagcggccatggtttgcaggatacaagatcactatttgtagatgtttctcgtctatgagtgtcggttgacctccacacgtatatgttgagcccaactgcttggaacgccttcccaaatctgaaggaccttcatctcccgctttcgagggcttggagaagatcatctgcctacatgaagtccagccgcttcctcccaagacctgctgttctcaaagatggctgtctggggcaacaagtagggccttagaaggcacaggaggtgggagtgaggagcccatactcagcctgctgcccaggctgtgcagcgcagctggactctgcatcccagcacctgcctcctctttccgtttctcctgtttattacccatctgtaagctcgccaagatcttacgatgtgtccctctgtcagctgccccctaaacaccgctgtacccatgcaggacccgttatgaagcactgcagcatacgccactatccgttcgtgaacatcccgtcaccatcagttaccgcttccactgcagctaaagccagcctgaccttccgttcctgttagtggttgtgtctgcttaaaagggcatgcctggcccctcgccatgtggagactcagcccacgagctgtaccccgtgattgcatgaaggagcagcattgactggttatacggcggggtcctgcagacagtgg

SEQ ID NO: 494873 - DNA, 269 bp, Homo sapiens
aggcctatttgaattaaacagattttatgaatgtcttgttagctacttttttttttcctgcaaagccttgtggtaagtgtaagcttgcatatgcatcaacatgttaatcacagatagatctgtgcgatttaattgaataatgagttacttcattttgcttacttatacctttaatctttttatccatttttgcctttttaataaaatgaggagatgaacaataatgttcatttgtctttatgtttgccaaccaactgtaatgcatttgg

SEQ ID NO: 494874 - DNA, 181 bp, Homo sapiens
tggctgtctagaggatccctgtaccgcggaataccatactgcacacgccgagacccaaagcgaaatcgccgatcttcacgcgtgaagatcggcgacgaatggtttcatgtgtggaccttcggcgtgtgcatgcacacgacgaatgaccacactgagcagaccaatatcgccgatcttcacg

SEQ ID NO: 494875 - DNA, 128 bp, Homo sapiens
attttatctaacattagtttgtactactttataaatttgccacagtttttgctcacccctgtgacacccggattagtattacagttacaggtcttatcaataggagttcttacagacatttgtaacag

SEQ ID NO: 494876 - DNA, 742 bp, Homo sapiens
taacggctaggtacgaggcctggttggctggtgcggcgccgagtcttcgagcagtgccgggacaccatcatcgcgcgcaccaaggggctctccatcctcacccacgacgtgcagagccagctcaacatgggccgcttcggggaggcggggtgacagcctggtggagctgggcgacctggtggtgtcgctgacctgatgtgctcgtgcccactgcggcctatctggccgctgtgtgccacgccgtggcgcccagcccgcgcagcctgggcctggtgtgacctgctacctgctgtgactgcgatgcctgccacgatggtggagcagtggttgctgcctgtgcttgctgctgccactgccgctggcctgacattgactgcctgcagcttgcttgctcggagtgtgtctgcagtgtgcctgtctgctgcaacctcaatgttcctgactggactgcgtgcgccctgtgccagtgacaatgtcacgggaccgcttttctgctgggagcatgttcaagcttgggcgtcaagtgcatgagcaccagctgctgtcggcgctgctggcctgcgtgctgcgaggtgaagtgtggcgcccagtgagctggctgcgcagccgctgtgcgctcttcagcgggcccctgtgtgcagtgcagtgagcgccctggtaggcttcgccaccgagccgcagttcctgggtcgcgcggcagctgtgagcccgatgggcatggggtgagaccgcatcctggcgg

SEQ ID NO: 494877 - DNA, 229 bp, Homo sapiens
tggtcacttaggaactctgggggaagttgtacgagttgaagattagtccgccatcatcctagtcctcatcgcctcccatccctacgcatccttcacataacagacgaggtcaacgatccctcccttaccatcaaatcaattggccaccaatggtactgagccttaaaattacgcccctcgcgcaaactaatcttcaacatcatacatacattcccacattattcgggga

SEQ ID NO: 494878 - DNA, 137 bp, Homo sapiens
aataatcttaattggataattcgggtcgtctttccagcggggtactgccagtcatgatccccctcggggttatcggcagcaaaaaaaactcgcttgctgtgcttatcatcaatgatgcatcgcttaacgttgtactc

SEQ ID NO: 494879 - DNA, 361 bp, Homo sapiens
ggtcaaccatgtaccctatcgacagatcaggaggattagacacccctacccaacagctctgaccgtcaatgctatccatggttcaggtgccctccccatatgtgtcccaccacatcataggctacacatcgtagtgggcattccgcgatccggccatagtctacaccaacagtcaaacaggaatcgtcccagagtgatgtcggctcactccatagttcacagcatcaggactccgagaaggaagaacgaagagaagaacgccccacataaagaaacctcttaatgcattcatgttgtgtatgaaggagctgagagccaaggtcgtagctctgtgctcgttcgaagatagcgcggccatcaa

SEQ ID NO: 494880 - DNA, 230 bp, Homo sapiens
  misc_feature (229)..(229): n is a, c, g, or t
actcatcaacaaataaaaatagggccagcacagtgctcatactgtatgcagcactttgggagccaagggagatcacgagtagagttcagaccaatatgtgaaacccatctctactaaaataaaaaaaaattatccagcgtgtgtgcacgcgtgtaatcccagctacttaggtgctaaggaggagaatcctttgatcccaggggaagaggttggagtgagtgagatcgcng

SEQ ID NO: 494881 - DNA, 249 bp, Homo sapiens
tgatgaggagggtcatcacctcacccagtagtgcaaggggtcggggaattccctttcctagcaaagggaagccatgacagatggtaccggaaaatagggacactcccaccctaatactgcgcttttccaatggtcttagcaaatagcacaccaagagattatatcctgtgcctggcttggagggtcccacgcccacggaacctcactcactgctagcacagcagtctgagatctctccaaggtcagcag

SEQ ID NO: 494882 - DNA, 614 bp, Homo sapiens
gttccgcattctgaagcctccggagcgcacgtcggagtcggtccctcgtgacgaatcaccgactctctccccagctgtatttccaaaatgtcgctttctaacaagctgacgctggaaagctgacgtaaagggaagcgggtcgtatgagagtcgacttcaatgttcctatgaagaacaacagataacaaacaaccagaggattaaggctgctgtcccaagcatcaaattctgctgtggaccaatggagcaagtcggtagtccttaatgagccacctaggcggcctgatggtgcgcccatgctgacaagtactccttagagccagtggctgtagaactcaaatctctgctgggcaaaggatgtcctgtctgtgagggactgtgtaggcccagaagtggagaaagctgtgccaacccagctgtgggtctgtacatcctgtggagaacctccgtttcatgtggaggacagacgggacgggcacaagatgcttctggaacaaggttaaagccgagcagccaaatagaagctttccgagcttcacttcaagctagggatgtctatgtcatgatgctttgcactgctcacagagccacagttcatggtcggagtcatctgc

SEQ ID NO: 494883 - DNA, 335 bp, Homo sapiens
  misc_feature (14)..(14): n is a, c, g, or t
  misc_feature (63)..(63): n is a, c, g, or t
  misc_feature (77)..(77): n is a, c, g, or t
  misc_feature (95)..(95): n is a, c, g, or t
  misc_feature (101)..(102): n is a, c, g, or t
  misc_feature (118)..(118): n is a, c, g, or t
  misc_feature (123)..(123): n is a, c, g, or t
  misc_feature (137)..(137): n is a, c, g, or t
  misc_feature (142)..(142): n is a, c, g, or t
  misc_feature (152)..(152): n is a, c, g, or t
  misc_feature (172)..(172): n is a, c, g, or t
  misc_feature (185)..(185): n is a, c, g, or t
  misc_feature (233)..(233): n is a, c, g, or t
  misc_feature (241)..(241): n is a, c, g, or t
  misc_feature (245)..(245): n is a, c, g, or t
ggtgtgagctacgngcggttggctttgactgtgggtttggaagaagagcggggtgatgtgcangtagctcctcattntagtattattggctgggngggatnnaaaaaagtgggtttangggtnagggtggttgtcgnatggnacgtgtttangttatatagcagctttaggnttaggaagttctntggtttcactaatttgaggatagtgcaggacctcctccatcctctgcncagctccntttntgtaggcttgtgtcacccacttgttttggtatagtagtacatcagaggtgttgggtaggagggagatggcaagctttatctggctgtgtg

SEQ ID NO: 494884 - DNA, 130 bp, Homo sapiens
ccagctacgtggcggcgccggctcgctgctggtgggcgtgctggaatcgttctcgtccttctgggccagcgcctacaaggaagtgatcgtcttcacctttcattatcccggttctggtctggcgttcgtt

SEQ ID NO: 494885 - DNA, 203 bp, Homo sapiens
  misc_feature (3)..(3): n is a, c, g, or t
ggngacaagttagttaaacttttctcatctctatttgctcatctaaaagaatgaaagggtgggatcggttaatctcaatgatcgcttatagctgtgtaattcattctacaattctactacgtagattatacacacaaggagaaatcaataattcttttctgttgagctcagtgaagttaaaagaaacctactaatatttagtt

SEQ ID NO: 494886 - DNA, 277 bp, Homo sapiens
  misc_feature (73)..(73): n is a, c, g, or t
  misc_feature (142)..(142): n is a, c, g, or t
  misc_feature (144)..(144): n is a, c, g, or t
tcgtcttgcgagggaggggatcacagaatatctcaatgagatgtctgacaaatggaactggaagggcctttgnaaatcactggtccaagacttgcaaatgagggaactgaagagctgaaaatgaaaggacttgcgcaagctngntaaatggcagaacgaaggttaggactgtgatatttctgcaaggaacccacggtctgcaaggaggaagtagcccggctgcgggaactgctgatggctcagggactgtcagcctctgctctgcaaggaacccacg

SEQ ID NO: 494887 - DNA, 142 bp, Homo sapiens
  misc_feature (34)..(34): n is a, c, g, or t
agctatacaccactcagcagaggatagtgaaganaaaaagaagatcttaaaatgtgcgcaacacggcaggcggcatctaaagcagcttctaaacaggagagagatgctcatggaagatgtgggcagtgaggaagaacaagaa

SEQ ID NO: 494888 - DNA, 755 bp, Homo sapiens
atcaccattagctcttgaagtttctctagtttggtctagtgactattctgattcttagtttctaacatgaaccctaactaagacaaagtttgatatattatttattcgtttagagactggccttgtcatgtatgcccaggctgacgtcgggactcctgggctcattcgaatcctcctgcatcgagctagaaactgtacagtagtttcaggattttgaaggtgtgatagtgtagtatgtgtgagtatgctatatattccggtgtgtatatgaaatggagagtatcgttatctgagtggtggttgtcagtaatgctgtcaagtattcgttagagtggtgatcacacatgataacattggtttgaaatttgagcttatgaagaatttcttgactttctacgctatatgatcagttcacgttctcttagcctcaagttttattgctgtctaaattccagaagttcttgactggctataaggattccttcagctttcaaagtattcaatattctgatcatcggagtctggggttctggccaaacgacattgtttggtcaccgccggtaatgttagcgaagagaattgttattggccaagaacatgtctcataccacattcagttttttataagaaaaagttaatggtatgtggttatcctgagttcattagaattcgctttacgttatatttcgtgatggtctttaaagtacagagggcagattgtgggtgtgtaagttggtactgatgattgtatctaa

SEQ ID NO: 494889 - DNA, 327 bp, Homo sapiens
ctgctggtgaaatctagaggatcccgtccactcggtatggatagctagttagagtgtggacacaaagggtctccaaggccccaccagagtagctagatacagagtgtcgatggtgcgtcacaaaccctgagctagacacaggtgctgattggtgtgttacaaaccttgagctaggtacagagtgccgattggtgtatttacaatccctgagctagacaaaaggttcgccacgtccccaccagactcaacccagctggcttcacccactggatcgcgcactggcgaggctaggacactggcgaggctaggacactggcgaggctagga

SEQ ID NO: 494890 - DNA, 180 bp, Homo sapiens
gaccttcgttggaaacgggatttcttcttataatttcttgaaaaaagaattctcagtagcttctttgtgtgtgtgtattcaactcacagagttgaaccttcctttagacagagcagattggaaacactctttttgtggaatttgcaagtggagaattctagcgctttgacgccgtcgacg

SEQ ID NO: 494891 - DNA, 722 bp, Homo sapiens
aatgcgctgacgtactgtgatatcccgttgactgatggtatgcatggtaattagtacatgttagttgagcattccagctagggatgtattctgagcaagggttctgcacgttctgaagcctaacatatactatatcaggaatcagtggagtgctaggcgctcatacatagcgtatataatttttatctatcttagggatagaggccttttaagatacgaacgtaaacacgactcaaggaaataatgtaaacaactatagaggtcagtgtttatacatctttctcctttactaatagcaagggtacatccctaccatcaaaaagtggtatcctgtgcatcgttatccgataacaacggactataaacggacctaagccaggtactctctaaagtgagatatgggaggatgcagtagccggtgctggttgaacccaaatgattagaggtataatcatttccccactaaaatatttagtgttctcattggcccgtggtttactcgagtagagcccttggactagccgaagacagtttagcaaggctgcagccagctctctgcagaagagttaccccaccagccccaactatccgagcctcagacaaggtaagtccctcagagtcagagagctccgacaacatattggtttcccctgttgtctcccgactagtttgaactcttaggtgtgtggatccggaggggacaaggcaacaaccagagtaca

SEQ ID NO: 494892 - DNA, 189 bp, Homo sapiens
ctgtgcaacacggcgaaactgcatttctgctaaataaaaataataaaaaaattagatgggcatggtggtgtgcgcctgcaatcccagccactagggagactcaggcaggagaaccactcgaatctcggaggcggaggttgcaagtagcccaagatcgcaccactacactccagcctgggcaagaaagca

SEQ ID NO: 494893 - DNA, 117 bp, Homo sapiens
acacccatatgttatatacaggctgatgcacatacatcaggactccattcccagcatgcagatgcagtaggcgtaactgttgtgctaattccttgtacctatcgaggacaagaattt

SEQ ID NO: 494894 - DNA, 890 bp, Homo sapiens
gtctcgctcctttgttgggcaagcaggatgtgtcaggaggcgtgatctcagctcactagaaagcgtccgcctcctgggtgcaagcgattctcctgactcttgtctcacgagtagctggggttacaggtgcccgtcactagcagccagctaatttgtaattgggattgtgatatctgtgtagagccaacgttctgtcgtcggatgttgcccacgtggtggtcatcgaactccgtgtgtctcgggcagtgcatcctgaactcaggttcgcgcatatagctgagattggaggtcatgatgccagcatacgctggccgggctcagtgacttgtacacagatacctgctaaactcatgccagtatagaagagtaaccgtatgaataccatgttgggtctatatatactattactgtgtactcaagtgcttacattacattgtgctgatgtttcaactgttgccaaaatttgctcttcaaggagccaatgtttttctactatggctttgcttgggaagaacaaccctagtcacgagatagatacaggcagttggcttgtgctcggggacaatcgttctcccgctgttcccagagcgagtctattgccttggaatcctggggcaatgggaacaacccacggggcagggatcaaaggtagtcccctaggcacaaattcccgcaagtacctggaccactggggcccgcctcatggccgtagatcaggagtgttggcaggcggggtgaccaattgcagaacgctggcggggtcacgccgggcccaatggggatagggaacctgcagcgggggttaaggggcgtaccaaaaaaaaaacgcgggcgacaaaaagcgagacgccaggaggcgaaccgcaacggacggaacccataaagcggac

SEQ ID NO: 494895 - DNA, 199 bp, Homo sapiens
atttttttttaaaaaaaaggggctaagtggggggatttttaaaacccaaaattttaattttttttttttcaaccaggtttaagggccaatctgtgggttttccctttggtgggcccaggcgccctgccccccccgcccttggttggtaccagaactttttttatgatgggattttcatttaaggggcctttaagattga

SEQ ID NO: 494896 - DNA, 158 bp, Homo sapiens
tgtactcctaccaggtcgtgaacggcaaaggcactgcccgcatcgccatatcaggtgtcttcttgtgtacttagacttgccatcacagaaagtgtgttcattcagtatgggctgcacccctacagtggtctacggtgtcttcttttcgggggctgaat

SEQ ID NO: 494897 - DNA, 1174 bp, Homo sapiens
gctttttcgtctgtgctgccaacatgccatccatactgaatgaagaccccggaacacttagggcgtccatcgtgacgccacaggccacggcccgcatatcgcaatgccaccggaacgccagcccaggcggccgcggtacattgctaggtgagtctgcgttcaacacgcgggatcaacttcgactaagatacgcatccgaggctacatttgggaacagttggtatgaagcattagcatttaaatgaggaaccaagagcttcatggcctaagcttgtcatagccttgatcaacattgttgagactcttgagtcgagttagaaacagaccacggggtggaattgcatgcttcagaataccagaatactggaggcatgtctcccgcatcatttgatagtggtgcgactccgaggctaccttactcaccatggtttcctggagcacgaaggcggaaatcgcttcacccaaaaggcatgtgcatgttcaatcggtgttaacgtgctcaaaaattccttcacgcctcggacaggtagtctgtacgcatcacaaaatttcctgaagctggtatgggaggtggttgaccatggtggaacctagggatgcgcttcttacacaggccccaacacttggcacggaggcatgtttgtgcaattctacactatctccccttaacagtgtaacttttcatggcccaattttagaccacccgggatcctttaaacgcgccttctacgttccacttagacagaaggacgaagtagccataatcgcagagagcaatgcagaagaaggtgttcccgacgttaatcagtggtataaagcccttgcgtggatccacgaagggaacactactaattctaagcgcaacagaagcactcagacgtgcgaccgcggataactaagcggtgtggccacaagggagcagatatactagtgatattacattaacacagcttgggatgtacttggacacatctttgcaacactaccgcataattatgaggtccccccggttgtggcaacacttgccgaccattgtgaattgcgacaactaaaatcggtcagcagacggtgaggtaagccaggtagtaccacacacaaggtggacatttttctacgacaaacagcttgggagctcaagcagaggagtgccatattatcctcgtaatcatcctgt

SEQ ID NO: 494898 - DNA, 137 bp, Homo sapiens
cgagctcggcccgtgttaaatgaaagtaatgaaagaatgatactgtaatttcataccataattctcttggaaggaaatttcagtatcattcatttgggattattacagtgagaaagtgtgattaacttttgtaacat

SEQ ID NO: 494899 - DNA, 119 bp, Homo sapiens
gaatgtatggaattgaactgcacggaattgaattgaattgaattgaatggaatgcaatgccatggaatcaatcccgagtgcaatagaatggattcgaattgaatggaatgctatggaat

SEQ ID NO: 494900 - DNA, 294 bp, Homo sapiens
  misc_feature (26)..(26): n is a, c, g, or t
  misc_feature (52)..(52): n is a, c, g, or t
aaccaatggaaggacccccacctggnttccaggagattttcagtaactgganataagtcttctgtgatgattgtgattctcagggactgggaaaagatgcacaaaagttgcttattatactgtgaaaatttgaatcaattaatcaaggctgacagtgacactaatgaaacatgatatcaggaaaaatgtaataagccatctggtaagttttcttaaaggatgttgttaagaagtccatctaaaaacatgtctagacttttttatatccagaaaataaaaccaaaggataatatc

SEQ ID NO: 494901 - DNA, 112 bp, Homo sapiens
gatacgaatcgagccggtacccgccacaacatgcacaggtctctgtttagtaatacatcactgtataccgatcaggaatctgctcccaataaaggaacataaagattttttt

SEQ ID NO: 494902 - DNA, 988 bp, Homo sapiens
  misc_feature (307)..(307): n is a, c, g, or t
cgtacttgtgctatgaacactatgcaatcatcactgaatcttaataactacccttgagggattgcagacgtgtactgatcacatggtacctcctgtttggataggctgtaaataaacgctagatcattgatactgtctgacaaaaatgtgccgacttatgacaccagctctccaattgttgaactgtgtttgaccacaacgagcgttctgatgatacttgcatgatagaaacgcattatgaccgagagatcccgatgtaccatcccctggactgtgtctaagagtgaggaccactccggtgtccatnacaaggcgacagccacaattcgcaaaaagtgcatacgagtcagtgaatgaacccaaggctgctctgcctgggaaagccttgacttctagcgaaaccagcatcacatgaacctccattgatatcactaatattccaggaaaatacttaggttttgaattcaataaaagtgggcatgatgcctagattagtccttatatgctcgctaggcgcaagcataaactcgtccgtggattgtgatgcaaatccatggccaattattaggtttccaagcgaaatggcttgttgtctaggatggtacgaattatggtgcgtacatgcatagggggctggttgagtgtggctaagcttgccgatgcctttgcttacactgattggtgttggggtggctcgttgaagacattagacctgtttgagatgacgcatgtcataatgttcagtatgaaatacccagtgacaaagcaggagtggcgcccaactgggtataaacaaagtaggttttgaggcattatatatgcacgtcttgaagaaggaagctgaaagttcagggtcaggattgggtagcacctggtaagtatctgtagatgaagtagcctttcagaaactgtcctgtgtccaaatcaattgtcacaaggtcttaagggaaagttatggtgaatgctccgattgagagactggatagtg

SEQ ID NO: 494903 - DNA, 216 bp, Homo sapiens
  misc_feature (18)..(18): n is a, c, g, or t
  misc_feature (94)..(94): n is a, c, g, or t
  misc_feature (96)..(96): n is a, c, g, or t
  misc_feature (164)..(164): n is a, c, g, or t
  misc_feature (174)..(174): n is a, c, g, or t
ggcagaccacaggcaggnaagaggcacgtctgggtccctccctccttcctatcggcgactccagatcctggccatgagagctcgcacctccacntntcgccgctctggcccgggctctggcgaagtgctgccgctgctgatggcgcaactctgggccgcagagncggcatgctnccccaaaacgacacgcgcttggacccgaagcctatgggcccc

SEQ ID NO: 494904 - DNA, 208 bp, Homo sapiens
atgagaatcatggtcccacaccgtgcataaaggtaaatatccagtattaaatgttaaaaacgagagggcgagcgaaaacaaattagatgtatgtgtgttttacgtactataagaatgaatgtcttctaaaatcaaaatttcaaacagaaaccttataaaaaggaataaacctgacgtacctagaatgtaatttctgtgcccatttcaa

SEQ ID NO: 494905 - DNA, 186 bp, Homo sapiens
cgccaaactcggatttcactgttgcccctggaacattttagtggtgatacctaaagcctggaaaaaggaggtcttctcgcggccccagaccagtgttctgaagctggcacagtgacttcacatggggcaatggcaccagcacgggcagcagctggcaccttattggccatcaacatgtccctcatc

SEQ ID NO: 494906 - DNA, 158 bp, Homo sapiens
  misc_feature (28)..(29): n is a, c, g, or t
gccacggctccagctcatctgtttgcanntcagaccccgagctgtgcttgtggctgcagctactaactggctgcccacagggacctgtcaccatgcctcactcgtacccagccctttctgctgagcagaagaaggagttgtctgactatgcctcgcgg

SEQ ID NO: 494907 - DNA, 116 bp, Homo sapiens
gcttctagtaagcctctacctgcacgacaacacatagatgacccaccaatcacatgcctatcatatagtaaaaccccagcccatgaccccctgacaggggtcctcttcaggcctcc

SEQ ID NO: 494908 - DNA, 424 bp, Homo sapiens
  misc_feature (44)..(44): n is a, c, g, or t
  misc_feature (80)..(80): n is a, c, g, or t
ggcttgttatttgtaagttatcatgaaaaggtttatattccctnttcttaaaaaaagtgtagaaattttagagccaaaanaaacacaggcaaaaagaagttaaataacttgccggacggtggctcacccctgtaatcccagcactttgggaggccaaagcagggagatcacctgaggtcaggagtttgagaccagacgggccaacatggtgcaacatcgtctttactaaaaatacaaaaacaaaaattagccaggggtggtggtatgcacctgcagtcccagcaacatgggaggctgaacaggagaatcgcttgaacccgcgacagggaggttgtaatgagccaaggtcatgccactgcactccagcctgggagacagagcaagactccatctcaaaaacaaaaacaaaacaaaacaacaacaa

SEQ ID NO: 494909 - DNA, 351 bp, Homo sapiens
cgggcaagctccatctgctgctgctgttctcaaacagcatgtgagccatgttcttctgctccgagtgggctgtcaggagctggtccctgcagggtggacagctggtgactcatgaacagaagctggagctccttctctgctaggctctcttgggtccctttgacatctttggattccatagagtaccttcctagaaacctctccttccagtcactggacaaaagcttctctatggctggcaccaacttctttcaaatatcggttgaagtccagctatctcctggctaacagaggcagactccgagactcctggtctcttgggaactgggggacccatataccctctggaga

SEQ ID NO: 494910 - DNA, 377 bp, Homo sapiens
gactaagggccgtgacgtggtgccgctgagcttggaccccgaccaaaaaaaaaaaaaaaaaaaacaaaaaaaaatttttgggcggcttggccctaaaagtttttaaaaccttttttgggcgcgcgtcgcccaaacaacgtaagggtaagacttgcgctgacaatgcgtgtgtccccaaaggagaaactcccgtcggcacacaactcagcgtcgtgggcatctctccacaccacagcttaaaaaaacccgcgcggggtgggaacccaccagagagtgttcttgagacaacctccacgagatggcggttcccagagagcacatacaggggcgatcttatcaacaacgggtgtgccaacgcgacctacaatactaaatac

SEQ ID NO: 494911 - DNA, 927 bp, Homo sapiens
aagatgatgatgatgaataagtaggttctagcgcagtttttttctttttcttgtctataacagcatttaaccccccgtgtacgacaactcactccttttaaagaacaacaacattgaaatgtcaaggctgctgtcacgcatttgtttttaacactgctacacgtgtctttcttctggctcactagctctaacaccactacctgccactggtcgctctctagcactacgcccgtgctcctggctgcgctactttacaacctacgccacctacacctttgccccgcgccacacgaccatgggcgcccttgctacacctctgccaacctgcgacacatttaacacgccacgcgctctcttagtcgcgttgcaccccgcccccacacattctaccctctcctacctattgcggcgaactgtcctacacctactacactccactcctctcacaatacagctccctcctacactgacacgcctctacttacgcaacactacacattgctgctccttgctccacacctgcaacatcccccaccttctgctcccctacgccacaacaaacacaacacaacaaaaagatttcgaacacttgcatttcagcaaagcaccacttccatgaaaattgctatctcataagttaaacttcccaaaattcctctatcaaatttcacaacaacaaccacacaacaccacacaaacacacaccacccacacacactcaaacacacaactaatacacataccaacaccaaacaataaatcatcaacacactaacacaaaaaacaaaaaatacactctaactaaaacaaataacaatttacacattaactcctactaatatatctatataatactattcacgagcattactactggccttccacttactcatatacaataacacatatctttctcctcacttcacc

SEQ ID NO: 494912 - DNA, 158 bp, Homo sapiens
cttgggtacatgggcacagtgtttcagttgagcattagtatttaaatctgtagacttttaatcctacataatgtccgcggggctcatccaatcagttgaaggctttaagagcaaacagacctacaaagaaaagggaattctggctcaagactgtgctc

SEQ ID NO: 494913 - DNA, 467 bp, Homo sapiens
taaacacagaatcactcgggcaatggtgctggcgagctggccacgggggcaagggccttaccagccctagcctctagcacttctctaagtggccaaaaacaggggtgcatggtggtgtggtctcctttctggatacttagtcatggggaggatattacaaaaaagaaatttaaattggtggttcatagtctttcagaagtaagctcaactttagtcctggtgaacttaatgggggtggataatttgggggtgccagggtgaatggtgtttctcttggcgtggatatagtgttaccagtgggtacctcctataaagcattatgtgccctcaccgtgggttaaaaaaagaacaaacagtggtttgtgggtgaaacgctacgtgaaggtgcctgtgggaaagtgagaaaggtttctaatagagttaaaagtggatttttataaatttctcaaacaaaaaaaaacaaagga

SEQ ID NO: 494914 - DNA, 893 bp, Homo sapiens
tacctctgatcacatatcaggctaacgatagagaaagcattaggtttaagttgagggctaagaactggttgtttaaaggtttaaattgtggaaaagagcattgccttctttaagtgaatgatggtctcacaattcagtgacttgacctaatatttaagaatataaatatattttatttgaaaggctgagtgtggccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagatggttgtttaaaatgctggttcctgcacacaaattctctatcatactgaagcacatctgtaaaacatatagtaagaataagcttaggcttataagtaatattaaagtttaccaccagtgattccagttgcaactgaaaagttgagaacgaaggcttagtggtacgtcggggtataccaagctaaggatggatagcattataacctgggaaacgttaacaagagaataacagacatatcttgacttcttagttgtagatttatgactgtggatactacggtatggacgaaaaaagtctcccagaataattgtggatgtcacgagtcaatagtatagaactatctatcatagtgaagtgcaatgctaagagatgaagtaacgatgacaaaagctaacacaggaaaacaacatgggaactaaatgcacgacaataaatcggagaggaccacagagacacaacgccagccaaaagcaggaacaccccgaagacacggacaagaacacacaacgcggaaagcaaaggaaagaggaacagaacaacacacacaaaaaag

SEQ ID NO: 494915 - DNA, 257 bp, Homo sapiens
aaccctgggaatggcagccctgggtattgacaatgggcggagtacacatacaatgaggaatgtgttgctgcaaatccaaataggcccactaggcattgtgcccctatctgggttgtagaaggggccaaatgcagcaacgtaaccctcaccttagaaggaatgtctcgacagagcccacaccactggactcctagaaattttactgaggtggaagttccctgaatattaaccacgatttatttcccatcctatggttt

SEQ ID NO: 494916 - DNA, 714 bp, Homo sapiens
ggaccttacgcagccaacgtacaccgggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagtgggttgggcttgaccattcaggatgagatgggcaggcacgaagtggggccacaatcgacaatccatgaagatcccgtgaacaatggggcaggctgccgttcgagggggcagttcagcatcaacaaggtccccggcaacttccacgtgtccacacacagtgccacagcccagccaagaacccagacatgacgcatgtcatccacaagctctccttttgggacacgctacaggtccagaacatccacggagctttcaatgctctcgggggagcagacagattcacctcaaacccccgttggcctcccaacgattaccatcctgaagatgggtggccccacggttaatgaggacaacgagtgggcaagcaggggtaactccataaccagtaccacgggtggccaacagggaatacgtcgctacagccaaacgggcgatcatccttgaaatctggttccgtaagaactcaagcccatcaggtcaagtacacagaaagacgggccggtgtacagatc

SEQ ID NO: 494917 - DNA, 930 bp, Homo sapiens
aaaagttatatatattttttccttctgattttaaaagaaatggggccaggcatgatggctcatacctgtaatcccagcactttgggaggcccaggttggtggatcacctgaggtcaggagttcgagacagcctggcaacatggtgaaaccccgtctctactaaaaatacaaaaattacccgggcgtggtgtcacacgcctctaatcccagcgtactcaggagactaaggcaggagaatcgcttgaacccaggaagcgaaggttgcagcgagaccagatcgcatcatccgtactccaggctgggcgacaagaacaaaactctgtctccaaaacaataacaacagcaaaacaaatgaataaacactcattatatctcatttgctttatttatctatatttaacttctattcattatgattattatcttgagacagagtctcattctatcacccaggctggagtgcaatgaggcaatctcgcctcatgcaacctccatctcccgggttcaagcaattctcctgtctcctccaggtagctggggttacaggtgtgcagcacacacctggctaatctctctattttagtggcagactgggtcccatccatgtggccaggctgatctcgaacagcctgacctccagctgaatccgccaacctgagggctcccacacgtgtggggagcccaccggcaccggggatcctagtacgtttcgacaacccagctcggcctggtcgtccacggctgaagtacaagggcggcacacacttgcatcgggaccgacaccctaccacgacccccccacatccacactcccacagacgagtaataggttcaaacgggactgacactaactgcctcgccactaaaaccaagccgcgctaccacctcagaactgacaaccctgacacccaacctacccaccccgctccc

SEQ ID NO: 494918 - DNA, 1117 bp, Homo sapiens
gcgcggtgctgggttctgcggagcagtcaggtcgcaggtgggcatcgcgcacggactgccagcccggggcgaccatgaatcctgcgctgacggggtccgagaggggcgccgcggaccctgtctgagctggtaggctttccgcggaacctcgagggcgcccatgtaacggcggcgagtgggtacggtctaccgtgtctcaaggagggcagtgctggagaaagctgctagcggggggcttgcatgcgagcgtgtggaagcgtgaagactgctgctctccatcaaccctgaactgcagtggcttgtagcatcttcatagggccaaggggccagtgtgagcggcccgggtccgaaagagaggctcaaggctttctgacgccgccattcgaaggtcctgatgcgtagattgcagtcgagagaagcacccgggtgcagtccacaattcgtactttcagcgcgtggtagaccggaagggggtgggcgggcggaagaatcgactttccgggttgcccccgctgggaaagatcccacggggggtggaagatcggctcgcaagcaagtcaagccctcttattgtcccttgtgttcgaactgtttcacaagagaccccaagtcatgggccacttcacaataacacatgttggtcgggtgccccccgggacaaggaagacccttccgggtgagccccgtgagagcgccctcgggatgttcccttaataaccaaggcgtggcaggcctacccagtactttttccctttccaagtgcttaaccccaatcgcaagcctacagtgggttggctttaggagggttcaaggggccgagagtctttccgttttggtgtcccctttctggggcctttgttgggtggggtcaagcggggattgatgtcttccaatttgtttggcaaaggggctgtgaaaagtgcgagtgggaccggtagttggacaggagaagggtagactgtgggagggcattggaaatgggacgttgtgcgggatagccacgatggtgaagggacagtggaatagagaggtatttaaggcaagggggatttaaccgaatagaagaattggcacgtcccttgggagtgggtaccggagaggttgagaagagaagaag

SEQ ID NO: 494919 - DNA, 294 bp, Homo sapiens
attttacgaggtaaacaatttttatcaccgtcagacctgaactgaagactagctgacagacgtgggatttctttgaccatcacggaatcgtggccaagcgcggtggctcacatctgtaatcccaacactttgggaggtcaagatgggcggatggcttgaatccaggtgtttgagatcagcctgggcaacatgacaaaaccctgtttctagtaaaaatacaaaaattaaccaggggcaagccatgaccatgcaccatggcactccagcctaggcgacagagcaggaccctctctc

SEQ ID NO: 494920 - DNA, 890 bp, Homo sapiens
agttgtgtgtgtgagagtagcacaagaaggaaaagacctaggcgggcttttgggaaatccccaatctctttatcgtgtttcaaatgggagtcctccccttcggtttttgcgcatttgttcccccaagacggaccatgtcctccggggattgcccttgtctgtggggaaacccttcgccttggtgggaagacctctcccccctcgcccgggggttttcaccacccgtccgcccgctgcttcttcccgcccgccggaggatcttcctgctcgctgccgtaagcaacaaccatatcttcctgtgtttgcccaacgacctgtgttatcacccccttccgtctctgcggcggggggtttatcaacgtcgcggtcgcccccttggcggtgttattattgtgcgtcgccgccccatgcgaatatttcccggcgctgtgcgtgttccagctcccctccggaggcaccaccgctgggtaatcaggaatctccacgtgtcaggtgacgctgtgacgtttgttttctaagacacgcccgcgctggaggaggctcgatccccccgcttctgccacgtctacccgcggggcgtctatccaccgataaagcaggcgtcttgatgccccctcgtgtccccaatgcgagggatattcattttcgcccggcgctcgcccccctctgaagcccgctccccgggaaggttgtcccctgcgccccccatgctgtgcatccaacaattttgccgggccggcttgtatacgcacccagctttctctcatcacgccttctccacccgcagaccatatcatgccgggggcctctttaatctctcgccagtgcttccatggcccctcaccccccctaccccccgcaagcactcttggcatccccccaacaaaaca

SEQ ID NO: 494921 - DNA, 178 bp, Homo sapiens
gaatcagctcgtaccgttatcagagtaggactttaatcgatcgacagttaccctacggataatagcgcaatcctattctagagtccatatcatcaatagggtttacgacctcgagtatttgatcatgacatctcgatggtgcagccgctattataggttcgtttgttcaacgattaaa

SEQ ID NO: 494922 - DNA, 87 bp, Homo sapiens
gctgaggacactgccgtgtattactgtgcgagaggagaggatatagcagtggctgaccagtacggtatggacgtctggggccaaggg

SEQ ID NO: 494923 - DNA, 210 bp, Homo sapiens
catagtactgttaagtctggaacagggcagttcagcgtgagagagagaaatacagggtattcaaataggacgagggaagtcaaactacgtctctttgcagatgacttagttctatatctaataaacgcatagtctcagcccagaagctccttcagctgataaacttcagcaaagtgtcgggatacacaatcagtatacaacaatcactat

SEQ ID NO: 494924 - DNA, 423 bp, Homo sapiens
aagatgttcccaaacatctgatcttagcaatggctctctgttcctcctcctcggagaggaggggataacacgcatatcatagacatcaacatatctagttcgattaacaaatacatcttgtaattaggaaattaagaggcgtctgactgtgtgctatgcttctgtcctgattgaccctctgctgctgggccaacaaagttaggagcatcttctgccaatcgcagacatagctgagcatacagtgagctatactttggctctactagggcttagtccacaatcagcagtatgaccccttaaaggatgagtttagactctacaccctcatagaggagctcaaggcatagcttgtcaaactttacaggagtaagcttattaagtatgcctctaactatcatgaagattgcatcatgtcgtacttaa

SEQ ID NO: 494925 - DNA, 632 bp, Homo sapiens
  misc_feature (454)..(454): n is a, c, g, or t
atacctactcacggtgcacagtgcatggctcatcctgacatctaccgtgcatagcgcatgacacggaaatgccatcttgcccccatggttgacccccctcatataggggggccacggcacccatcctacgggaactcaatttcccgcacaagagggctactgtgcactgtacgggcccataacacttgagcgtatctaaagtgaactgtatactgcacctggtacgacacagggccgtcccaatttggttgatcgttggaacgagaaaagggccttgtcgcgctgtttgaccacatcgacattatactaaaccatgctaatcactccaaaccactaatcaagctcgctcataccagactccacctatggaagagggaatgtaacaacaacactggcctgccgaatgacaacaatcgggactagggaaaaccggtggctgatcacactttaatcnctctatgaacgcatcccgcttttatacgatcacttaataccaaataggaccttaccattcgccattaccaacagatcctcagcctaagcggctattggaaactgtagacgggaatacttacttaaacctgcgaggaaactggtgtaaatcaactcagtaattaaccggagcgcctgtg

SEQ ID NO: 494926 - DNA, 1049 bp, Homo sapiens
tatgcgaatatgatggcagaggcatttgctctcggacgcccctaaggcggaggaaccggttgctgttgctgtagtgggtgggtgcttccaaacttgggggtacaatgacaccgttggtctggatcagagttgctttgaatagggcggagagatatgcttgatagagtgtgtaggggtattgccccggtggagcaatgttgtcagcctcgtgaggtcactctatgagtcacttgagtcctagtcaataccggttcctcttttgggcagcatgttcaaatatgctgagagaaaaagcggtcttaactagaatgcgatctgactcatccaatcgtggtggctactcgtctatgttaactattggcatcctgtggctatttgaattgggggattaatataggctcctcaacttctcacgtggtaccggcatggcgacttggagcttgttagtgctgtgatatccttatctagtcgactgaactggggttaccagaacctcatttcattaccctgcattgtattagcgccacaggatctttactccgtggtgcacacagctaaactttctcctaccaggaaatgggatccatggatggagtttttaggcggatgaccaccaagggaaaaccagggttgggcacggcctatactacgttgaaaggctgacccttacagctatgggagaggcaatagcccgaaggggggcaagccggggtcacccaggcgttcaacggcctaaggcttatgtttcgacccacgtggagactggcttgttggaatgatgctgacgctaaaatattcagtggcccctgacaggtatggctatggaaagatagggataagggtgcaatctttaaaggagcctcttgtcttcgggaattggcaattagagctgcggggtgagaaagagccccggatagatgatgtcaatctgtacccaagggcaaattgcgaaggattgagaagttacagttatggacgtgctgggtcggggtaaccagaggaagaagtaaaccattgagactattggtgagcgacatagcgacaatacg

SEQ ID NO: 494927 - DNA, 138 bp, Homo sapiens
cttgtgatacctactcttatgacagactcgctggacctcaaactgtacagcttagcaagccaagtcttgtaaaacagacagttaaatctcacacagaaacagatgtagaaacacaacagagagccggaacattaaccc

SEQ ID NO: 494928 - DNA, 1483 bp, Homo sapiens
gcttttctctagattaatgatttttcaatcattagcggtactagacacatcagcctaaagtggcatctggcacattgaatggcatttactgactaatgatcagtctttagctcttccctttgttatatgactttataggcttatgacttgatcaaatttacgtttctactaactggtaacgcggtgcagggtcactagtgcgacacgcgcttctctggcgctttctctacgctacttgcttgcacaaacctgccacacgctatctggcctacttatgatataacttagccccactcaaacttgcgccgaacacacaaacaccatgcaccccacgctgcttctactgctactctcaactgccagatctgcgcacacagcacacaagcgtagcctctgatatgctttcgacctttactgcttcaaacatctgtcctctcgagcgcaattaatccatcctttcctccacacacccttaacgccctgctctttctaaccgcagcgcaaccagcaacagtggccacaaactcctggcctaacctctacgcctcctcattaccaacccacgccgctgtaaaccccattcccaccacgcggcgcgacctatttccctgactctaccaccttccaacatccatttgctaatccaccccaaccctccatcgcgcacccctacctcctggcgctctaaacgggcaccttttctccacatgtgacacatttacacctcaatctccttcgccaacctaacatgtacatctgaacacatcacaacacctagcacccctactaattacaccaacccaacgctctttttactaacttataaaatttagctatcacacactactccctcttccctcaccacccccaactctcaccaccccacctccatcctcactaacctcttgcctacatacactcttaactatgcacacacccctccctttgattcatccggcacaaactcccacacacctccctagtatcaatacgagcatcgatacccaaaacacctcacctacaccactcaccttcctcttcactcttctcttcatccatatcctacatatcaacacccattctccactactctacaacaatcccccttcgcaccatcaccacacaccactatatccggcagaccctcagccatgcaccatccgcgaccactctctctaaagttacacgctgtgtctcgtgaacttaccctcccacatcctcacacccccgaccctagcccgtgcacaacacgtccacatctaaattaaacaaactcgctatatccaatatacatctcatgtctatctatcctccaattcttacgtggccaatatacacaccagattaactaatgcagtctctacatgaaccaactcatctatcaattctaatcactcaataaaaatacctccatctacctaaacctcacaacctacttgcactcctccactccccaatactttttatacccacactcatccat

SEQ ID NO: 494929 - DNA, 251 bp, Homo sapiens
ccttttgcgcctgcgtttggctcccagcttggaacgtcccagccgtgagtcgggtctcactgtgtcatcttcccacgcttgtttcaagagcattttttatgagatgctcccactgttttggaaggagaagcttcccctccgctggaggccccgttttgtgcccgatggccaggccatgtgtatgtgtatgtataaaatagatacatatatgtataaaactaagtaaataaacacatacacccggcacatga

SEQ ID NO: 494930 - DNA, 347 bp, Homo sapiens
  misc_feature (8)..(8): n is a, c, g, or t
  misc_feature (39)..(39): n is a, c, g, or t
  misc_feature (52)..(52): n is a, c, g, or t
  misc_feature (65)..(65): n is a, c, g, or t
  misc_feature (81)..(81): n is a, c, g, or t
  misc_feature (85)..(85): n is a, c, g, or t
  misc_feature (111)..(111): n is a, c, g, or t
  misc_feature (113)..(113): n is a, c, g, or t
  misc_feature (127)..(127): n is a, c, g, or t
  misc_feature (135)..(135): n is a, c, g, or t
  misc_feature (139)..(139): n is a, c, g, or t
  misc_feature (169)..(169): n is a, c, g, or t
  misc_feature (201)..(202): n is a, c, g, or t
  misc_feature (217)..(217): n is a, c, g, or t
  misc_feature (257)..(257): n is a, c, g, or t
  misc_feature (275)..(275): n is a, c, g, or t
  misc_feature (277)..(277): n is a, c, g, or t
  misc_feature (322)..(322): n is a, c, g, or t
tgtatttnggtcatattgccaactggaaagtcaaaattntctaacaactttnagtaagttctttnaagacttagtgctgtntttnatccagtttagaaagtaacttaattntnataccgctactaanacttcganaatntcttctttaatcacattcaatatggttaanagacaacactaattgacattgcgtgggctttnnctccctttgtttaanatgtcatttgttgagcaagagttgtatagtattatctacntacttgaggctgttaatncncattacagtgttttgtaatctatccacggaccatgatgcattgtnttgtgctcaacttgtgttttgtatt

SEQ ID NO: 494931 - DNA, 281 bp, Homo sapiens
  misc_feature (8)..(8): n is a, c, g, or t
  misc_feature (95)..(96): n is a, c, g, or t
  misc_feature (98)..(98): n is a, c, g, or t
  misc_feature (103)..(103): n is a, c, g, or t
  misc_feature (110)..(110): n is a, c, g, or t
  misc_feature (178)..(178): n is a, c, g, or t
  misc_feature (219)..(219): n is a, c, g, or t
  misc_feature (221)..(223): n is a, c, g, or t
ctcgtgcntggttaccatatgtattcatctgttgggatcttgtaaacatgaaaagggctttattttcaaaaattaacttcaaaataagtgtatanncntgcanctgttgntttcctcaacatggctcacaaatttctatcccaaatcttttctgaaggtgaagggtttagttttaacnctgcactgcaacaagttcacttcatatataacggattattntnnntcttttgaggtgaatataatttatattacaatggaaaggttctttaatactaaggatt

SEQ ID NO: 494932 - DNA, 674 bp, Homo sapiens
  misc_feature (136)..(136): n is a, c, g, or t
tgtcctgtgccgcaagcgaactggtgtgctgcggctgcggtgccccgcgggggttagaggtcaccatgctgaggtgtcgcgtggaggacgctgagtttgattctggaccctgtggctgttacccatgtgtcctagntaccctgtgtgctgcctgggctggtgggagctgccaagtttcctttcaaccatgtgtggtgcctgcatgcctcgaagtctcctcctccagtgccgcgcgctggatatgtcgtcctggaaaccagcccatgtctaggcttggatgatgacccacctccttctacgctgctcaaagactaccagaattgtccctgtgaattgagaaggttgatgatgtcgtgaaaatgactcttgtctttggaaattggccaacaatgaaggagatgctaaaaatcaagcaatgaacatgtttatgaaggaagatttgtttgcaaacccagatggacaccagatccctggaggctcgaattatttgccttgtcttgtcaggatccgcagttaatgaagaacacttggagaaacatcgtaatggacaaagcccacaaacgctatctgctaattgagcatttgaccagatgcacacaagatgctcaaaacctccgtaacaccaactatgatttctttgaggaggatatgctggggcctgtgaattgagtacc

SEQ ID NO: 494933 - DNA, 199 bp, Homo sapiens
ggtcagtgtctctacagctgctctcaacccatcatgtctttgttgatacagtttattcatattccttagtattttcttaagtctgaagtcccagagattatatagacacatttatggctctcgatagcattgccaactgttttctaaaagggtgtaaccgtgtcaaatgccactgggggaaaaatcgccacgcaaaacc

SEQ ID NO: 494934 - DNA, 109 bp, Homo sapiens
agactgctccattatcccgtctcatgtcaggatcacttgtgtagaccactatataggcagaagcacaaatctcaataccggaagaaccatcatcataaccattgggttc

SEQ ID NO: 494935 - DNA, 173 bp, Homo sapiens
tctgaagcctgggatttcttgtaatagtggctgaggtgattctttcagtggccaccattctgcttgtgaaaagtacacaccaaataaaaagaagcactcatgataggggaaagaatttgagcagattgaacagctgaaatcagatgatagccatggtatagaatcatcatgtc

SEQ ID NO: 494936 - DNA, 137 bp, Homo sapiens
actgatgcatcgtaacgatcgccgatgcgcttcgataacgagcgctccgtaactgacgccctagaatgtgtttacatctgggatcgcgattttcttttcttggtggcgctgtacggagggctgtacggaggcgtgtt

SEQ ID NO: 494937 - DNA, 251 bp, Homo sapiens
caggcacggctagtctcgcgaacgtgtatccctcgcgaacgtgtgatcccaacgttaaatctcctcttaagtcattcagacctaccaggtatctcatcattttcatttcttgaaagagtcatcattttctttttctttttcttttgagacggagtcgggctctgtcacccaggctggagtgcagtggcatgatctcggctctaccttgtctatatcaaccaacaccttttctgggataacacgttcgcgag

SEQ ID NO: 494938 - DNA, 462 bp, Homo sapiens
acccagtccagcactagcaaaacagagtcggagtgacacgaaggccgggaaggctatgtccacagggggtcttcggcaggtaccaggagttactagagtcactatcgggaaatctaaaaatatcctcttggtcatccaaaacccagatgtctacaagagccctggtacagatacttacctagtttggggggaagccaagatcgaagattaatcccagcaagcacaattagcagctgttgagaaattcacagttcagggtgaagctgtctcaaactttccagaaaacacacagactccaattgtccaagaggagcgtgacgaggaagaggtcgataacccaggtgtagaagtcagggacataacatgggtcatgtcacacgcaaatgtgtcgcaagcaaaggcagtccgagccctgaaaaacacgagtaatgatttggcacctgcgattatggacataccaat

SEQ ID NO: 494939 - DNA, 310 bp, Homo sapiens
  misc_feature (106)..(106): n is a, c, g, or t
  misc_feature (166)..(166): n is a, c, g, or t
  misc_feature (220)..(220): n is a, c, g, or t
  misc_feature (239)..(239): n is a, c, g, or t
  misc_feature (259)..(259): n is a, c, g, or t
tatcttactgtgttctgggatccaggagcctagtttttagaacctcctccaaccaagaccacttcattattccagaagactcactgaaccctttcttatgtacggntttcactactttcccagatcccctgtgtttagatctggcaaaaaaactagtactagccanagaaatatgcaccctggctaaacttagacaattgagtatctgctttccacaggntctttccatttcacagcanccttgcaggccatgtgttanaaatggtgctatacaagatgaaaggagtctgggatcccgagttactgcttg

SEQ ID NO: 494940 - DNA, 112 bp, Homo sapiens
agaaaaactcttggcttgttagaagaaagtatattctttctagaatttgggtgccaggaatatgtgttcatatcccagggcaaacgggtgtgtttttatcttcagacatgaa

SEQ ID NO: 494941 - DNA, 399 bp, Homo sapiens
  misc_feature (9)..(10): n is a, c, g, or t
  misc_feature (16)..(16): n is a, c, g, or t
  misc_feature (24)..(24): n is a, c, g, or t
  misc_feature (60)..(60): n is a, c, g, or t
  misc_feature (235)..(235): n is a, c, g, or t
  misc_feature (341)..(341): n is a, c, g, or t
  misc_feature (373)..(373): n is a, c, g, or t
gtgaagttnngtgttnccttcacntacaaaaaagagaggttttgtttgtttgtttgttcngttgtttgttagctgagtcaggatctggctctgttgcccaggctgaaatgcagtggcaagatcacgcctcactgaggcctcaactcccgaggctcaagcaatattctcccacctcagcctcccaagtagctgggactacagacttgcgccaccacacctgcctaatttttttttnatttctaggagagaagaggtcttggtatgtcgcccaggctgttctcaaattcctgagctcaacggatcctcccacctgggcttcccaaagtgctgggataacaggnatgagccaacctgcccagccagaaaagagagnttttaatgcttatgtgctttatgtga

SEQ ID NO: 494942 - DNA, 267 bp, Homo sapiens
ggggaagatcatttgccaaaaggcagctactgcaagtttttgggttcccttgtactgtaacaacataaaccagcacgcggttcccccccggggccaacctctccccgggccctcaggaaagtgaccagtgacccctggggttaggaaggtggctccagtaaagggttttggctgcctttggggaatgctgccttttgtttgggcctgtaaaattggtttgtgtcctgaccagccccaaaaatatacttccctgccctgaaaaacaga

SEQ ID NO: 494943 - DNA, 135 bp, Homo sapiens
gggtccacagggcgcaaaattcaagttagaaacccttccctttcttgctaggtgtccaaaacccttcgggggggccctttctctccttatggatcccttagaggcacaagcaaatctttttttttccttaaccag

SEQ ID NO: 494944 - DNA, 997 bp, Homo sapiens
  misc_feature (240)..(240): n is a, c, g, or t
caaacttggtggaatggagattccgaaaagagcaagcccaagggaaagtcaatgtctttggccgctaagctcagggttaatggcagaaaccttccatttcagcttgatctgttgactcgaacaatcagaagactagaagaacgatctatgacgaccaccgtaaaatttctactatagtgaatcggcctacgacacgatctgggcacccgagctctctggactgccaagtcagggcatagncctgatggcctgtcaactgtcaccatattgtcattccagcacgggtcaaagtttgccacgtcaatccgagacgtaggacaacccacatcagtcgggaggaacagtcagcatctcagtgaccgcgactagcggcgaacggatccgtgtctcgcggctctttgctcgtattggttagaacatgggcagttcacacgataattgtagacataggtccaatggtatcttctagcttcatagccagcggcaagtacatcattctgagattacgatgatgtgcggaccgcactgtctgctcagtctagcgcatggcctcgagtgtggcttcgcgcagcaaccaactgcgaggaccatccgatcgcattggctagctaccggcaacatatacaaacccccgcggaaagctaacgccttcgcagtcatcgagcggactacaagcgatggcaagggctgcttctagctaacagctttcttgggtacaagtcggagggtctctatgtcaaatagccagaaggcagactaggctctcagaaattttatatgatagcacgagagtcagtgtgacctactgatgacacagcaggagtcctaaagacagtaaacctccagagggatggtggtattgtgcaccattaggatacaggcaaagttggtccccctggattggacaggcagattttcccggcttcaagtgaaagaatggggattggtaaatggcaagattggactattaggttttgaaaacaggttttgagtgaca

SEQ ID NO: 494945 - DNA, 400 bp, Homo sapiens
ctcttgtcatacagaacgtccatggtgtcgcccacatagtacctgagcccatctagctcggtctccagcagcgttcgctcatccgccagccacacggtgttggcaaacctatgtggtgagtggggcaccctggcaggcaggaggaatatctctccgtgccgaatgacctcatcccggtgtttcccatgctgcaggactcggagaaccatgtctccctccagctggtgaaatacctcttcaccctattcgatgtgatagtccttcctggtgttggggcctccgacgaacatgactgtgagctgctcctggtgcatgagcttgttgcagaccgggggctggaaggagcaacggttctccttcacccaggccctcactcacaggcggcgctccatgactgtcc

SEQ ID NO: 494946 - DNA, 915 bp, Homo sapiens
  misc_feature (32)..(32): n is a, c, g, or t
  misc_feature (63)..(63): n is a, c, g, or t
  misc_feature (76)..(76): n is a, c, g, or t
  misc_feature (78)..(78): n is a, c, g, or t
  misc_feature (82)..(82): n is a, c, g, or t
  misc_feature (88)..(88): n is a, c, g, or t
  misc_feature (92)..(92): n is a, c, g, or t
  misc_feature (109)..(109): n is a, c, g, or t
  misc_feature (114)..(114): n is a, c, g, or t
  misc_feature (367)..(367): n is a, c, g, or t
  misc_feature (557)..(557): n is a, c, g, or t
  misc_feature (560)..(560): n is a, c, g, or t
  misc_feature (574)..(574): n is a, c, g, or t
  misc_feature (747)..(747): n is a, c, g, or t
  misc_feature (764)..(764): n is a, c, g, or t
  misc_feature (792)..(792): n is a, c, g, or t
  misc_feature (812)..(812): n is a, c, g, or t
  misc_feature (821)..(821): n is a, c, g, or t
  misc_feature (832)..(832): n is a, c, g, or t
  misc_feature (894)..(894): n is a, c, g, or t
caaaagggaggcaatactcgttaaaactcagncacaggttctccccgctcgttcccactgggnctccacccacatngnattnagcagnagtngcacgaaaaaaaaaaantcctnataaaagatacaagccgagcacaagaacagagaggttggttgacatttgcaaactccgataagatgcagggggcctcgggagacttggcgtttctcccaaagggctccccaacaccattctccttcctcctcgattttctggttgacaaatagttggaaagctcacttcgcttgggaggtgactcgggggaacttgatcgggggaactttcatcctgttaggaactcccgctttccattcctgggtctctgtnttgctccctggagaaggatggatcacggagggggccacagtcagctggggcagcaggtactccctacggcactagtctacagggggaaggacgctctgtgctggcagcggtggctcacgtggcctgtctgcactgtaaccacaggctgggatgtagccaggacttggtctccttggaagacaggtctgangtntggccaatccagtncttcagaccctgtctgaaacttgtatcttacgtgaacttaaagaataaaatgcatttctaccccgatctcgcccccaggactggcacgacaggcccacggcagaatagatcttttcccagttctgatcggtgcgtggaattccagccaccacttctgattcgatttcacagtnatcctgttctctgagtnttttaaagaagccattgtcaccccagtnagtgttccaggagtgggcancagccagtngggtgtgccantctccactccccagcccaggatgcggatggcatggcacccatcatctctccggtgacgtgtnggtacctcctgacttgtagag

SEQ ID NO: 494947 - DNA, 154 bp, Homo sapiens
  misc_feature (36)..(36): n is a, c, g, or t
  misc_feature (126)..(126): n is a, c, g, or t
cgttgttaaacggcggcccgtggattggattttggnggcccttttgaagggctttggcgttgcctgcccgggttcgttagcttgggtccttttgggcggccgccttcttcttcttctttggtgcgngaaggcggccggatgggcccccaatcca

SEQ ID NO: 494948 - DNA, 1255 bp, Homo sapiens
gttttgttttttctttttgtcccttggtttccctatctctaggttgttccgtctcttgtgttgtccttcgtgtttgttcgttgtgttcttgcctttgttctgctttttgtgtgatgttgtccccttgtttttcatttgtgctctcgcttggggttgtgccttcgtggtcgtttctgcactgtgggtccctgcgatgcgttttcttctgatgtatgcttcgtgtttgggcttttctcgtcctgtgccctggtgccgtgcgtccttggcgtgcgttgtcttgttcctggctgtctttcttgtttgtcctcttcctttgtgtgcctctttcttgtcttcgcggtttgtttttattgttcttttatttttgttgttcgttttttctttttttctgtttagctgtgggtcttgtggatgttcctttctggtggtgtctgtcccttctttgctcatgcacctggtattatgtggtatgttcctttatagttcttggtgatttgtcatggggccctgccttttatctaggttgttgtgcctgatctcgttgatgcccctatgtggccttgtcagtgtggttggatatcgccatgatctccgtcagttagtctccatgatgtcatgttctccatgccctcatggtagctccatggattatgtgtaattcgtgttgtgttttagtgtgtgtgtttatgggattcgggtgtgcagtcgttcatgggtccatgtattgtggtgccccctccctctcctctcctctcctatggtgagcccagcgtgggcaccgggccgtctcatgcctgtgttcccagggctgggaggacagtctctggcccttcttaggcttatgcctgcgtcccaagtctattctgtaatgccatgtttgggtctgtgttaataggaatgcatgtgtttttggttctgatttctgcctctgtagtctcaagtggggtgcagcccccagagtctctgtgcattgcttgccaagcgctcctatatgctgttcgccataactgctactacgatgctgcttgccattccaggtgcatgtgcatggccttgcgaatgggtttatctggcgttctgtctctggtgggcttctcactgcatgggtagttgtgttcctgtgtcatagggggagctgttgctccaggacaggatgtctgtcttccctattctgagggtacatgtccttaacgatcgcccggtatagtcagtgctcctcacgatacagcacgggattattgtcatgttccacttc

SEQ ID NO: 494949 - DNA, 766 bp, Homo sapiens
tgggctaaattctttaattttgggttaaaatttccactccaattttaattctggaaaaacagcctcgacaacatatatcgcactcattataaaaagcaaggggttatatcaaaaattattagtataaaatcacgggaaatcgggttgggaaccagaaaaaaatacaaaacagatatagatacatagacacgggacaattttttataataattgggaaaagtgttattttcccctaattctgggtctcctttttcttatagtgcgcatacgagtgttataaattttacaaaaaagtgaaaataaagcactagtattttacaaaagtgaataacaagggtcagggtgtggtgtgttctacattaggctttcagtccactctccatagtggtgtggtcccgtggtacagaatatatccacatccgctccacgcgctcttctattatgaacccccttcccaaatacccaacgccccgtggttcaaccttcaacacataggccttccataataataatcatagcccaccatcaagccataagccgggtatacactacaaatccttcggaatcagggggtggaagccattcaaaccatccaaaaatacggcccctagtgtcgggcgcactggcagaagacatgtagccccaaacaacttctcaaattattgaaggtacctttaagacaatacatataaaacatatcaaatgttcataaataagggggctcctttaaacctctaccaccattaacaaacaaccacaaagaaac

SEQ ID NO: 494950 - DNA, 171 bp, Homo sapiens
aaaatttgtttttggaaataaacaagggactttagtgtattaaaaaaaaaaaagaaagaaaagaagaagccaaaagtctaagctagatttaccacatgctaaaatatttgtatgtcagggactgtgcaattaaacttgaagttacttactggaattcaacaaaaaaaaaaa

SEQ ID NO: 494951 - DNA, 1354 bp, Homo sapiens
  misc_feature (747)..(747): n is a, c, g, or t
gcgggtatgcttcattcgatcggcttgggggcatggtgtctgggagaagagtagcatcagaccctagtgcgacggtcatgtccagtatttatgcaggttgctttgacctgaacccttagctagaatcttaaatgaaagaagctgctaggtaggtatgggtgtgttacgacagtacatcgcgtgcatgtggacctggtagagcatcatgatcttgtgaggcctgcttccctgtacagtgtggctactcatgttgactgctcatatctggtgtctccccgtggtagcagatgctctggatctggatgggagtctagagccagacttgaacacacaattaggttggcatgtctagacttgtttgttgccttggtgcctttgctactcggtactgggccagaaagcatagcatatgatttagacgctgggagcactgtctgacgtagtagtagatccaagtgacagggatggctatctatcgttcacgtgacgttatccttacgttccactctcgacatgtcaatcagtgcactaacgctcgctaataaggagctactacgactggaccctggattggaccactcaagaagccatcctggatgaggttcgttggatattggacatctccttgattgtgcatttattgtggagaaaccatggtagccctaaggattcgttgatctatgctgggttccatatttaatcggactgttggtcaatctgtgggactgactcctagaggagtttccntcctgaatagcgcagtcttgtgattggggacgcccatgtcggggtggaattccagttcacaagatccatccacggcgtaacgttcggttgccccggctctcaggaatgttttaacggaaaaggtgaagttcccgattgctgtggtcatccgtattgtggttaacgccccctgtgttagcgctgtacaggggcaagtgtgttggagacgtaaaaaggggtctgagtgggagcccaggttgcattgtgcgggggcacaaaagggacaaaagcttgaggcaaatagaaatgcgacataggaggacgcgaaccgagcaaacgggaaagagttaaaacagtttatagacagcatagctgtcttctctttctctccaattttctctctcttagttcctgaggccagggcaggagcaagcagaggagcaagaggtgggaaaggagaggaggcaggcaggagcgggagcgccgaagaggggaaagagaagaggaagagaaggaagagagagaagagggaggcagaaggggagaagagggaagaacgagaaagaggcagcgagtgctggtaacagcggagaaggagaaggaaagagcagaggaggagggaagggat

SEQ ID NO: 494952 - DNA, 96 bp, Homo sapiens
cccccccccccccccccccttctcccttttgaagaaccgggaaaaaaaaaatttaaacaaaaaagggggggattgacccccccaaaggggggttta

SEQ ID NO: 494953 - DNA, 945 bp, Homo sapiens
tggggggcggggggggagagaggcgcgggagagaagggggggggggggaggagacactatctcctcctctatcaaaagcgcgcgcgcggggggggggggagagagagacaaacaaaagagagagaggggtgaagaggggggcgccccccgcgcagaagcggggggtgagaggcggggcgcgcgcgcgtccacaaaaaacagacgggggggtgtaagaaaagaggggtgcggggagggacacacaaaaagggggcgggtgagaactctctgtgaggagagagagtagaggggcgccgatatgggcgcgccccgacgagagagagagagagagggcgggggggcggaggtgggtagagaatatactatataagagaggagaggggtgtgtttcggcggcaccacagaaaaaagcgagggcgggagaggcgcggcccggcgcggtgttctccccgaggcgtgtgcagagcccaccccgtagaaaaatagagagtagggagacaatccctcacccagacggggggggagcggcgaggagagggtccgtccgcggcgagagaccacgagcgcgagagggggggagcggaaaagaccaccaccattgcaggggcgcccccgaggggtgtcatccagcgagcgggcggagggggcgacaacaaaaatacacagaagaccgagggcgagggtcatcgaaccccgcaaagggccgcggagacaaaaagaggggggcgcagaggaaacatcaagcggcacccccccaaaaataggcacaagcacagaagccaccagagagacaggaaggaaggggcgcaacacggcaggtcacaaaaccacctaacgcgacacaaagcaggagggaggcccagcccgcccgccacagcgcgcgcacgaagcaacaacgggggggatgaaaaagtgggaaggggggcaggtgaccacccccccccg

SEQ ID NO: 494954 - DNA, 291 bp, Homo sapiens
cttgtactacccacgtgataacactgaatactggacgtgtttatacctgactaccttggacctgaactgaggaaacagcgatatgctgataatgagtagatggtagttaatcactcaggaactgtatagtcgatccagatacacacatctctaagaatagggggtccaaagcataatgctcgtggcatgaacaataagattacgagacagatgtcaggactcttgttggagagcctggatgactaagtgacatatgataggtgggcggcacggatatcatccagcctgcgt

SEQ ID NO: 494955 - DNA, 424 bp, Homo sapiens
ctgagggaccgtcttgtcctctcaaacgtgtcttcctgtgaacactgctgtctgggtccggactgctctagcagaaatgctatcactgtgtcatgaaagttatacttaactagggttaggccagaccaatactcagtgtcatttctacagactcagagtgctataattttagctattcccttttatttctgatgtcattttgttcataggtttctagaccaactggggagattcccgttaaaaagtatgtatactgaaacatagatattagatcatctagtttccaaaattgtgtaataggatttaggcatcaagtatgtgaacagtttatattctgtcatagtacatatctatttttggtatcatttcatttgtttccccttaagaaataaaagctatagtctccagttatctacactgaaac

SEQ ID NO: 494956 - DNA, 207 bp, Homo sapiens
acccctagaggatcccgacgctctctctgtggggcggcgagtcgtccgagggctcccgcacctcgggctgcggcaccagacatgtgggcatcatctcttagtgggccatgtggccagtgaacccttcatgaaaccacctctgcagtcctggagagttgctgtagaagaaggaaaagagaggaagacaacacaacacagagagagcgt

SEQ ID NO: 494957 - DNA, 437 bp, Homo sapiens
cgtcgacggccaacctctggaaatagctttgcccaagccctgagggtgcacaaccaaagagaaaccaccgtgcattggccccggggccagttttgctcagagacatggaaaagaaagagcaatatttttatgtgaagccagatatattattggaaagctaaatatacatgaattaaagaaatgtcacacgttgccggtgggctgctgtgggctgtcccgtttccatactcttcctggaatgtgaggacttgtttcttgcttctgtgcctttagagactgacctggcgtgggctggaagggccagcagagactgtctataaagtcctggctaagacaggcttcagaatgaatacgctcatttaaccaaaatctgccttagaccttttacttcctcctcccgccagacatacccctaagtcgacgcggccgcgaattta

SEQ ID NO: 494958 - DNA, 999 bp, Homo sapiens
  misc_feature (39)..(39): n is a, c, g, or t
tgacaggatacgaggctgggatgttatcagacaggcggngcatcttcgaacttagacttccggaaggactttggcgaggggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtgggagaagagggggtgggcccccggatgagacttctcaggtgagccacaagtggaagtgggcgcgggaagcctgactagcgggtgcgaacccaggttttggaaaacacgggagccaggcaacatagccggggggccaggaaatagtggggccacggagcgcagcgaagacacaacgccgcggcggcgtcc

SEQ ID NO: 494959 - DNA, 221 bp, Homo sapiens
  misc_feature (79)..(79): n is a, c, g, or t
  misc_feature (85)..(85): n is a, c, g, or t
gcattgcgttttgagtctcgggacccctgttagagagactatggcgctcaacaagaatcactcgggtgggctttggagngatcgncattttcaccgagagcattctattgtcctatgatcacgtggaactcacattcagtgacatgaagaacgtgccagaagccttggaggggaccatgaaaggcactgggtacgttaccccttgagggggtatgtttctg

SEQ ID NO: 494960 - DNA, 912 bp, Homo sapiens
  misc_feature (39)..(39): n is a, c, g, or t
tgacaggatacgaggctgggatgttatcagacaggcggngcatcttcgaacttagacttccggaaggactttggcgaggggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtgggaatttttgtatttttaaggacttgggttgaggattctcaaaaggcttgcagccctggggcttggtctgaggggccccaggggggagccctacataacgggaaaagtggagctcgtgctgccctgtggaagagtggtgtgcgcccggtcacgtttcttccccggtgcgctcactggacatgtgggcagtgatcactatacgctgtgtgcagaggcatggctctggaggacacgcggg

SEQ ID NO: 494961 - DNA, 610 bp, Homo sapiens
aggcattgaggcagccagcgcagggccttctgctgaggggccagccggagcttgaggaacccgcagataagtttttttctctttgaaggatagagattaatccacctacttaaaaattatagccaataggttactaagatatggctaagcgttaagtttttaacgtaattttaatagcttaggattttaggagaaattatgaggacttagaagagtagcatgaggaaggaaaggataaagggtttctaaaccatgacggaggttgagatgaagcttcttcatggagtaaaaaaggtatttaaaggaaaattgagagaagggactacagagccccgaattattaccattagagggccattgctttaagattaaaaggaaggtgacttaaccagcttaaggtttagttaaaaggttgtaggtgattaaaataattggaaggcgaccttttaaaaggagattaacccgaaggtgattaaaggaccttgaaatccatgacgcagggttgcgccatttaaggcctagttaacgcatttactaaacgcagacgtggaaggattaatggaagtggtaggatgaaccatttggagaagattgaagtttgagtgaattg

SEQ ID NO: 494962 - DNA, 541 bp, Homo sapiens
ttttactaaaaagcactgctctagaggcaagagctctagaactctttaattaaagtgaaataaaatgaaaggctctgtttctcagctgcgctagccacattttaggtgcttggtagctaattggagctagcaactggcatattggggagcacagataatggatcatttccatccccacagaaagttttattggactgtgcggctgtagaatccctctccttcattaatgcttcttctgtttctccagccgagagcagaaacattcatactgggagtttgctgagtggattcctttagcctggaagtggcacttgttatctgagctgtaagttgaagcaacatctctgtagcttaggaagggtgacaccatgaggccgctccctacctgccccaggaggagaagtctccattgttttctgtacaacgtgaagggctacctgaagatggcaccctctaccgaataaacaggtgaagattgcacatccgcccttttttctgattctttcattaattcctttcttcatcccatctttgatttttc

SEQ ID NO: 494963 - DNA, 358 bp, Homo sapiens
ggctcgtgtaccgatgtgatgcatgtagagggaggtcacgctgtggatgtctgcatggaatgcatggccagacagctccgggatccgtctcactgtcaaactcgtgccgaagcctctggatgttggaagacacgcctgaaagccggtatgatcccatccaagccccctgaagcttcgccggtgcattcgttctcataatcgcccacgggcttacatcctcattactattctgcctagcaaactcataactactaacggcgctcacagtcgcatcataagtgcctctctcaaggacttcagactctactcccactaatagctttttgatgacttctagcacgcctcgctgacctcgcct

SEQ ID NO: 494964 - DNA, 204 bp, Homo sapiens
tctagaggcggggtttcaccatgttgcccaggtgggtctcaaactccggggcctcaagtgatctgcctgccttggctcccaaagtgcggggattacaggcatgagccacggcaccgggctaacttttccattttaatcagttatttcccatataaactttacaaaattcactattacatcccatcctcaggggtaccgagctcg

SEQ ID NO: 494965 - DNA, 573 bp, Homo sapiens
gagacctgtcaagaagggagaacctgtgaaggaatattaagagaggggagaggagtaagggagactattccatagggcgggagtttcaaagaggcataagggaatcctgtgaatcaaataccatggagatgttgaggaagctgaacagaaaataggtaacagattttgcattttcgatggaggagtagagcagaaggtgaagaagtcattatagtggttgaaacacaaatcttttaagatgctgatagggcagtgattggagggggaggtattgccaaagaagataaaaactgggaaagagctgtctctgggactttgtccaacctgtagaatttgctcccttatattttcttcaatttgatcctcagaaacagaaaccacactgccgaggaatggctcccaatggcttaccaaatcatatcatggctcctgtttggaagtgcctccatctcaccaaggacttgtgagacttggggacagggggctggggttaataaaggggtggtagaggagtgcaagggcggtattgaagtggggccgtgggaaagagaagcactcatgggtggaataccg

SEQ ID NO: 494966 - DNA, 1703 bp, Homo sapiens
  misc_feature (39)..(39): n is a, c, g, or t
  misc_feature (1470)..(1470): n is a, c, g, or t
  misc_feature (1550)..(1550): n is a, c, g, or t
  misc_feature (1554)..(1554): n is a, c, g, or t
  misc_feature (1581)..(1581): n is a, c, g, or t
tgacaggatacgaggctgggatgttatcagacaggcggngcatcttcgaacttagacttccggaaggactttggcgaggggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtgggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaanagggccacttgtctatgggatgcttgtgacaacggtgatctgggacctcaagttctgcccagtggagcatgggaacttcnaggnaccctcggaaggctcctctcctgcccngttgggtctcttggtctggcctgatcagacgggaaacgtagtgctatttcagctctaacaccatccggaggcactgactggtcagaaaacaacaagatgaagatgatggcctgcagtatatc

SEQ ID NO: 494967 - DNA, 1778 bp, Homo sapiens
  misc_feature (39)..(39): n is a, c, g, or t
  misc_feature (1545)..(1545): n is a, c, g, or t
  misc_feature (1625)..(1625): n is a, c, g, or t
  misc_feature (1629)..(1629): n is a, c, g, or t
  misc_feature (1656)..(1656): n is a, c, g, or t
tgacaggatacgaggctgggatgttatcagacaggcggngcatcttcgaacttagacttccggaaggactttggcgaggcttgagtgtgcgtcagaatcccctgaagagcttgttaaaacacaaggtgctggccccatccagaattgctgattcggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtgggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaanagggccacttgtctatgggatgcttgtgacaacggtgatctgggacctcaagttctgcccagtggagcatgggaacttcnaggnaccctcggaaggctcctctcctgcccngttgggtctcttggtctggcctgatcagacgggaaacgtagtgctatttcagctctaacaccatccggaggcactgactggtcagaaaacaacaagatgaagatgatggcctgcagtatatc

SEQ ID NO: 494968 - DNA, 162 bp, Homo sapiens
  misc_feature (49)..(49): n is a, c, g, or t
ccccctcataatgtatgcccattgtaactggaagtaagtaacttgcttntgattttacaggctcataggcagaaagaacttgccttgtctcagataagactttggacttggagttttgggtaatgctagaatggattacgactctgggcacacattatggag

SEQ ID NO: 494969 - DNA, 1618 bp, Homo sapiens
  misc_feature (39)..(39): n is a, c, g, or t
  misc_feature (1385)..(1385): n is a, c, g, or t
  misc_feature (1465)..(1465): n is a, c, g, or t
  misc_feature (1469)..(1469): n is a, c, g, or t
  misc_feature (1496)..(1496): n is a, c, g, or t
tgacaggatacgaggctgggatgttatcagacaggcggngcatcttcgaacttagacttccggaaggactttggcgaggggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtgggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaanagggccacttgtctatgggatgcttgtgacaacggtgatctgggacctcaagttctgcccagtggagcatgggaacttcnaggnaccctcggaaggctcctctcctgcccngttgggtctcttggtctggcctgatcagacgggaaacgtagtgctatttcagctctaacaccatccggaggcactgactggtcagaaaacaacaagatgaagatgatggcctgcagtatatc

SEQ ID NO: 494970 - DNA, 392 bp, Homo sapiens
  misc_feature (90)..(90): n is a, c, g, or t
  misc_feature (219)..(219): n is a, c, g, or t
gcgagctccatgtcaaactcccccaaccagcatcagcagcatgtcgccgtcacccatggtctcgggatcgtcatcgggatcaggaatgtnctcaccgaggaaatcagcgacatcgcgggctatcggccaatcgttggcctgggtcgcgtcggacagaaagacctgcacatttcggccacgcacccggacgatgacgtaaaactggtgatcgatggacancataccgacagccccagcatcaccgggcaaacgcctcagctgggtgatgagctcatcgaagtcattagcgagcatcggttccataggaactgcgacgcgctcaccgtcatcgttgtagagggctactacaaagtcgatctcatcctcgctggcgtcctcgagatcgtcgtcat

SEQ ID NO: 494971 - DNA, 1432 bp, Homo sapiens
  misc_feature (39)..(39): n is a, c, g, or t
  misc_feature (1199)..(1199): n is a, c, g, or t
  misc_feature (1279)..(1279): n is a, c, g, or t
  misc_feature (1283)..(1283): n is a, c, g, or t
  misc_feature (1310)..(1310): n is a, c, g, or t
tgacaggatacgaggctgggatgttatcagacaggcggngcatcttcgaacttagacttccggaaggactttggcgagggatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtgggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaanagggccacttgtctatgggatgcttgtgacaacggtgatctgggacctcaagttctgcccagtggagcatgggaacttcnaggnaccctcggaaggctcctctcctgcccngttgggtctcttggtctggcctgatcagacgggaaacgtagtgctatttcagctctaacaccatccggaggcactgactggtcagaaaacaacaagatgaagatgatggcctgcagtatatc

SEQ ID NO: 494972 - DNA, 635 bp, Homo sapiens
tgcagatgaacatagtgcatccggtatcgaccagatcctgtttcatcatgagcagggtcatgaccactgctcagaaacaagtcctgctgacctatgtcactgttggaaatgcttattcttcagggccataaagaaatagcacttgaggccaggcatggtggctcacgcctgtaatcccgcactttgggaggccgaggccggcggatcacgaggtcaggagatcaagaccattctgaccaacatggtgaaacgccgtctctactaaaaatacaaaaaatcagccgggcgtggtggtacatgcctataatcccagctactcgggaggctgaggcaggacaatcgcctgaaccctggaggtggaggctacggtgagccgagatcgtgccattgcactccagcctgggcaacaagagcgagactgtctcaaaaaataataataacctaaaccactaacggtcttttaatttacaaaaatcatctatggctatttttagcagactaaacgaacttcaataataaaccgggccaggcgtggcagctcacgcctgtaatcctagcactttggcaggccaaggcagggggatcacacggtcaggagtttgagaccagactgaccaacatggtgaaccccatct

SEQ ID NO: 494973 - DNA, 363 bp, Homo sapiens
tgctgaggcgatctagaggatcccttggggctccattcatgggttcatagggaggggcatgaggagggactgggtagggggtatggtgtttcttttgggagtgatgaaagtgtctggggataatatagtgggtaatagtggtacaactctgtaaatatactaacaccaatgaatggtacactttagaagagtgaactttatggtatgtaagttgaatctcaattttttaaaaaaagccaaagggctcaccttaaaaaatggatttcctcacttcggtttcaggccacccaagatatttctaaaaatatagaatggtttacaaggatattggacatttataatcctacagcaacaaatactaca

SEQ ID NO: 494974 - DNA, 123 bp, Homo sapiens
ctgtgctaggaatgtgtcaaatatggaaccaaaagaaacacagtaatatgctcctgtatgaagaaaccaagagttagtgccagccccagtgttactgagggttaggccaaaaacagcccattc

SEQ ID NO: 494975 - DNA, 679 bp, Homo sapiens
agcggactcacaggcatggggggttgctcggatccgggactgccgaagggggtgccacagcagtgcctggtagcgtgggctgtgaccttgtcactaaagcagagaaaccagttcttctgggcccacgaggtagctgtcccatgctctgctgaaccacgggtggctgaacatgcctcttgcaattccatcctgtatgctgactccgtacgtgggcctgtggcgactagtcttgcactcgtgtggagactaccttggagtcagaatgaagccagagaaagccattgggtccctgatttgcccgggaccggagacaggtcaccgaatatgagtacctaccattatgatttcctgcacggaaacgagaggcctccaggaaattgcgtagacggaatcatgcacctgaccaggccagcgtctcgtctgatgtgggcgctggaatgctcctgagtctatccattgtgtagcctgctgtaacgggtactactcggcctgtgatgcaggaggggcatgtgcaccagaaggctgagccaaggagactgagctcaagcatggggaacctgtccacggacttcatggcagctactggagtatagcaagaacagtcagagccatgctaagctcagcgggaggctagagaccaatcaagcagtggcccacggaagcaccagaccactccact

SEQ ID NO: 494976 - DNA, 465 bp, Homo sapiens
  misc_feature (56)..(56): n is a, c, g, or t
tccaggccctgtgggcaccaggatgccgctgtcatccagccagtgggctcgtcctntctcggggccttggggtctgccgttcctggctggcgcaccccctctccaggctgggtcctgagtgtccttgtgttacagaggctcccaacctccttctccccaaggctgttcttctcctgaagcaagcctctgaccacagggtcagctgacccccagggttgggtctgggcttggcaggcagcaccctgggtcgctgtggcttgggttccattcccttgggctattgctcgagccccctcatggccctgagccccgctttcccgccaggctcaagaccatcagcctggtgatccgcggcacgcagggggccgaggaggtgctcagggcccacgaggagcagctcaaggaggcccaggccgtgccggccaccctcccggagctcgaggccaccaaggcctctctgaaggt

SEQ ID NO: 494977 - DNA, 130 bp, Homo sapiens
gggtcctggggccagtctgtcctgactcaacctgcctccgtgtctcgggcttcctcggacaagtcggatctacaatcttcctgcaaccggatccaatcaattgacggttaatggtaattactatggttcc

SEQ ID NO: 494978 - DNA, 143 bp, Homo sapiens
tccattgggctgcttcattgtttagttccagtgtcttcatcttgcacgccaggcttatgcggcaggcagcacatgtttccatgttcattcatactcaaccatgcagttcttctcatagggtgcatcagcattggtccccgcca

SEQ ID NO: 494979 - DNA, 528 bp, Homo sapiens
agttcgacggagactctcgtaaggggtgacttacccctataatcccagcacttcgagaggccaaggtgggagtatggctggaggccaggagttcaataccagcctgggcaacatggtgaagccctgcctttaagaaaaaatacaaaaaattacctgggtgtggtgcagtgtacctgtagctcagctacccaagaggctgaggcaggaggattgcttgagcctaggagatcaagactgcagtgagccatgattgcagcactacactccagcctgagtgacagagcaacactctgtctcaaaaaaaaaaaaaaaaagaaaaggtgaaaagtttgaagatgtgaaccggtgggcctctttaggttaaaagaagtccgggagacggagtaggaacacctagtgagatcaagggaaaaccaagattggttatccacctgtggttcacggagaagggttggaccagtttggtcaagtgcggccgataggtcaggtgacttgcagacggagactggaccattggcttgaacaatt

SEQ ID NO: 494980 - DNA, 102 bp, Homo sapiens
tgacaatcgtgacaatccaatcctgaaccacagaggcttgaagttgtcacgattgtcaccaaccacagaggcttgaagtagcagtagttgtcacgattgtca

SEQ ID NO: 494981 - DNA, 138 bp, Homo sapiens
ggcgagaatcgaaactaagctggggtccatggagcctgcacccgcccgatctccgaggccccagcaggaccccgcctgtgctcaggagtcaccatgcctgtagaaccggacggggaaggacggaagttgtggtcaatt

SEQ ID NO: 494982 - DNA, 82 bp, Homo sapiens
cccgaagatgagacgtgtatcattaagatctgcgaataagataaaaggatatatatatataaaatataataataaaaaagtt

SEQ ID NO: 494983 - DNA, 950 bp, Homo sapiens
atagagataaataaatacatagtaccatcgtcgaaccaggacggacaaggagcgtgatgtcggtgtcgtcgcaggtgttttcccagctagtaagcggtggttgtgtcacgctgtgcgacctggtgcgaagtgccatgtgtggataacgctccgcaacaattatcagccttacacatggtgggtacagccgttatgtcacaggctggaacggatcgggccacctcggggctctggagtcgtaatatttcgcggttttagtcagagtccggagcactttaaattgcgttaatccgggcatgtcgacccacgtagtagtgttgtcctgttttacccgtcaggaaacttgatcaccataatggtgggtacacagtgctacagaagtggctccaatgagaggactcagcaccgtggcgggagcacacaaggttcctacgtctaggcgcttcccaacaccctggtggcggtcgcagaggttcgtacagccacccctggacgtcttgcacaagagttgaatcccgcccccccgacgtgggcccgaagaaccccgccgggcagaaacgcggcccccaagggggaagcgggggggccgggactgtgacccccccagggtcagacccccgttacttgcggtcgaaaggtctcacccggcacaacagcgtcacagatgaggatcgctatcataacaggttcaggaaccgtgagatcgcaccgcgctgaggggtaagacgcttcctcagctgatctggcaacaaactctcacacccaccaacgggcacctcactggccttttccatgtcggaggccacgttcaccagaacaaactgtacaataagggcgaggtttttttatattatttgctcgtgctcggagttggggcaatagaaaacccgcagccccgttgtgcttccaggaccacaaaaaaagaaaaaattctcgcaacaaacataaca

SEQ ID NO: 494984 - DNA, 829 bp, Homo sapiens
cgcagtggctcatgcctataatcccagcacttggggggccaaggcgggtggatcacctgaggtcaggagttcgagaccagcctgaccaacatggtgaaaccccatctctactaaaaaaaaatacaaaaattagctgggcgtggtggcgggcacctgtaatcccagctactcaggaagctgaggcaggagaatcgcttgaacctgggagctggaggttgcagtgaaccaagatcacgccatcgcactccagcctgagcgacagagtgagaccttgtctcaaaaaaaaaaaaaacaaaaaaggttcttagatgtgacccaaagggccctatcttataaaattttaaaaccggataatttagaaccccatctcaactaaaagccttaactctatgaaagacccggttaagaggatgaaaagacaggctacgggccaagagaacaattttggcaaacacccaagtgcgacaaagggactgtgtatcttgaaaaacacaagcactcacaaagggcttaatatcttggtaacacaaaccttcagtaatagttaaacgcagggtcttctcagtgatgtaccacattagaggcaaacaccctttcttggctgggcagaatgggtcaaatccctaagtggggatcagctttggaccgttttacctttggacattttcaaaggggtcctgtgagaataatctttaaagaaatcccttaacatgtgacagaatactatttcacctcccccggggacaatcttccctatattgcccttattatgtgcaaacggttggacgtccctaaattcccgcgctggagcatagttaaagtccgttga

SEQ ID NO: 494985 - DNA, 964 bp, Homo sapiens
gcgctcctcctccatggctgaccgctccatccgcactgtctggagtaggcctggtaccatggctggagtctcatggttgatagctttgagtaggaagcgagacaactgctgtcgagcaagaggaaaggaaatccttcgtggtagatagtgatcctacagtgatccataatattgcctaggactatgaggctacgatcgagctgtagcggagaaagcagaggtacattaaattcgtgtacatgctaagaccgtatatgatgggaagtaactctctagcgcttgaagtgtcatgtcagcacatctgccttagacctccccctagcaatgcatatgaatccctaaagcatcctcatctaaggattcattgtttgaggtggtcgaaattaatgtatctggatgatttgggaatatgcctagcagtcatgttactgtcgctctacagtgcatgttcatctgaggtgcccctagggtggccagtatgcattcggaacgtttcaatccatatggttgtgggtggtgctcttgaagatcagaaggatacgtcaagagcaagattagacgacttctgctttagaaactcattgagaagtctgacagggcatcaaggtattagagcattctaaaggggctggttccgtaactctgtacaaatgcttatgggattcaatttgtctttaatgctagaacgttactgcagtcaccagggtgatatgctggggaacttcttttactgagaactagaatcttgctggtataacacgtgctgacaagattatgttcgatacggaaaattcccaagattgtcgttggaagcaatgcacattaggtgcgtctgagagtgagaactgctggtcagacgccgtccagggggacccggtggggaacctcgcggcacgagtttggggaacgggtataaatcagcaaaacagggcggggaaattagttttgtggtggtgctttttct

SEQ ID NO: 494986 - DNA, 374 bp, Homo sapiens
ataaggacaaactacagacacatgcaacatcaatcactctcaaaaacatggaggatccgtcattggaaaaccagaatcacgagtaaatatgtaggctgggcacggtggttcacgcccataatcccagaactttgggagcccaaggtgggtgcattatgaggtcaggagtttgagaccagcctcgccaacatgctgaaactccgtctctaccaaacatacaaaaattagctgggcatggtggcacatgcctgtaatccgagctacttgggaggctgaggcaggagaattgcttgaacccgggagatggaggttacagtgagccgagatcatgacagtgcactccagcctgggtgacagagcgagactctgtctca

SEQ ID NO: 494987 - DNA, 407 bp, Homo sapiens
tatcaaaactattttttgggccagttaatctgtccatttggataaatttgggtggggatgaaaaaaaaaaaaaaaaaaaaaaaaaaaaaaaaaaaaaaaaaaaaaaaaaaaaaaaaaaaaaaaaaaaaaaaaaaaacaagagcaacaaacacataggagcaaacaaagacagaagacagtaccagacgacagaagcagggctcagagcagaaaaggacatgccgggcgagcgaccgaacaccacgagggcgtgagctggagacaaaacagcaggtgcgcaacgactgacggcgacatgcacgagcacgccgacaccaagacagacgcaccgcgcaccgcagcagcagaccaggaggagaggcaagaccgagctcacgagcagcaccgcgcacgagcgcccacaggcc

SEQ ID NO: 494988 - DNA, 177 bp, Homo sapiens
gctcggcgacgagggcctctacacctgctccttcgagacccgccacgagtcgtacacctagcatcagagtctacctcattgtccacgtccctgcccgcataggtgaactatctcgttcgccttgtgacaggtagaatgatggggggcgatgtgaacctggctattgcctggaccgtg

SEQ ID NO: 494989 - DNA, 360 bp, Homo sapiens
gtatgtccctttagaagagggttgtttcagtcggcccagtcactgccatggactcgcgggaaggccatgtcctttctccctcagccccttcccgttccggtttacatctcaggggaaaggccgcggggtctcccagcccgtcaccccgctgggtgtcagccagggctgcacggcgcccttggcctgggcagtctgagacttcctccgctggcttggggatgcgggggtcagcccgggcccgggccaccgcggcgacgcgcgtggcggggggggcagaggttagaccgtgctggaagtccgggtgcgggaagaagggacaggtgcggggagcagagggccgcagccctagcggctctcctt

SEQ ID NO: 494990 - DNA, 602 bp, Homo sapiens
gtggggatgagatttgcatggctgctggtatgcgtgcgagcctgctgacgggagtgtccctggccacggtgaacggccagcctaacgtgagctctggactttgtgggacagctgtcagtggcctagtgcctgcaggacaccatgaatgcaactgccagtcttggaacctgtgatgacaatgcccatgtgaaatgcaacattggtacaccgttgacttgtccctgtgtgacagcccctgtgctctgagtttggccacaggcttgttcagtagtttagccccacatgtttggtaactgccaatgatgagtggaatgtgtcttcattgtatgggggagcaaatccaaacatgaatgcttctcagactgtgcacaccatggatcttgggaaaacaccagtgggacttagatacctgcaagggcctcttgccccgggtatgaacatgctagcttcattccctcctgcacacctgaccgtatctgggtatttggaggtgccaaccaatcaggaacattgaaattgtctaacaagtcctgaatcctgaaaaccaggacgtggaccacgccagaagtgaccatgcccccatcattcccaagaacattcca

SEQ ID NO: 494991 - DNA, 339 bp, Homo sapiens
atcattggataagcagatgaggggtcattggataagcggatgaggggtcattggataagcggatgaggggtcattggataagcggatgaggggtcattggataagcggatgaggggtcattggataagcggatgaggggtcattggataagcggatgaggggtcattggataagcggatgaggggtcattggataagcggatgaggggtcattggataagcggatgaggggtcattggataagcggatgaggggtcattggataagcggatgaggggtcattggataagcggatgaggggtcattgaataagcggatgaggggcggtgggtcattggca

SEQ ID NO: 494992 - DNA, 484 bp, Homo sapiens
  misc_feature (58)..(58): n is a, c, g, or t
ccatctatgggccaatctacccatgggatcccctatggtgggccattcccattgtttnttgatccaaccctgataacattgctcacatgaaggcccaagggagcagctgttaggattggacttccaacacaatgtcggagtacagacctgctgaatgcactgaagacagtaattaatgatcctttgtgagtagaacaatgtttttcactaggtggtatttgtggacagcttctcttgtcaatagtgagcatgagtttcatcctttttataagagagtaatcttgaaagaatttaaatgatataaccaatctgaaatctgctttgtttttatcatctattatttaaaaattgtgtttgaatcccatacatctaatgagtaaccagttagtgaagcaattttctaaacaaaaataattttaaaatgatatagataatataaaaaatacatttcttaaaattttaacatgaatccatagaagaaagg

SEQ ID NO: 494993 - DNA, 788 bp, Homo sapiens
ttttttttttttggggaaggggggacaaggtctctgtcacccaggcgggagtgcaggggtgtgatcacagcttactgcaaccttgagcttctgggctcaagggatcctcccaccacctcattctcccagatggagctcccttccaaaggatcgttcctctcatggcacagccatattacaaagggtttccgtgctcaaggtgagtgtttgggtaagaacttcgcgtgagttccacgtggtggattacagttggtatggactactacgtgtaaattatagctggttgggagggatattagtcattatttaattcatgaccggtagactacaattcgaacttagggtaacctcagctctttagccattacggctatatttcttttccccaagttcacaaacaaactggataagcgtgcgtgggtttaaagcagaaggcacaccgtggtcagaatcttacccttaccctttaattgcggttacagtggcaccgtgagaagttttcacttcagaaccaggggaattttcccttaggaagggctcaacaggtgccagactcagaccagtgcacggctaagggtgaaaccacgcctgacagcgggaccagggattcccgacaaacacatgtgccagcatagttgagggcaataattcgggctccaaaggaatacgaaaacagcccaaccatgttgcccaacttgggaaccattgggtgaagggactagatctaacaatccccttacttcccaaccaaaaccctaaggtggaaaactctaatttatcaccctgcg

SEQ ID NO: 494994 - DNA, 152 bp, Homo sapiens
tcgagctcggtcccttgttaaggttgatttccagccacaagttacaatggcaacagcctgctgtacatgtacaaggtcaggaacctttgactgcttccatgttggcatcatgcccctcctcaagagcaaaagcaaatgttagggtgaacggc

SEQ ID NO: 494995 - DNA, 201 bp, Homo sapiens
accgctctcgtgagactgagcgtggaaacaaatccgacatatccatgaggattcgggtttgatctctggccctgctcagtgggttaaggatccaccattgccttgagctgcagtgtaggtcgaagacgctccttggatcccgagttgttacggctgtggtgtaggtctgtagctgtagtcccatttgactctgagcctggg

SEQ ID NO: 494996 - DNA, 585 bp, Homo sapiens
ttttttttggaagaataatgaacattcaccaggcatttactcgcagccaaacctaacccaacctaccacggttaagaatgtgttataacatgcactcatctacggccgaccatcaaccgagattagatatctggaggatgatccactagaagctcacattcaattaaaggctaggattaatttgtggatcatgctgaccaaaaagtagcgcaaggagaccgatggacacaagtctgtcacacacgagcaaatcctaggtatgcacaaatacgggaaaaaacctgttgtagttgtacgcacgcagacacaagagttaacatgtgaggagctctcagcacatcgagtcgaattgtaaggaatgtacaacaggggacgtaatgttagtccttttaccacactctactaaaagtgcctgagctaggcaggaccccagtgggccatgaaatctatcgcatgcggctacgtggaaccggccacatccaatcccctaagaacccaccggaacataacggactatgagcgagcgctagcaagctctataacgaattatggaggtgccccaggggagcgcactagattgccacc

SEQ ID NO: 494997 - DNA, 733 bp, Homo sapiens
  misc_feature (13)..(13): n is a, c, g, or t
  misc_feature (155)..(155): n is a, c, g, or t
  misc_feature (200)..(200): n is a, c, g, or t
  misc_feature (303)..(303): n is a, c, g, or t
  misc_feature (327)..(327): n is a, c, g, or t
  misc_feature (373)..(373): n is a, c, g, or t
  misc_feature (540)..(540): n is a, c, g, or t
  misc_feature (605)..(605): n is a, c, g, or t
  misc_feature (632)..(632): n is a, c, g, or t
  misc_feature (654)..(654): n is a, c, g, or t
  misc_feature (704)..(704): n is a, c, g, or t
gtaggaaatctcngttttttaaaaaaattgctgttattgtattattatgtcatgggttactctgtgcagcaaagcaaaaatgttcagttgtcctacttctccttgcttttatgtttggctttcagaatgagcagttggtcattatcatgtatttnttaaaatatgaccagttaataagtctgacaaacattttccaaccngtcatttttgaaaaggagaggatatttttgatacagatacacaatatacaaaaaatcccagagcgtgaaatttcaggcatccggggcctacaaataagaaacnaaacattaatccagttagttatcnatgggtataaagaaaaaaagcggcgaatcaatatgccggcgaaaanataaatcattacaaaacacaggcaacttcccccccccattacaaaggagcaaaaaccgagggaaaaatcgagggggcccccaaccaatgaaaacaatatagaccaaggaaatgaccagtcaagtcgagaagagagtaaggcaaaaatgagccactcatattttaggnataagtgacaaatatatttctctttattacttttaagggtttctctaatgtcttttgggagtggnagcattttatttgaatccactgttgcncatgggttgagccccacatacncccctcccctttcacctcaaagggaactcctttgtatgtagccacacacncatcattagtgtgaagatcaggcgggatc

SEQ ID NO: 494998 - DNA, 113 bp, Homo sapiens
ggactcacgctgagactcccccctctgatgctctgtctcctttattttttttggaaatggaagttccactcttgttggcccaggcttgaagttgcaattgccttgactcacag

SEQ ID NO: 494999 - DNA, 329 bp, Homo sapiens
tgagacggaatctcgctctgtcgcccaggctggagtgcagtggcgctatcttggctcactgcaagctccacctcccgggttcacaccattctcctgcctcagcctcccaaagtgctgggattacaggtgtgagccatgcccagcctacaaaaactttaaaaaacagctgggtgtagtgacatactcctgtggtcccagctactcaggaggctgaggcaagagtatcacttgagcccaggaggttgaggctgcagtcaaccgagatcaccccactgcactccagcctgggcaacagagtgataccccctttcaacaaaataaacatgaga

SEQ ID NO: 495000 - DNA, 1025 bp, Homo sapiens
gagttgacccccagagcctccgcagacctcaccggcatgccccctgtctgtccacgccggctgccgcactgcactagatgcccgtgggcgaagaggctgctatgtgctgatgcctgttggtgcagccgactggagtgactgagtcgagtgccgtgggcctccctttgtagtgtgttggtccccgcgtggtagggaccccagtgccgctgactggtcaaggacacacgtgggagcacccaccattctgtgcggtccccagcagccatctcaaccacctatccctgcgactcccttgactgggaagaagccccaagttgtccttgaattcctttttcactttgcatctcttcacgtgcaggctgggaccagcggagacaccgcggcgaatgcagatgagtgcaccggcgcactcagggagctgcctgggctccgtgtctctgagccccagggtggcaggagccaccggcacctctttcttcctctgtcatatggttcctctgtcaccagacacagtgtgcacagaaggaattggaccaggtcacatgtacgtagaaaactggtagaaagagcagacttagataaagcatctcctttggatattcatttccgctttgggcagcaggtgaacatctattataaaaacttctatctacaagaagtccacaacacatcaacactacggttggatgtcatgttcaacagtggcatacatacacgtaaagaatttcctgatcattccactggaccttacttgacatcaggacaaagtccttagcgtgctacgcccttaatcaaggaacccagcgaaccacaacctgaagccggggcaacgagcacccaccggaaagacgcaacaccggcacacaaccaccggcaaacaggtcccaaggccccaacccgacggacaccaccacacgcaccacaaagacagaaaaaccacaacgaacacacccaaacaagaaactacaaacccacacagaccaacccacaacaacaaagaccaagacgagccaaacaaacagaac

SEQ ID NO: 495001 - DNA, 356 bp, Homo sapiens
  misc_feature (32)..(32): n is a, c, g, or t
ttactacctactaaattcgccggccgcgtcgnaccccagatcccttgtcctctggcatctccgcctgcctggcttaggaagagggcagagcattgtcaggttttcctgtcttctcggcctttgagaaaaactactcttcagtgggaagtgttttcctaggctttatttggcggcgtgctggggaacttttaaattactgccttcctttaccgtcacgtaattcttgtattaatgcttcttgtgcaaaaagaaagggaagctgctaccgtgctttattagggctttccaggtggtccaggtttttaaaatcccatttccatagattaacttatgagtaaccgcgtcgacgtcgacgc

SEQ ID NO: 495002 - DNA, 497 bp, Homo sapiens
  misc_feature (392)..(392): n is a, c, g, or t
gtagaatgagtgtcagttaccagaggattaaatgatattagtattgtttagtctttgccaattaccacgggaccttgagaaagccctttaggttctctaggtctcagttttctcatctgttaaaatgggtataatatgaatcatcctatttatatctcaggtttggaaagaagaagaaaaaagagtacttgactaagaacaaaccttggagattatctggggaagcaaaaatatttgaaaaagcttgaagtggtatacaaatgtttaccagtttttaactacctttcttcctcttcagttgatttgtattttcagctttccagcccaccacattgtctaatccctcttgatctccccttgattcctgctttccagttggccaataaaacttntgttgtatggttgatgccttttcatcataagctgattgctcctctctcctttctccttggtttagcataaatctatatttcatctcacctgctcccgaatttcaa

SEQ ID NO: 495003 - DNA, 323 bp, Homo sapiens
acgatgcacagttggaaaggagatatgttaggcgtatctcttttctccgctgcttggtacttccgcttccggtcgtgccatcggagagtctcacgccccctttgtttctaacatggggttgtgatgaacttggtgggggggccctttcttccttcacgtggatgatggcagagccggtcggggatgcttggaagcacggtgcctcgcgtacccttttcctttttgctgatttgctctgatctctcccgccaggtggtttctggcccgtctgttggtagtggggcgcctcatattaacgtgtttggcacatgtttgctaaaagc

SEQ ID NO: 495004 - DNA, 310 bp, Homo sapiens
  misc_feature (42)..(42): n is a, c, g, or t
  misc_feature (59)..(59): n is a, c, g, or t
  misc_feature (76)..(76): n is a, c, g, or t
  misc_feature (251)..(251): n is a, c, g, or t
  misc_feature (260)..(260): n is a, c, g, or t
gaaccccaaaactgtggattataggaacaatattcccctatnagctggcttaccagccntgggtttcttcctggcntagactagctggtcaaccctggtacaggtgccgaacagtagccttggaaactggaatgcagaacactcagctgtgctccaccattgtacagctctccttctcccccgaggatctcaacctggtgttcaccttcccactcatctatactgttttccagctcgtctttgcagcagtnatattaggnatttatgtcacatacaggaaatgttatggaaaaaatgatgctgagtttct

SEQ ID NO: 495005 - DNA, 685 bp, Homo sapiens
agcgggtttttgttgatggagagcgcggcggagagcagagctccgggacccagggtgaccgggaaagcagggcatccccagcggcgggagcagccggcagcagcccaggcccgggactggggtgggggtgggaggggggctgaggggaggacctgaatgttgtgtggcggcagtggcacaagggacccctggagcccgtgacagcatcagagatcaagcatctggcatcaggggatcttcggacccagcaagaaggatcctgctcacagggtgaggtgtcctcccagagcaagccaacgagagattcacgctgccgccccacagtcatggagctgggcacccccgttacgtgacgactgctggcaagcaattagacagggccacgttaaagcggctcgaggtacgtccagtcccacgagtaagcgcgtccggacagggcccgtatgaccccgacttacaagaatctcagtcgtcaaggtcgcgaagtatagccaatgacccaatcgtagaagcagacataggcaacgctccaggaggggtagccaaacattaagcacatcacagacggtcttagtgcccattacttcaagaccgacagtcctggggtacataaggcgaggaatactctggagaggggagcatcgttagagacgggcgaatgcccgcatggtggcacatgacagcg

SEQ ID NO: 495006 - DNA, 321 bp, Homo sapiens
tcacaggccttctcatggcatcatactgtaattctgctcagaaccccaggaggcaggactaacattatcttctgtgtagaccaggggtggagcaactctgtgtgtgtgagtgtatgtgtgtgtgtgtgtgtgtgtgtgtgtgtgtaagtcattcaggacaagttcaaacacttatgtgtgtgtgtgtaggccatatcaggacaagtaaaaacacttatgggatgtgtttacactctcagggtgaatacatttctattgaccttctagagggggataaaagtggtattcgtgcagatcgctgctttctgagtagaacactag

SEQ ID NO: 495007 - DNA, 169 bp, Homo sapiens
tgccaacaccaagattggcccccgcgattccacacagtccgtttgcgggaggtaacaagaaataccgtccactgaggttggacgtggggaatttctactggggacaagagtgttgtactcgtaaacaaggatcatcgatgttgtctacaatgcatctataacgagctgg

SEQ ID NO: 495008 - DNA, 420 bp, Homo sapiens
  misc_feature (388)..(388): n is a, c, g, or t
atgttggctaggatggtcttgatctcctgacggtggcctcccaaagtgctgggatcacaggagttagccactgcgcccagccaccgttgttgatttaaagcctattttgtggatactgattctcctcaacttattatggagttatatccttataaacccattgtaagttgaaactattgtaagtcaaaaatacatttaatacatcgaacctatagaacattgtagcttagcttagccttcaccttaaatgtgctcagaacatttacattagcctacagttggacaaaccatctaatacaaaccctattttataataacatattggacagctcgtgtattttattgtacaccttactgaaagtgacagaatggttatatgagtactcanaatacagtttctatttgtgtgtcacttttgcc

SEQ ID NO: 495009 - DNA, 265 bp, Homo sapiens
ggctcgcctcttcttgcattctgaagtgtcacggggcctccgggcgcttgcgctatgtatctcgtcagtctactccactcgcgacatgaacgcagtactccgcgcgccgcctggtttccactctagacatactgggggtgcccgtggcatgattcctaagatggctcggatattgagcttagtggtgacagaacttcgtgctcgcacggagtcgcggtggttttgcctgttcctatcgttcggtgcggctgctcgtcgaagacga

SEQ ID NO: 495010 - DNA, 114 bp, Homo sapiens
ctattctattcagattactttcctgtgagacccttaaattagaaaagtattatttattttatttgagacagagtttcgcttttgtcactccagcctggagagaaaaaaaaaaaa

SEQ ID NO: 495011 - DNA, 109 bp, Homo sapiens
gccggaccctgcagccgcagagatgttgatggctaaggagaaccggattggcatttatgaacctccttttaaggaggggagtcattgtgtggcaaggaggatgttcaca

SEQ ID NO: 495012 - DNA, 90 bp, Homo sapiens
  misc_feature (52)..(52): n is a, c, g, or t
acatggataggcgtatgcatactacactaaggagaaacaatggtctacacanacgtagtgagaacattatctgtatacgggaactgtgat

SEQ ID NO: 495013 - DNA, 700 bp, Homo sapiens
cagagttatttaaaaatggttaatttgaggagataacatttaaactttgttcctaaatatataataataaaaggatggacttaatttgcaaaaaaaaaaaaaaaaaaaaaaaaaaaaaaaaaaaaaaaaaaaaaaaaaaaaaaaaaaaaatttagaccgcttggacccaaacaattttaaattaaacaaacttaatcatggcgaccgaaattcaagttaattggccaaatcccccttaaagggagccgattaaaatttaatggcccgcgttttaaaaagttcgaaatgggaaaaaccttggggtacccaacttaaatcccttggaagaaaatcccctttcccccggtgggggaaaaagcaaaaagccctaaccgaacggcttttccaaaaagtggcaaacctaaatgggaaatggaaattggaagcgcgaaaaatttggaaaaatttcggaaaaatttttggtaaaaaccctaaatttttaaccaaatgggccaaattggaaaaaccccttaaaactaaaagaattaaccggaataaggttgaggggttttcaaatttggaaaaaaggagcccttttttaaagaaccgggactctcaagtttaaagggctaaaaaaaccggtattaaggggcagaaggcccattttgtgaacaccattcccttaaacaagtttttggggacacagcgcccctgaagctct

SEQ ID NO: 495014 - DNA, 366 bp, Homo sapiens
cttacaaacttacttgtagttaacagcttagctgactacataactatgcgtgacaggtctccttaaaaatgatgatttatgggctggagcacggtgtggctcatgcctgtaatcccagtcgatctttgggaggccgaggtgggcggatcacttgaggttgggagtgcatgaccagcttgatcaacatgaagaaatcctgtctctattacaactacaacagtagccaggcatggtggcgcactgcgtgtaatcccagtctacttgggaggctgaggcaggagaatcgcttgaacctgggaggtagaggttgcagtgagtcgagatggtgccattgctctcgtttgggcaacaagagtgaaacctctt

SEQ ID NO: 495015 - DNA, 701 bp, Homo sapiens
atacttcttgcttccagaatgtgattttaaggaaaagaaaaataaataaataaatttaatacttctgagagacttctgcttctggaaaaaccgaattagatggtagtgagtttcttagttttttgccttatacatctcagacttggaactaaacaagccagcaaccatggtgaagaggctccttattactgctggggtgggggaatgggagttgcagctccctgtgtgacctccctggtacactagtggaggtggcctcattaccactggttaatgttcaaagtcctgactctgttaggcctcctctgaccccatcccaggggcaggggcttggcagggtttggaggccctggtttcctccctggccatctctgacagtattctggcagagacattacagcctccagaggattggttacattaagttggaaataaaatatataaactaaaaaaaagttatatatatgtgatcatatttttcaaggaataaagtagtatgggccgggcgtggtggctcacacctgtaatcccagcacttcgggaggccaaggtgggaggataacttgaggccaggagtttgaaaccagcctgggcaacatagttagaaccccatctctattaaaagaaaaatagtagtatgtaggatcgacaataacatgttgaaagaataagtagcaaattacgggttcagggtaagggac

SEQ ID NO: 495016 - DNA, 145 bp, Homo sapiens
aatagatatatcatcccatagtgataagattatccataggactagccgtacatagggcaaggagaacggtgaagctgcgtgcatacacgtgggaagatacgtcatacacacatgctataccacggagacgatgataccctacaca

SEQ ID NO: 495017 - DNA, 169 bp, Homo sapiens
cccttgggtgggccccccagggccccccccccccccccttggggtttggtcccgggggggggggggggggttccccccccttcccggggggtttccctttgggcccccaaatgggatattttgattaggggggtttagtgcccaaaaaaccccgtttttttccggggta

SEQ ID NO: 495018 - DNA, 281 bp, Homo sapiens
atttgtcaggtcaatgctaatcatgcaaagggttctctgcacgccagcagaggcacttagcacacaagtcacctcaactttaaaccaatgagatatagtttcctacttgatccactcattgaagaaggtgaaggtagcccaggacctgatagaaaatacatttttaatgtagaatattttaaatcttctacatttgactttgggttgtaagattttaaccttgccagttattgcttcttcagtaattatagatagaatgctaacagtgtccgactctgttt

SEQ ID NO: 495019 - DNA, 276 bp, Homo sapiens
ggtggaggtcccgtggtgaactggcctgctggacgtcgtggtgcaggtttgtccccgctgatccccctggtcctgtctggcgaggaaggagcccttgtgctgctggtcctgctgatgctcctgttctcgcgggtctcatggtattggtggacagcgtggtgtggtcggtctgcctggtcggagatgagagagaggcttccctggtctttctggcccctctggtgaacctggcaaacaaggtccctctgtagcaagtggttaacgtggtccccctgg

SEQ ID NO: 495020 - DNA, 271 bp, Homo sapiens
gctcgacagcataacatctacattcttacagagaagtagcggggaggcacaatgtaagcaggagagccgatgattagaaacctaggtctaactcacagcccgtgagctttcctccacgccccgatggctatccccttaaaaaagccagcaaggaggcgagtactcggagggcagaacccacggaatggcggcaccacacagcggccagagcccgtgctcgcgagccaaggacttgtcccgaccccccgtgcctgacggagggcgcacgtct

SEQ ID NO: 495021 - DNA, 105 bp, Homo sapiens
gatcgtttaagagtacttattgtgctctaaattctgttaggtgcttgtcataccttattgatcgttatagtacctcctcttgttgtgtagaaattgaacgggtac

SEQ ID NO: 495022 - DNA, 295 bp, Homo sapiens
cgagaattctggatcctcatggttggttaactgtatggaataatgtgaagggagctgagaatccatctgcccagagcaactatgcaggagcatgcctgaaatggcagctcatatttcttggcctcgtgctttctaggagtcctctcctaaaacagagacgcctccgtcagatacccacaattcttctaactaggcatgccctactttgttgagttcccacgttcgattcgcgagggaaaaaaaatcccaaacggatggaacttgggatgggggaggatcccaattccccattagt

SEQ ID NO: 495023 - DNA, 175 bp, Homo sapiens
  misc_feature (20)..(20): n is a, c, g, or t
  misc_feature (22)..(22): n is a, c, g, or t
  misc_feature (29)..(29): n is a, c, g, or t
  misc_feature (31)..(31): n is a, c, g, or t
  misc_feature (36)..(36): n is a, c, g, or t
  misc_feature (40)..(40): n is a, c, g, or t
tagcatcaagaatcatgcantntgattantngactnaaantatgttgaacttttcagcctccattgtgtattattggtgcaatactctgtgcaactatctcatccaagaccagaaggggctggcagattgcctgcttcacattaaaaccctccttattgtatcgatgctggacga

SEQ ID NO: 495024 - DNA, 1097 bp, Homo sapiens
gcggtcgcaccgcgagcagtagcgaccagggggtggctgccctaccctgcctttggtgtagccagtgcgtgtcctgcgcagtagtcttccgcgtgttgctactagtggtggtatatggtggtgccctttttcatagcgcttgttcgcacgcacgagtgtgcgggtttatggtcgcttctggtgtattcccccgctcgtgtagtgtggtgtgcacctcggtccgtcctcgcgccgcgggtcccccggtgaacgcccgtggtcctggccatccgggcgccagttttcagggagcgcactcaagggcgctatggtgccccttcgttttttccggatgacccctgcccccgctccgcctgagttctctggaacccattggagacccccctgtgggatctgaccctctggaggaagatacccctgtgtctccagctcttgtgagctagagattgaagctttgcccctggataccccgtcctctgtggagacggacctttcctcttcccggaagccatccgaggagccctttcacccctgtcttagagaatggagccggcctggtctcttctacttccttcaatggaggcgtctctcctcaccactggggagattctggtcccccctgccaaaaattctcggaaggagaagaagccaacccggatcacgggcccttaggaaacacgctatgtggaaaggccaaggtccgtgcactgagaagaatgggaaaaagatatgtaccctgcccagccccccttcccccttggcttccttggcccccgttgctgattcctccccgagggtggctctcccacgccctggcctggtgacccgctccctctgcatcccttttccacgcccggctgtccccaaccccccacttcaccacgcctcctcggcctggtaacttgccagaccagtgtggcccaccaccatagcgatcccagaagagatcatcgtgctctcagactctgatttagctgcctccccttctccctgcctcccagaatgtttctgggattaccatttggaggaaggtgggaacccagatgactgaggaagggatggactaagcttatccccttttggtggtgtttccttta

SEQ ID NO: 495025 - DNA, 595 bp, Homo sapiens
actgattcgctacatggactcaaataaaaggtacactactttaaaaacagcatgtatatatgagttttacttaaaaggcaaacatatctatgaatgatagaaatcagaacagtgattaccttgggagggagagattgactgggaacgggtgagacagaccctcctgggggggaggataatggataacagaaacgttttatagtttgctttgtgtggtgatcacagatatatacatgtataaaaatttattgacgtatgtattttctgtaagttaaatttcgcataaataaatataatatagccgggcacggtggctcacagcctgtaatcccagcactttgggaggccaaggtaggcagatcacctgaggttaggagtccaagaccagcctgaccaacatggagaaactctgtctctactaaaaatacaaaattagccgaatgtggtagcgtatgcctgtaatcccagctgctctggaggctgagacaggagaatcgtctggaacgtgggagacagaggttgcagtgagctgagatcacgccagcctgggtgacagagcaggactctgtctcaaagaaaaaaaaaagggggatcc

SEQ ID NO: 495026 - DNA, 333 bp, Homo sapiens
  misc_feature (27)..(27): n is a, c, g, or t
ggaagacctcaataaccaccatcaacnagcaggacctaactgatatttatagaacaccccacccgacaacagtagaatacacatgctttcaagtgaccacaggatgtatctaccaagatagacaataacctgggccataaaacaaacctcaacaacaaatttaagagttgaaatcatacaaagcatgttctcaggtcacaatggagtcaaattaaacatcagtaacggagagataccaagaaacctccaaaggcctggaaactatgcaacccatgtctaaataatccatgggtcaaagaagagctctcaagagaaatacattgaatttaccat

SEQ ID NO: 495027 - DNA, 953 bp, Homo sapiens
atgcccctcattgacataaatattatagtagcatttgagcatctcacttctaggaatactagtatatcgctcacaacctcatatcctccctatatgcctagaaggaatactactatcgctgtccattatagctactctcataaccctcaaaacccactccctcttagccaatatggtgcctatggccatactagtcttggccgctgcgacgacacggtggcgcctagccccttactagttctcaaatctccaacacatatggcctagaactacgttacataaagcctcaaatcctactccaaatgctaaacattaattcgtccccaaaccaattataattaaccttacgacagagacgatgacttttggccagaaaacacacatacgttttggaatcaaaaaaaaccacacccaacaggccttaatttcattgaggccaccatcgcgtcgggcatatgtgtttcaaccacaattccacaaacaaagcctatataagctgtacccccaaagcttgtatgctcggagcacatataagaatgccccatcgtaaatacataattaagggggaatcatagccgtaagaattaaagggacaggccaaggccacactttatccagtgcaccacactattcagatcaaacaacctcgtacctcttcaataataatctgcgtacaaatctcgttattaatacaatcacgagccacgtcatatcatgttatcttttgcgaaaccacatattccacttgttacatcaccggcaggcaccgactgaacgctgagcaggcaatctcgattctcactaggagacgtccctattatgatgaatacccaaagctaggtctaattatataatcaggcagattcatctgacatcatgtgtcacacgtataaacctttaacttgtccacggtacttgaatcgactatgttaaccgatccaaacttttgtaca

SEQ ID NO: 495028 - DNA, 122 bp, Homo sapiens
  misc_feature (3)..(3): n is a, c, g, or t
tcntggcagtcccatcgattggggagattatacccaggtcatccacagtggaggtcggaaaatgttcttggtcgtacccccactctcacaaacggaggggacggggtaccgagcacgaatcc

SEQ ID NO: 495029 - DNA, 158 bp, Homo sapiens
gaagagaggacttttgtggtgggcgaacgagtgacattggctgacatcacagttgtctgcaccctcttgtagctctataagcaggttctagaggccttctttccaccagccctttcccaataccaacctaaaaagggacacaccacggaaagagaagg

SEQ ID NO: 495030 - DNA, 874 bp, Homo sapiens
agcggcttcaaatgaaatgagaaagttagtaaatcattcagcaactatgcagtcttactcaatattaatgtacctctaaggcattagcaatgagaagggcaaataattatggtttggtaaagttaatatttattgaacataatgagaaataatctatatggactagtcatatgaaatagattttattctatttgtgtgcactggagctggaaagccaagactgaaactttatctcttgctgcctgtgataccacattgacataccagaagaatattggaatgatcagttgttagtggcctaggattttatttgcctgttgagacacagccataatagatgttaagtctgtgattcttagacttttcaggtgatagagtacctggaagtcattcataatgatcgttatagaacatcataacatttctacattttcaattctgccatgatagctagtgtatttttaattttcaataaatgtaaccaacttacatgaaggaatgcaatataaaattataatcagtacatttgtccaacgttttcattagtattatcacctacttattcatcagttactaatatttcctgttagaaaagtgaggcaggaattaaagattttttttaagaagcatggaaccaaaacttaaacttgctaaaaattattcattaatcttttctacattaagtgattatccagtttatactgctacaaggcaaaagtctgaggcaagtgttttaagttaacttttaaaggtgcagaagaaaattgaaaatctcatgtgaacgatgtgttaatttcatgcctaaatttcatattttaatatatattttaaacaactggtaatttggttgaaccttggaagaatgcaaaatttt

SEQ ID NO: 495031 - DNA, 1617 bp, Homo sapiens
  misc_feature (1345)..(1345): n is a, c, g, or t
tcatcttgtgaaagaagaggtttctcctgtcgtcccaaaatattggtccccctcttaactgctcgaggagatgcgcgcggcctcttcttctatggagtattttttctcctctacggtgcggtctcccctcactcctttgctcctggcgcccataatcacaccaatgggggtaaaacaatctcgtgggtttatccctaaaagacccccccccaggtggagtttgtaaactctctcgatgaggagagatttgttcgactttgtggatggattcatccccctggttgatattcctgtccggtcggggaaggcctctcccacacccagcccccccccagcttgtcttgagaaacgtttgtgtgtttgcccccctgtgagtgtaagaagttcttcctccccaacagggcgcgggaaaacagccccggggtgttttttgttgtccacaacctgtttcccccctgcagatcgcggcccttggggtgttgccccccccgtccccccccctctcccgtgtgtttttcttttcacggggtctttcttcggccccccccaccgcggagatgtcctttgtggccacagcccactcggtgtggcgcgtggtggagcaaccccccccgggtgtgcccccgccccccgttgcgcgcaaacaccacatttggcgccgcacatgatcttccctctgggggggccccccgtgtagacaacataattcttgtgtgtcgcacagagcgcctttgtgttgtttgtgtgtttctcgcagccatctcttctataggtggtggttcatcatctctgtgtggtgtttttgcgttcttctgcgggtgcctctgtgtgtttatatattgtcgttgttttttttcttggtgggggggatgaaatatcgccctacaatatatcacattgccgtctagacagatatgtctctatatagtagagagagatagagagatatagtgtgtgtctcactataaagagtgctcacaacagctctctctgagactctgtggggcgctaggggtgttttcgcgtctgtgtctctatgtggggtgtgtcccccaccactgctggtgtttccgagatatatggcggccccccccctgtgtcttttcgcgcgcacggcagaggctctgtgtgtttcctctcgcccacacacactctcgggggcgcacaacacaccctcagtagccccgcggagagggcgcctcgcagaggagtgtcccacatcttgtgttgtggcgcccgctcatgagagagtgtgtgtctctgcgccctctgagagagtgtcacacttgtgtgcgcacacaagagagacgcccgcacacacccggcgacgacactgtgtctctgncctctgagagagtgtgtctctgtgtgtctctgtgtgtgtataatacacacaggggaaaacacaggcaccctcgggttttcttttgtttcttttcttcctctttctttcctctggccacacagaagaaagggcttacacacaggcacttggaacacaccacaggtgtggcacacaaccgggctttaacttttggcttaatttataaaagatgagaaagaaaagattaaaaagggttaatttttccttcctctgtaaaatatccccgcctttta

SEQ ID NO: 495032 - DNA, 194 bp, Homo sapiens
gcctcgccagtggcaaggctttcttcctccaccattaccaacaataccgacatcaacagccactcggcttactgtcccgggcttaccagatgacccaaggatatttcaaatgtctttttcttttcttttttttttttttaaaagacagaatctggctcggtcatccaggtgggagtgcacgggcgcggctagga

SEQ ID NO: 495033 - DNA, 713 bp, Homo sapiens
ttgggggggtgggggaaaaaatgtggaaaaaaagtgggcggggggtgcccagggttaaccccccgggaaaattttggtgaaaggccagggattttgaaatattttatctttccaaaaaccggtttcccccccccgggggcccaaaaaaaaacccccccttcccaaatttttttaaaaaacagaaaactggggaaagccccccttccccccgggggggacgggttaaaaaggcggccaaaaaattaaaaaaaaaggggtttccaccccctttttttttttttagggggttttaaaaaaaccgggtggaaaaaagggggggaaaattttggccccccccccgggtttttttttttttttaaaaaaaatttttttccccttgtttgggggcaggcttacccttttaattagaaaaaaaaccctttaaaaagaaccctgggcaaaggggggttttcctttaaaaaaaaaggttccccccgggctttaagggaccccccaaagggaaaccccccccccggggttccctttaaaaaacgggggaactccctctttttcaaaattttttggggggccctttatttttttgggggaagggggttcaaaagaaatttttaaaaaaaaaagggggaaattttttccccggggacccaaaaccccaaaaaaaaagaaagaagaacacaagtcacagttcactgacctgctgaaaaaaagaaaaa

SEQ ID NO: 495034 - DNA, 1153 bp, Homo sapiens
  misc_feature (12)..(12): n is a, c, g, or t
aggatccccttncaaccccacgatcacgaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctct

SEQ ID NO: 495035 - DNA, 269 bp, Homo sapiens
aaccgaacaacaaggcaatcctctgtgctgggacgtccctttctgctttgtgtggatttgattcagcgtgaatgatcaccctaggccgagcgccccgcctcacgcctgtaatcccaacaccctctttgaggtgggcggatcatctgaggtcaggagtttaagaccagcctcgccaacatggcgaaacctcatctccaccaaaaatacaaaattagccgggagtggtggtgcacacctgtaatcccagctacttgggtacatattacggt

SEQ ID NO: 495036 - DNA, 342 bp, Homo sapiens
caacggcaccactgatatcttcagagcaaggtacgcattgcccaggctcaaagaaggtgagaggctcagagcgtatgatggccaaaggttgaagtagtgagcttagtggcgtcaagatgataggcgttaatgaagtcaaaaggtaggccaagtggagtagaggaacatctaggtattgaagtggagctaaattcaaagccctctgaagacaggcgaatagcaaaggtgctatttcctagggctctccaggtatagtcgcagcttcagttgacgtatgaggccagctaggagcgattcggcttatataagtagcgatgaacataagaacagacccgaatttct

SEQ ID NO: 495037 - DNA, 1123 bp, Homo sapiens
  misc_feature (14)..(14): n is a, c, g, or t
  misc_feature (61)..(61): n is a, c, g, or t
  misc_feature (66)..(67): n is a, c, g, or t
  misc_feature (72)..(72): n is a, c, g, or t
  misc_feature (74)..(74): n is a, c, g, or t
  misc_feature (83)..(83): n is a, c, g, or t
  misc_feature (87)..(87): n is a, c, g, or t
  misc_feature (89)..(89): n is a, c, g, or t
  misc_feature (91)..(91): n is a, c, g, or t
  misc_feature (98)..(98): n is a, c, g, or t
tgagccctccaagnaccagaaacccagcctcccaagatttttttgaaggctgttaggagtnacctnncaagnanaggactgtntttngngntccaaanacctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctct

SEQ ID NO: 495038 - DNA, 314 bp, Homo sapiens
ggtgtactgctctagaggatcctatggcagagctgatgggacgctgtgatccagcactttggaaggctgagatgggttgatcacctaaggtcaggagttcgagagcagcctgaccaacatggtgaaacctcatctctactaaatacaaaaaattagctgggcatggtggcacatgcctgtaaatcccagctaccttgggaggctgaggcaagagaatcgcttgcacctaggaggcggagtgtttgccagtgagcttcaaacattgctgtcactgcactcctagcctggacagcaatgagcaaaactctgtctca

SEQ ID NO: 495039 - DNA, 1660 bp, Homo sapiens
  misc_feature (28)..(28): n is a, c, g, or t
  misc_feature (32)..(33): n is a, c, g, or t
  misc_feature (39)..(40): n is a, c, g, or t
  misc_feature (43)..(43): n is a, c, g, or t
  misc_feature (48)..(50): n is a, c, g, or t
  misc_feature (773)..(773): n is a, c, g, or t
  misc_feature (1108)..(1108): n is a, c, g, or t
  misc_feature (1206)..(1206): n is a, c, g, or t
  misc_feature (1317)..(1317): n is a, c, g, or t
cggctggtcgcgttgcaggtgaggttgngacnngcgggnnggncgcgnnncaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctctacctgagtctatttncaaacaaaatagagattctaaatctcccagaagcagcgactagagctgctcccgtccccactcttgccccttcctgctttatatcccgtcctcaccctgggcctgatgccctaaatttatggtgtcagatgttctatgcctttttctcctggctcctgttagccaggtgcctcctgtgtgagttactgtaatagctgcaggtaatagaaaggaagaagtcagagacccctcccagcaccctacaaaagccttgggggacatgttgggcccaggacatgttccctgcactctttcctttgcagttagtactcatgtatgagccgaagtcatatatngctaacaaaaaaactaaatccttcataagagaagttagggatgtattgaataatggcctctttgacacttggccgatgatgcccacttcaaaaacttngggtttcagaggcctgcccgtctcctgtcctagcactgccagagccacctactcagtgttactttttgggtctgtgatcctgttccctttaccaggtcattgtactgtgtngtccctggaggaacagcttctcctcttgtcttgacagtagggctgggggtcttcgcaccctggttcagctggagggagacgtgttgcagggttaacgaaaaggtctccctggcggcagcgtgtgtggcgggtcagaccgctgatgggcacaaccttccctttggtggggtcgggggatgctggctctgggaagtttgaacccataggggtccgggaaaacgctaccatcaccaccaatcctgaatcctagggccctgatatgggacacgcatacgagaactttcttaaagcacacgggaacatgagagggggccaaaacacaagcgaaaaggggggagtagaa

SEQ ID NO: 495040 - DNA, 142 bp, Homo sapiens
cacagctactccatacttgtcaaactgcaggggtagcgaacaagttccttataaatgagaaaataggcagccatggggagaaaaatgacaacgcggctttggtattccgtctgacagcagaagcactagagactaaaacaca

SEQ ID NO: 495041 - DNA, 508 bp, Homo sapiens
ccttcaagggctggcagtcttacagaggtctggatgcggtgagaatgagaggccagagggaccatagtgttgggcactgtctgaccatgttgcatttggaaggctaaatggggccatgaagaaggctggatatgggatcatggggtgtgatggcagcctacctggtgtcccctaccccacctgttctcggagaatccaagttgctacacaggaaggttctccaaggtccagtttcctttctcccaccagattggtggacggcttcagggaagaccacgagtcctggacagagatgggtaacaggaaggagtcggggatatacatcaaactatcaatcagctgtgtctctgatttgggagtgattggcggggatggggtgtggagagggttagtttggtatttctcatggccatgattttttttgtttctattcctcttgatatcacatgtgctctgaatcgacgggggacggggtgtaacccggaaactaaagcctccagtctccgcg

SEQ ID NO: 495042 - DNA, 157 bp, Homo sapiens
ccttgaacgtaaaacctgagagctgaagatggaaatgtgaaggcaatcctgctcttaggaggagaatctctgccttctctgcaaagagaaattgtcattttattttttaagggtgattttgccactgggaaaggctgaccacccagcgtcattttcc

SEQ ID NO: 495043 - DNA, 174 bp, Homo sapiens
ggttaaaaaaaaggttttgcagaatcatcccagtaagagcccagtggatgtcttgcaaatatttagagttggcagattgaaaagggtctccttccatgggaaaaaaaaaaatcctgtcttgttcataaattggcaatgtccataaattgaaatatggttccctgtttctcttga

SEQ ID NO: 495044 - DNA, 708 bp, Homo sapiens
gaccatctaagatattcatgtcttttgagatgaggtctcatatctgtcacccagactagagggcaagtggtgcaatcacatgatcaccacatggacttacaaactctctgtgtgcctccgcgaggtagctgcgatcacgggtgtgcacacatatcatgcccagctacatggtgaccttgtaatctatctaattacgtacggacagtggtcttagctgtgttcgcaccaagagatggtctcagaactcctgggctcaggtggtcctcccacgctaagcttccccaaatactggggattatagtgtgtgagccactgtgccccaagggcgttgtccttcaggactaactttgcaacgtgtcgtggcgaacggacttttggcacaacgcgtgtcgcacataacggaacatatggtcattccccaaggcacgatggggcgtagtacgccacgcgttggaaaactaaccacttaggggtttcaaatatacagatgagagaaaaaagggggtggtgctagcacaagcagataacactgtctgcgcgagcagtttgcgctgtgcagatgaaccgtggtataagtacacacagatatagctacacggggagatggcacccacaaggtaaagagaacgcgcatgtatgatttgcagcgctctaagcaaaagtgtagagagaaacccatgtggcagggtggtaggcagtggaacccga

SEQ ID NO: 495045 - DNA, 410 bp, Homo sapiens
ccgttaggaataggaggagaataggggatagttatgaacctgagggtgttttctcgtgtgaatgagggttttatgtcgttaatgtggtggttgagtgagccccattgtgtatgatggtcaatatgtagagggagtatagggctgtgactagtatgtcgactcctgtcactaggagagtgatatctgatcaggagaacgtggttactaccacaagagttctcccagtcggtcactagtgcggcggtaaggcgaggttagcgcggctagctacacgtcatcacaaagctattagtgggagtagactttgaagtccttgagagaggattatgatgcgactgtaagtgcgttcgtagtctgagtcggctaggccgcccctctcctgaggatgtaagccccgtggcgcgatcatg

SEQ ID NO: 495046 - DNA, 907 bp, Homo sapiens
gggtatttgaatgtttttcttttctcaccttatcctagaacttgaggctgggcgcggtggctcatccctgtaatctcagcacttgggaggccaaatgggcagatcacttgaggtcaggagttcgagaccagcctggcaacatggtgaaaccccatttctactaaaaatacaaaaattagccaggcgtggtggtgcacgcctgtagtcccagccaatcagtaggctgaggcacgagaatcgcttgaacccaggaggccaaggctgcagtgagccacgatgcaccactgcactctaacctgagcaacacagactccatctcaaaaaaaaaaaaagcaaaaggatcttgggaatgcggccgcccatattataactagtgggagcaggacgcgacataattttgccagtgacgctcatataaagacttgactggaggtatgaccaaggggcaacctttatctggtgggccaagaaaccatcaccaggggcatcactaacgagggggtgaaactacaccaccatggtccagaggggggcgggtactagccccccattaaaacaaggttcggtggtaccagaggctcaacaccaaagggcatacttgatcccagatgtaatgccccacacattgccccgggtcccaaacggctggcagtacacaatgccctggggaattccttgccaccaccgtgggagactacagtcggacatgtgacctggtagaacatcattaaggggcatacgcaaacaaccaccaactaggaacactagccttggcgaaaacggaagcacctaaggtccacgaagacggcccggataccatgaagaaacccctgtcagtcttacgaacacatggagcccagaatgcagtagcagacagaatgcacttgcagacgccgtctcaaggcga

SEQ ID NO: 495047 - DNA, 276 bp, Homo sapiens
cctggtacgggagtggacggtaatggcaatgtcgtcatggcagcggagaaaccggagaaaatcagccgctccacttggtacggctgtctgacggttctgagtacaaggttacgccatggcatgaatttgtcctggttgatggatctaagcgacaagctaaagacctacaacccggcgacgaactaatgcctcccaagggcgtggagggtgcttttggtaccctacacgacccggataaggcgtatgtggacgctaaggctcccactcccgtaccag

SEQ ID NO: 495048 - DNA, 347 bp, Homo sapiens
tgggttctgccactaatttgccatgtgacctaggcccagctgtcattttcctcatctagaaatgataggctgggtgtggtggctcacacctgtaatcccagcactttgggaggctgaggcgggtgggtcacctgaggtcaggagtttgagacccgcctagccaacatggtgaaaccccgtctctactaaaaatacaaaacttagccaggtttggtggcacacgcctgtaatctcagctacttgggaggctgaggcaggagaatcgcttgaacccaggaggtggaggttgcagtgagccgagatgacaccactgcactccagcctgggtgatagaacaagactgtctc

SEQ ID NO: 495049 - DNA, 361 bp, Homo sapiens
  misc_feature (197)..(197): n is a, c, g, or t
ctcatggaagaatgtggggtcagggacagtggcgggaggagctggctcaccaccctgtggacaatcacggcttataatttgtgattctgtggctttgtctaaagtcctaaagcacttgatatccagtctcacagactgctcacaacagtccacaaggctggtggggagtgcttcttttgaatgatatactaacgacnaaaataatagaagtgaacattctttgcaatgttcaagcagctagacacacttaagaccattaagaaagccaagaaataagacccagacaaggtgggcagaagttggaaggcaggagacaggtgtgaggaggtgggcctttctgatctgccagcccatctctcct

SEQ ID NO: 495050 - DNA, 728 bp, Homo sapiens
ccccactttgtggggggcagagcctttttggtggtcctgtgcccccacaatgtcttgtcgcctcctggttgcggccccgtcctttgatccccgcctgtttttgtccgtgtacgccaccgggtcaacgggtcctttggtttgctgacttggccgcatcctctcgcctttaagtgatcgccatgaggttggatgcagcaagagtccctgtttgcctctcgtggtcgccaccccacatcagttggtatggactactctcctcttgtgggtggtgtgccccacacacccctctgttagagagtaatgcccgaccccccacaatagtgctgttattccaaagaagcgtaaaaatttttctcttatttctctgagaactcatgattatcaaagcaccctcatgccacgttgctataaaatttctccctgtctattgtttatacaacacacccagactcacacacctgtaaaccactctttattatggctcacaccagacgagaaacatacccaccacacactcttggctgcctctgctcgtgcaccccacacttgcaagatgtatgcagattatccaggagcggggtctcaacacccacatatctatgtattaggttgttgttctagaagaaaattcctctttggtatcatatctattggagagctcgttgtctgttttgctccccacccaatgacagagctaccacacgttcccgacaaacaataacaaagca

SEQ ID NO: 495051 - DNA, 255 bp, Homo sapiens
gtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattccctgagcccttgggggacgacagcttcaggagtaagaaaaagggtggggtttccagtttccattaatgttgaccc

SEQ ID NO: 495052 - DNA, 382 bp, Homo sapiens
ctctagaggataccctgtcacactttttgcaactggtatgatagtacacattatcatactaccatactattgcatttctgagaacacttaaacgtattctgcaggtccatattatatacaactagaaagacctgtatatacattctgagttgccacaatgtttttctttcttttcatgctcatccaattaaacatgctgcgcccttactgtagataacttttccaaatctaaaataccttggagcagacagtttagcaaatatatagccttcagtcggcattcaatcaaatggagtttccccaagacacagttctgtaacgaagtgcgtttgagattgtgtgtatatatatgtatgtgtattttaagttattacttgtattg

SEQ ID NO: 495053 - DNA, 449 bp, Homo sapiens
tagctcggtacccatcattccctctctcacgtatggttgcaagaataagcagagtttttgggttgtggtgaagtatctaagctagagtttgactagaaatgaaggcaggtaaatttgtaatcagaaagtcacaatgatttgatttgattgtgaaagtcacaatcccctgtgttaagttcatggactcaaagtagctttcccatatttgtacgtcattttaaacataaattatgctctaaggaccttacattcaaaaagggacgaaagcatttttatgaatgatagtggttataggaaatgtttatttcttttttgtttgtttatagtaaatctgatatgtctcgcttgcgattagctgctggtagtgccataatgaagcttgctcaggaaccttgttaccgtgaaattattaccccagaacagtttcagctctgtgcacttgttattaa

SEQ ID NO: 495054 - DNA, 404 bp, Homo sapiens
  misc_feature (3)..(3): n is a, c, g, or t
  misc_feature (61)..(61): n is a, c, g, or t
  misc_feature (105)..(105): n is a, c, g, or t
  misc_feature (171)..(172): n is a, c, g, or t
  misc_feature (178)..(178): n is a, c, g, or t
  misc_feature (185)..(185): n is a, c, g, or t
  misc_feature (188)..(188): n is a, c, g, or t
  misc_feature (192)..(192): n is a, c, g, or t
  misc_feature (195)..(195): n is a, c, g, or t
  misc_feature (197)..(197): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (210)..(210): n is a, c, g, or t
  misc_feature (215)..(215): n is a, c, g, or t
  misc_feature (223)..(223): n is a, c, g, or t
cgnccccatcctttcctctctcacgatcttccgtctctttctatccttcccctctctttgncatccactcagcaagctgagagtatgaccacatggcataacggnctctttagatattactgttgacatggtcgttgggaggaagagacaggtagatgtttttatcatcgnnaatagngccctgnggntcanagncntgtancngncgcngctgnttcatagncatcgtgggctacttcaagttgtctctttctgagggcaaacatttgacgtccaggtggctcaaattgggcagccttcacaggaccaggggaattggctgaaatccgctttttcctgctgtaaatcaaggccactacagcagcaacaatggctgctacagcagtcgcaatgaccacagccac

SEQ ID NO: 495055 - DNA, 146 bp, Homo sapiens
aaagttcagacgttttattgaacatgttataaaagaggtttagctcaagaaagaccaaagcccatgtcatcagtcagactcctcggattcttctttctttgcttccacgtttcttctcctcaaacctaaagaaaaaaaaacaaaga

SEQ ID NO: 495056 - DNA, 181 bp, Homo sapiens
gtggacaagtcctgtcgacaagtgagcacgtgctgacctccaaatatcgttaagctggagcctggtcgacgtgtatcacccatgggtccttgctccctgtacaagttccgtcgacacgtgaacaccgtgctgacctccaaatatcgttaagctggagcctggtcgacctctagacgatcct

SEQ ID NO: 495057 - DNA, 1515 bp, Homo sapiens
  misc_feature (945)..(945): n is a, c, g, or t
  misc_feature (950)..(950): n is a, c, g, or t
  misc_feature (953)..(953): n is a, c, g, or t
  misc_feature (1006)..(1006): n is a, c, g, or t
  misc_feature (1116)..(1116): n is a, c, g, or t
  misc_feature (1169)..(1169): n is a, c, g, or t
  misc_feature (1477)..(1477): n is a, c, g, or t
cccctccttccagcctctgctatgctaatacccagacccctaatgctgtaccagagtgtgcgctactcgacgcccgacctaaataattctctcgagagctcagacctgtgatgagtttcagtatgcactctcacgagaatggaccctcatagctatagtatttacatacgtcgtagggtataaaccgatcataacgaactgatagtgcgcagatggtgcactgcgcaattgaatgcaattattagcgccgcgagaacgaatatggcttcttgttcgataacctgtgctacaatccgagggttcacccttatgtgtaaattctggcctaagctcttggtcctatacagaatatgtgtatgacatctcgaggccttcagtctccgacgtaccattcggctatgcaccccttgaacttcaccctataactatcgaatagagtacattggcccagcgcaaaagcagtgataatagatccactagcattacagtaagccctaatgaattttccccaattctccttaagaaaacattgactcgtttaataaattgttggcaataccacgccgttaagtaattttaagtgctaccagtgtatgggttccatccgaccatgtttctggaggttcatcgaagagagttgggcctcgccacgtatccagatatttgaatttcttagaaagcccgtcttaaggcctaatggttatattcgacctgttggcaacctggccggcgatacatcatagctttgatgggcaccgccgtcgcggttgcgtaggactctttcgggcattggtacattgacagaagtccaaccggacaatgtatcgaagaaaaacttctcgcacagagatacttctttaacaggagcgtcccatataaagtcaaggaagaattacgattcctcggaggcagggtaccggcgccggggttatctttctaccgacntgtanatncaatagtgtgccctattacctttttccttcatagtttaaattatgaacttttntggattcgctacacaaaagggaaaattatgttctattttctccccttgtttaccctataaccccatggcgcattttgtgggcctgcggcacattccgcgacccaatcggnataaaagccggcaaaacggacgggaaccattaaggtaagtgggcccgtggatntgtgcggcgagaggccgtggcgcccggtttgggctgggggtgtcccgttctccccaacaatctgggtgcgtttccaacgaggctgtccctgtgcgggctgcgcccagggcgcgacccgcggatgtattgggaatgctcggccgaagaactacttaacagacccctcgctcacagtagtatttcgacgacggaaaaacactgtgctcttccggtgttcgatctcgttggtggcgattgagtgccaccccgagcagacctaccatgttgtatggtgtgaacaacccacctgtgcttaatgttgctgatcntctctcatatcgggtcgacacacacgttctagccgaca

SEQ ID NO: 495058 - DNA, 657 bp, Homo sapiens
tggggggaaaaaggggggttgggggaccaaaattttggggggaacgggggaaagggccatttttttgccccaaaaaaaattgggggggggggggtggtttcttctatatatagtggttgtggttgtgtttcttgcgggctgtaataaaaaagaggggggatggggggcctgggggggtattaatcgaggatgtatgagacgctgcagaaatttattgtgagcacctccctctttggcagaggggctaagagagggtgttgtggggtggcgctctcgacgagaaggtgtggaggaaaaatacacaatattatgaggggcgagggtgatgtagaagggatgagcgaatctatccagcgaggagggggggtcgagcggaggtgaggaaaaaaagagggggcctagagagccttgatcaagaacgcgcaccccaatattatatatcagaggtggtcgaacagaccagacagaaaagacgtcagccagaggggggccgactacaacgaatcgaaagacggtgctgtgggggacaccgccgccgcccccaggaggcccgcagatagaacggggcgagaggtgacgaatcagtcggaacacccgcgcaccaaccggagtatacgaccaccaccggggtcgccgaaagcagcgccaacaacaaga

SEQ ID NO: 495059 - DNA, 205 bp, Homo sapiens
gatccccgggccaccacggatgtggcagggagaaggacacggtgaagaagctgcaggaacagctgggaaaaggcagaggacggcagcagctcaacaggagggcacctctgtctgagtttccccttctggaacaagaagttattgttccacttaccaaaatgccttacacattccttacaaatgaaccaaacaacctacacatccg

SEQ ID NO: 495060 - DNA, 259 bp, Homo sapiens
tactgcctcagattctggtcttcccggatggacgtcttcgggaagatgacaggggtgcttcctttcgccatcttgaggcaatcatactgttccctgtgccgttttctctgggataggctgaataagatgattaggatgatcaatgcgagcagcagcaccgccatcacagcccccacgatcccatacacgaggctcggggcgatgttgaattcacaggtctctccccagtaccagtgtgtgttcgtatttgggcacaggc

SEQ ID NO: 495061 - DNA, 520 bp, Homo sapiens
tgactctagagttcccctcgaatcgacggttctcatatgtatttaaaaggtaaatgcaggccaggcatggtgtaatgccagcactttgggaggcgaggcgggcggatcacgaagtcaggagatcgagaccatcctggctaacacggtgaaaccccatctctactaaaaatacgaaaaattagctggacgtggtggtgggcgcctgtaatcccagctactcggaggctgaggcaggagaatggcatgaacccaggaggcggagtttgcagtgagcagagatcaagccactgcactccagcctgggggacagtgcaagattccgtctcaaaaaaaaggaaaattatgacaattcattccttttctagatgaataatattccagtgtatctgtatgcacatttggtttatccattcatctgtggatcagcattggggtggttggcatctttgggctattatgaatagtatgctatgaacatggagtcccttttatcaaatattgggggtatacaaataggagt

SEQ ID NO: 495062 - DNA, 110 bp, Homo sapiens
  misc_feature (62)..(62): n is a, c, g, or t
cctgggtagctcaggggaggaggtgggggtccaggagggggatccctctccacaggggtcancccaagggctgggtgctatttgtaagggaataaaatttgtagcccaga

SEQ ID NO: 495063 - DNA, 419 bp, Homo sapiens
cgatgaacatgtaagatagtaaataacctcatcatattgactcttgctgcagtaggacatcttatgtatttactcactgcctatgctacccatgtgctatcacatttttcctggttataatacatataagatggagagcaggatgggacagagctgcccttgctgatggcaccttcagtgtaagctcttgcttgccaatggccactcttgggggcacctgcttgcacctctcatcgggctctgggtgacaccctgctgttgtccttgtgggcattgagggttcactccaacggtgtgtccaggcgagctgcctcctcactggtcttgagggaatgtccagaggggccgggttacccaatcacttgctttgcttttgggttgatcttttttcatttctttggtgctacgataataatttt

SEQ ID NO: 495064 - DNA, 189 bp, Homo sapiens
tcagctcggtaccatgcctataacctcccttgcaaagaacaggttatatctgatgataaatctgaaatacttgagaccagaagtatttcagattttggattttttttaggtgctgaaatatttgcattgtatacttaaaagttcagcatcccaaatctgaaatgttccagtgagcatgatggaggtgct

SEQ ID NO: 495065 - DNA, 124 bp, Homo sapiens
gtggtgctatagaggatcccgacattgtgtctcagtgtcatagatattgatgtttgctgcgatggcgctaatgaacccaaccaattgggcgacttgagaccactcgaaccccacagtgccactg

SEQ ID NO: 495066 - DNA, 195 bp, Homo sapiens
aggtggcccgagcgcaggcgccttgggcggtcaacatcagcgcagggggggtctcaggacgtactaaggaccaacctggggcccaagggcacatgaagatgctcgtttctgcgctggagacatcaaacttactaaagacggcaatgtcctgcttcacgaaatgcaaattcaccacccacagcttccttatagcaa

SEQ ID NO: 495067 - DNA, 1187 bp, Homo sapiens
cggatatttggtatcgattggggccggggacgcggagcagtgtggccgcggcggggcagctgggccgccagcttggtgcctcgtgggaccgtctcccgctgctttggtcaccagcccctgccctgccctgaccctgctccgttctccgtgcctgctgatgccctgcctgtgcctggactttgctgcctgcgtcctggcgcatgcatgctgcgctcagtgtgggcccctgctctgtgcgccgtgctggtgacctgtggaatgccctgctgttaaactggggcaacctgtgtgaccctgtgcccgtggtatggcttgaatgtcagcaatcgagcacatgtccaatgctgccctgcgatgtcaagggaatgtattgccgacgatttttgctagtcctgagagtgaaccacaacacctgagcctcaacatgcacttgcaagtgatacaatggagactttgacgcagtcatcttggcactcggacacggttcagacgggaagccgtctatggtccagcatgatactccaagggatggactaacgcaagcgtcccacagaagtgaacgactctgaaacggctgcagggcccaaggcgtccgaggacaggacgctatcaaagacctttggaagcagcgcaaggacttgtgcaacatttgctcacggcagccttcagggaggacagcttgcgctatttgaggggccagagcagcacgaacggccattccaggtgcagaaagcaagggactgagggaccagttaagcgtacggaccttatcattggcgacagtacacagcgggaacggttacccacgggacacggactgaacacgaacacgacgaacagagacaaaacgacttatccacagaaggtttcccccttgggagaccccggttcacgttactagcagcgattacggttcaccctcactgtattggaacggagtttggtggacagaaagccgaaccgccaaaggggcgtccaacgcagggaagagggtgcgcagacgtagagacaaacgtcggcaaggataccatgtgacgttcacttcccagcgacaaccaatagagtaggaacataccgcgaacgacgtacttaggcagacggaccgttgagtgacgtgcgaacaaaggaaaagggcaggacaaaccataggaaagaatccgacatggaaacaaatctggcacacacgc

SEQ ID NO: 495068 - DNA, 85 bp, Homo sapiens
catggatttgctggtgcagtacaactaggcttaatagggacgttagaaggaaaactatcaaacagaaaggacatccacaccaaaa

SEQ ID NO: 495069 - DNA, 360 bp, Homo sapiens
gctatgcaggcagatcacgaggtcaggagattgagatcatcctggctaacatggtgaaaccccgtctctactaaaaatacaaaaaattagccgggcgtggtggcgggcacctgtggtcccagctacttgggaggctgaggcaggagaatcgcgtgaaccagggaggcagagcttgcagtgagccgagatcacaccactgcagtccagcctgggcaacagagcaagactccatctcaaaaaaaaaaaaaaagtttatggtctaaaaaaatacatagttcttcagctttcccaatcagatccattttaattaacccaccattgataaatgatttactttggccaacaaatggcccatttgga

SEQ ID NO: 495070 - DNA, 148 bp, Homo sapiens
ggacgtacctcaggaggccgctggcagtgtagagccgcgggcagtcggggtctcagagccagtgtctgtcaaaggctcagcatgtttctggctcactttctcagaggtcactttctttggtggattttggacgcgccatcgtgcgctt

SEQ ID NO: 495071 - DNA, 650 bp, Homo sapiens
ggtatgagcttgagattatacaccactttattttatcattagcggtacttttttaaccatggaggagaatctagctctttaatctaagagggccccatgggagccaccaatagagaccgcatcttgtggccattttcaaggtcaagcatctttcgtcctacagatgtaacaccacacatgtccctgagatagtggactggtatggcaatccattgcatgtgaggattatttttgcaggctcaaaggaaagaatcatacgaggatactgccaaacaattggtatgacggaccatttaccatcccagccatgaatctaatactatgagagcgccacagagtcggccagatcgataattgtaacagactgctagatacgagcaaactatacctgattatcaccatgaaggataggcatgacgtaagttacatccttaggaactgaacattaccgtccaccacgtggaagacgaagcctatagataaagtaatattgttaggctttgcagccaatttgtacagctatattaggtacggcagacacggagagccctgcttgaggcgaatgcactgctgcccgaaggaaccattagacacagtagcgcccaacccacggggggcatttccaggtttgtgtcccctttcattgagga

SEQ ID NO: 495072 - DNA, 766 bp, Homo sapiens
  misc_feature (114)..(114): n is a, c, g, or t
gagaatgcctgcatcaggagtctcatatatgactcggtttgctctgtctttcctcattggccgaacgccagtgcccctgcctcgctgccgtcgacgcatacgcctgccgctggnacctgcgggacgtctcgggccatgcatctggaatcggctcgagcagctctccatgaatagtgcttcgacttcttctttgtcttacagtgcgcaccctgacgaatcagagtatcgactcgggacagtttctcctaatgcaattgttttcagtatcgtctattcagcctgtaaagccactctacacagaatgtacatgagttaccgtggagataaatgtgagagaaaagagcgctcagtctacgaaccgctcactctgaaatgaggtccgcccatactggcaggtgatatgcattttgaaggcagatgtgaatccagagtctcatattgggagatgtatgataattatgctcaatcgagactgaaaggattcaggaagaggacgcgttggacccaaacgatactggatactggcaacaagctgttcctcattccagaagtaaggcgtctcattgataggacaagacgagtgagatgtactatagtctggtaccatgatgccaattacgaaaaagctccagaacgaaggagtctatgaactggcacttttcggatgaaacctggtgggccagctctgtggggttgatgcatttaaaagggcagttcatgctcatgtcactctaggtacacaaaatacgttggagtgttccacaca

SEQ ID NO: 495073 - DNA, 272 bp, Homo sapiens
atggatgtctacaacccccccatttacccagggggccggttttccaagggtaaacttctgcccccaccctcattttggggggggccctggggataagggctctttcctgagggtttcctgtttggtaggccctgcaaaagcccctgcagtggtttatagcatccctgtgaggggatcctttccctttttcaaatgaggaaacccagacctggagaagtccctcggcccccccaagatcccataacccctccaataaaaatccgttggatgga

SEQ ID NO: 495074 - DNA, 101 bp, Homo sapiens
ccgggacgaggcgatgatcctggcacgaggcaaagatccgggggacactttgtggaaagcagctgtgccttccatcatcatcatcatcatgacccagcttt

SEQ ID NO: 495075 - DNA, 971 bp, Homo sapiens
  misc_feature (191)..(191): n is a, c, g, or t
gccctgatgtgattccgtcctgcgcggatgttctctgcgagtcagctgattgcttatatatcatcacgatcctgctctttctcttcctatcctaatgtgcggtgactgacgaggcctgaatggaatcattcgatggagcattggagcagtgacgcaccccgtgagcgcgcccagtaactagtctattatcnggctctgtgaagctaaacggaccgatcgaagagtctatcagcttgtagacgtcgtcggggctatcatcgatgtcgacacccgtcgatgccacccctgtgtagtccttctagatgaatctcgggtcatagtcttacagggtgcctcgtgagcataagcggagtgaacgtatgctaccaagttggattcgaaaggcccaaggcgtgaatgaaaatgaacggtacagggcaggttccaagaatctgagagaggtttaaaacaccttgtgtacaaagcgtctcaggaggaccataatgtcttggtaaacagttccctaggtgggattcataacccctgttgtgcagcgcctttctgcatcaagttaacgtcaccccaaacagtttgcgttgcgtataacaggcttgtgaaaacttatgtccgggtatccaagggacccacgatgtccgttagtcaagttgtggacctttcctcctttaaatcatgcactgaaggcaaggggaccaattgtcccctaagatccatgatacgcaatgtcaagtactggaagtccacagcattgccgcatgaattgtcctataaaccttattgtccttgggatacagtcagggaaacttgacctcgccagctggaatggtgggcattggcgcattagtttcccaatgagtaattacgagaagcttataaactgcttgccctgcactcgcattgaagaccattaaatgaagagaactcagaattgactgcaacgaagggaccgcaatggatgaaaacggaatgacttg

SEQ ID NO: 495076 - DNA, 155 bp, Homo sapiens
gtgccacataaccatgattggtacttatctgttagcccatgtttgtatgtgtgcagctaaatgatcagatggggctttaaatcggcatatgtatgtgtgcgacccaattcatcatacgcaacgtgttccccctgaatttgttgcgatggcatcaa

SEQ ID NO: 495077 - DNA, 1010 bp, Homo sapiens
actacttcaggtcccagctggcaggaatgcatagaccagggcacgtataagacagttgtactacattgaatggtcgcataatcgtagagacatggtcataaacaaggcaaactgctgcgagggatgtcttgctgccatgacatgggcgaggtcatcctgatggtttgctatgactccgtgtctcgctggaaaaaaaggagggaggtgcattttactccctcgagctgcgcatgtacgtcatgctactgtaggtaatataacgggcaactctgaagtgagctcacatggcaaagatgtgtcctccctggttctacccactgctcgtccagttactagtcacatctctccatctaaagccaatggtatttacatatagtccagttgtggtatagacatcactctctgtctgagcaggatagcatcaactggatttactgattctgcatagatagctctttacttctttggaccatactatcacgcgcactaaattctagatcataatgggggctaggcatactgcaacatgaagctggcggtgtccctcgtctttcaacatttcctgtatactagtaatatgctgggtatgtctgtcggacgagacctgttggaaatccctatcatgggcctgagactccgacgcttttacaatgtcttatatacacggctttgtccgtatcgatttgagttccaggggcctcaatccttgactggcattgcgcgaacccttttgttcgcgtcagttcccctccgttgtcaattggtcgttgcaggaatggcccctgctggactgggactcggctcgtgtagctctcaagttcattactgaggtgtgcctggcgcacttgttgctacgccgcaggtgcgcgacagcttggactcactggccattggggatctaacatttttccccccttctggcactcgttacttctggcccacgttatatcacttccgcaccgtgggctggttcccgacctcctcttcttggcgggtccaaccgccgagcc

SEQ ID NO: 495078 - DNA, 319 bp, Homo sapiens
aacgcccaggccgacgtagaaaacgcccaggcagcgaaagagcgaaaccgtgccagcccggacccgaggaggcaacggattgaggaagcgctgagctgtagctcccggggtcctatctctctcagggccgaggcacgcagcgcagccgtctctctcttctctccaggcagatggggctgtggctatacgatggggtctccctcacctccagcccatgccagacgagcgtgcagctctctatcctcatggtgcccactaagagtcatactctgccagatgctgctcatcctgctgacccccatccactcagccaaagcag

SEQ ID NO: 495079 - DNA, 142 bp, Homo sapiens
gataagtcgaaactgaagaagacagagacgcaagagaaagatccactgccttacaaagaaacgattgaacaggagaagcaagcaggcgaattcgtaatgaggcgtgcgcgcgcaatatgcactgtacttccactagcattgc

SEQ ID NO: 495080 - DNA, 228 bp, Homo sapiens
  misc_feature (192)..(192): n is a, c, g, or t
tcctcctgggcggatgttatgatatgtttgcggtttcgatgatgtggtctttggaatagaaacctgtgaggaaaggcattcctgtaatgctaggtgccaatggtgagggaggcatgaaagtcattgagagtcgagcccaaaaagatgaagaaaaaatggaaattcaggagatccaactgaagatgattcaangaaactagttatacgctgccccaaatgaaaagtggc

SEQ ID NO: 495081 - DNA, 515 bp, Homo sapiens
atttttagtaaacttacagacttgtacagctatcaccacactttgagaacatttttcacccccaaaagttccctcttttgtgtctatttgcagtcactccccattccccctgcagccccagcctaccgctcatctactttgtgtttttctggttttaacttctctgggaattttacataaatggaatcattcaatatgtggtcttttttgagcctggcttactttttactttgcataatgcctttttttttaattgaggtgaaattcggataacatataattaatcttttaaagtgtataattttgtggcatttagcgcattcacaatgttatgcacccacggcagctctctagttgaagaatcttttcattccctcagaagaacaacctgtacccaataaataatcacttttcattctcccctcctttcatctcctggcaaccatcagttggctctatgggttaactattctggatattgcatataaaagaaatcatacaatatgtgaaaaaaa

SEQ ID NO: 495082 - DNA, 100 bp, Homo sapiens
ttcactttctacacaacttttattgaaacacatttttttggaaaatgattttaggttttccctatagagattcttaagaactgtcatttttatagcttta

SEQ ID NO: 495083 - DNA, 170 bp, Homo sapiens
caggcccaagattataggcagcaggacaatcagtcaacagtcactggcgggtgctgacatgaaatgcacgatcacagcatcaggcaaagacgcagattcacatcgccatattggtctgttccggcgtaaatacagcccacatctgatcacacaccaagacacgtccaacg

SEQ ID NO: 495084 - DNA, 446 bp, Homo sapiens
  misc_feature (269)..(269): n is a, c, g, or t
tctctttcagtaataattatctcttgcagagttaatgtgcaaatgaaatgggaataaatatgactggagactaccctacagaataccatatacataatttatattcaacattacaaccttatgtttgtgtttcaagaaatatggcttccttcattattttcttcaactagatgatgaagacaatagtaccaatgtaccaacggcccaaaaagctatttgtttattcattttttactgagaaaataaattgtcataaggtgacaaactanaatcactgctctccttcacagcccctaatgccaggtgtcttacataagagttgcatctttgcccaccccaaagttgacatgtacaagtttacaaggaaggatttcattatcaagcctcaactgtcattgccaggtcatttcaacccatgcacattttcttgctctgtgcccactgcc

SEQ ID NO: 495085 - DNA, 419 bp, Homo sapiens
ggtgttctagaggatcccaagtgtgctatgatctcacctgtgagtagccactgcactccaacctggacaacaaagtgagacactgtcttcaacaaacaaaacaaccacaaatcaaaaacactttaggggccaggatggtggcttacacctgtaatcccagcactctgggaggccaatgtgggcagatcgcttgagctcgggagtttgagaccagcctgggcaacatggcaaaaccccatctccattaaaaatacaaaaattactcaggcatagtggcgtgtgcctgtagtcccagctactcaggaggctgaggtgggaggatcacctgagcctgggaggtggaggttgcagtgagccaagatggtgccactgcattccaacctgggcacacattatggagatgggcacacattatggag

SEQ ID NO: 495086 - DNA, 689 bp, Homo sapiens
cacagtggctcatacctgtaatcctagcactttgagaggccaaggtgggcggatcacgaggtcaggagctcgagaccagcctgaacaacatggtgaaacctcatctctactaaaaacacaaaaattagccgggcagggtggtgtgcgcctgtagtcccagctattaaggaggccgaggcaggagaatcacttgagcttgggaggcggaggttgcagtgagccgataccgtgccactgcactccagcctgagagacagagtgagactcttgtctcaaaaaaaaaaagtgcttctgccaattagagcgaatttattaccaggtaaccagacaacctgcagaatgccgagaaaatattctcaaactgtgcctttcacagaggtctaatattcagcatctataggaaaaacaaaacccctccaaaaaaaacttttggggggcgccccggcccagaaaaaatgtttcaaaacccacctctgttggcggcgcgcgcacccaacgtgactgcacactggcatacagcgtggcccagggaacaacccggggccaagacacaaggcggtgggctctccaccaaaaaaaaaaaacccgcgggagcacgaggggtgttgaaccaaccccgaggggtccagcggccaaccgggtcttccaccggggtccacgaagcgataaaacgcggcccgggagggagg

SEQ ID NO: 495087 - DNA, 556 bp, Homo sapiens
gtgtctatgcgatgccacctgtacgtcaatctgccatcttctcttggtcaaggaagtcccaaagccagtccagagaaaacactgggaaatagacttcccttcttgagaggaggaacctcaaaataccatggctgtgtttttctgtctaccatggtaaagatcagtatatttggattttttttcctgcacccaatattttgcatttggtatttctaacagttgttctgtgtttctctttctctttccttgccttttttggttgatttttttctatggattttctgtttttaatttcgttgacttgtgctcttatttctttccttctgcttattttggatttaattggctcttctttttctaatttcctaacatggaaacttggagtatggattttagatctttcttatcaaatatatgcactcaatgctatacattttcctctaagccctgctttcacagcatcccacgaattttgataagatgtacattttttttccacttagctcaaaatactttaaaatttctcttgagatttcttctctgacttgtgttattt

SEQ ID NO: 495088 - DNA, 1303 bp, Homo sapiens
  misc_feature (1098)..(1098): n is a, c, g, or t
acagaaaacagaactttattccaagggccagaaggtttatttaaaattattttacactctcacttgtggaaattcagtgtgtggaggggctgtgggcccagcttcagcagaaaagaaaagagccctttcgtgtgtgcagccaccgagggccagaaggcctccagaaggctgtgggagcccgggtgcccccatgtgacagggccctgtggcgctgtggtgcgtgtgccagaggggccgggtgtgagacactctcacactgtggcctgtgagggcgctgtgacgagaggagatgtgtcaccaccaagcgccacaagagagaagtcttttgtggcacactgtggcgcgctgtgcgcgcccacgatgtgcgccagagggcgcacaacgccacaacacaacacaccccagaggagagacactatacggagcggagagggcacgccccgagtgcacaacgctgtggatatatacagaaggccgccgagagagtcatctgtgtgtagggtgtgtgaggtgttgcgagacgacacaggagcagagggtccccccatttagactctctcacacacaggagtctctcacagggggagcagtaatacaacgaggggaccccctgttgtgggtgtcactaatctaaaggagtctctcctgtgtgagatgtgtgatgagagctcgacaacgcggcgcgcgtgtgcggcgcagtgtgtactctccaccatgtgggcgcccccgcgaaagcgctctacgcaggcccgaagcgagagatgtgctcggataaaacacacgggggtgtcttctccgtgggcgaaccatttaccaccgctgtgggggccccccaagttgggtacaccaccggagtgcgacaattatttcccgccacaaacgagaggaagcggtgataacacaacttgtgttggcggggacaacccccgggcgcctcttttgccgagactatacaaaaagcttttttcccaacacacgggggcgtggtgccctactctacagaagaactcactctgagggacataatataaggacaccgaggcggggctgtcccgctgggcacacaccggcgtaaaaaaccccccctgtcggagtcgncggagaacacctaggggccatcacccgcgccggggcacaaccacaaacgcggcgcccacgacagattgcactacggcagcgcacactgatagcggagagttagaacacccgcgccccaccccgcaggcccaccaccacgatggtgtgggcgaaaacacctccggcggcggcccaccaggcagccctccaccacccaacacacagg

SEQ ID NO: 495089 - DNA, 450 bp, Homo sapiens
  misc_feature (53)..(53): n is a, c, g, or t
cctacctggtggttttgtgccttcccccactcttttttcatttttggatatgncgaagtcaggaaactcatcctcaggcgaccccctggcggctgggtggagaaggaaacctactattagccccccgtcctgcccgccgtggagcatcaggcccccccctttgcatccgaccccccccccctctttgtgttcttcagttttggagtttgggactctaccctggtaggaaagccccccagcatgtggggaaaccaaacgtcctggaattaagcctgtagctctatggggggaggggggagggctgccttaaaaccatccctctgtggaaatgacaacggggaaggtttttatgggcccttttgtttttgtaaaaaaggaacccccggaaagactgaaagaataccttttatatttggattttttcaaataaaaatggcttttataatggga

SEQ ID NO: 495090 - DNA, 232 bp, Homo sapiens
gggaggagctcgaccacgcacccaaagagatcacctctatctattgatcaccgtttctgatctcacctggctctgccccctatactcgtcggtgaaaccaacgtcccactctcgatctgaatcccattggagtaaatccccctgtaccccaaggcattaggatgggggagcaaaaagcaacttatgtattttcttccacccccaccccaaattaaaatgttaagctgctgga

SEQ ID NO: 495091 - DNA, 153 bp, Homo sapiens
  misc_feature (1)..(1): n is a, c, g, or t
ntatagatccccctatcaagaactggccaagaatgggtaatttataaaggaaagagggttaacttactccaaatccaacatggctgtggaggcctcaggaaacttacaattattggggaagggggagggggaccaccgtatcatggtcacaag

SEQ ID NO: 495092 - DNA, 276 bp, Homo sapiens
ttcgtcctcggtggggaaggcgcccatgcccaggaggccgttttccgattgcagcatgacttccatgccgtcggggatgtagttggccaccagggtcgggatgccgatgccgaggttgacgtagaagccgtcctgcagtccgcgggcgacgcgctgagccatttgttcgcgggtaagagccatgtttgttgtccttttagtcgggctggggaagggcgatcacttgcgcacggtgcgctgttcgatgcgcttctcgaaggtgccgcagatggcccg

SEQ ID NO: 495093 - DNA, 140 bp, Homo sapiens
  misc_feature (3)..(3): n is a, c, g, or t
tancttccacagggtctgtccagattccaggagattccatgtttgagtacataggacttccccaaaaacgaacaagaacagacattggtatctctctaatcaaatgctcctcgtgagccaccgtctgatcagccatggga

SEQ ID NO: 495094 - DNA, 214 bp, Homo sapiens
ctttcccccgtgagagacttcttcaattaaagctttgttgggctgcatcaccatgcaggagaaaaggaatacttaggggcgtggttaaattaccagtgtgcgtcaccagtgaggtatgcctcaacataagcctataaaacgttataaactgaactagaacatacccatgcagtgaatattttttcagtgctactaatgcaaacaaccacaccat

SEQ ID NO: 495095 - DNA, 272 bp, Homo sapiens
agatggtactcagtgcgaggctcagataagtattgcgggctgaaaggcaactgctgatactcaaaaccagtactaggtaacacgctcctctatacatcagaaggctgagaagcgatatctccctaaaaacagctttatttgataatcccaatgcagtggaccgtggctccttctggaaaatcactatcttgattactgagcacataattcagtgattgtcctgtaatggcacggataattttccacaaaattccgaagtggcaggaaacaag

SEQ ID NO: 495096 - DNA, 508 bp, Homo sapiens
tcgagtttacgtttactctggttccacagctgtgtgttctctagtgcctctcccttgggctaagcgagggcacagctccatgtccttctgaagcaccggaaccccgcagcagcacaggtagccaaggcctggctcgccaggaagccatgcttgaacactaggttgggaggggaacaccccagcactttggtcctattgaggcttgaagtgcctgcttgatcctgatcaaggggccaagtgaaagcctgtgctggttgtgggaaagtgccaggctcacatggtccagtaggcatacacgagcgtcaggaggataaacatggccacagagcgcagcatgttcttccggttctcttgccgtctccttctccagggacctctgtgccctctgggctcagctcccggctgtgaagtctggagttcgcgccctgcaggtctctccgacactggcacagcttctcctctagcccatcgatctatagagcgacgcccatattctcgcgcgtcttct

SEQ ID NO: 495097 - DNA, 423 bp, Homo sapiens
  misc_feature (25)..(25): n is a, c, g, or t
catacctggaccttctgttctctgntgtggaaagctctcccaactgttttcaagatcggcaatctcctactcagtttcttcaaggttcaccaatagttatccacttcctgtcccaaagctttccctagttcccttggcagagttgcatgcctcctcttcagagctccaactgcaccacgttcctctgtaacttcattcaatcattgctgtttttatacatgtctcacctctaagttggtgtctctggaactgtggctgaggtgaatacctgatatttttgccaaccagctttcatctattcatcctacttctgggaacagtgccctggatttcctctgggacaccatcccacccctgctgtaagccctgttattttagaccatccgtttccagaccactggggttgatgcagggatggccaca

SEQ ID NO: 495098 - DNA, 169 bp, Homo sapiens
gctcgacagcctgcgtcagattaaaacactgaacagacaattaacagcccaatatctacaatcacccaacaagtcattattaccctcactgtcacacaccacaggcatgctcatagggaagggttaaaaaagttaaagggacctcggcaaatcttacccggcctgttta

SEQ ID NO: 495099 - DNA, 116 bp, Homo sapiens
gttgctagtaaagtccccagtccgtaatcttttgtataacagtacaaaaaaaaaaggctcatgagagaaaatacctagatttagaattggctcttacatctttggtattttggtgg

SEQ ID NO: 495100 - DNA, 443 bp, Homo sapiens
caggaactggcagcatcgctcaccaggacactggacctgcaggagcagctgcagtctttgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcaatggcactcatggaggctcagcaggccgaggaggtggtggtgcttgaagccactgcaagggccctggggaagcccaggcctcccctccccgcctccccaagcttggggagcacctttcttgtagtgcccccttacccaagccatgtcttggacaatgccaagacagctgctcggcactgtcatataacttgttcctggaagtgaaataaaaaaataaaaagaaaa

SEQ ID NO: 495101 - DNA, 280 bp, Homo sapiens
ttatgttgcctggaatagactggaaaaataactgcgacagtgcaaaagataaatcttgggccctttgatttacctgccagacaccactcacctgatagctgttggcatccagcctgtaagcgatcgttgcattactgaactctgtttcagttccacgaactgacaccactacctcgcaatgcatatccacaggcaccacattgaacacacgttagatgaaacccaaatggcaagaatgaatgtaacccatgaacaaggtctttatagcctctatctcgcg

SEQ ID NO: 495102 - DNA, 131 bp, Homo sapiens
ttttgaaaatgaattttttttttcctttgtggtttttaaaaaatgttgcccccgttatgcttcctgcctcgttacattttcctccggttaatgtaatgtttagttcctttgccattaatattttgctgcca

SEQ ID NO: 495103 - DNA, 446 bp, Homo sapiens
  misc_feature (20)..(20): n is a, c, g, or t
  misc_feature (23)..(23): n is a, c, g, or t
  misc_feature (136)..(138): n is a, c, g, or t
  misc_feature (145)..(145): n is a, c, g, or t
  misc_feature (229)..(229): n is a, c, g, or t
  misc_feature (292)..(292): n is a, c, g, or t
  misc_feature (388)..(388): n is a, c, g, or t
  misc_feature (401)..(401): n is a, c, g, or t
  misc_feature (414)..(414): n is a, c, g, or t
  misc_feature (438)..(438): n is a, c, g, or t
gagtccatgatccgcatggnagngcccacgcgcgcatccatctgcgggactatgtgatcgaagacgacgtcaacatggccatccgcgtgatgctggagagcttcatagacacacagaagttcagcgtcatgcgcannncgaaagnacttttgcccgctacctttcattccggcgtgacaacaatgagctgttgctcttcatactgaagcagttagtggcagagcaggtnacatatcagcgcaaccgctttggggcccagcaggacactattgaggtccctgagaaggacttngtggataaggctcgtcagatcaacatccacaacctttctgcattttatgacagtgagctcttcaggatgaacaaagtttcagccacgacctgaaangggaaatgattcntgcagcaattttngagggccttttggccttccttaanggtttcct

SEQ ID NO: 495104 - DNA, 776 bp, Homo sapiens
gccttgcatgtggactggcacctgcgggagctgaagctcaatgccagctccctgctctgctgctccattcgcctgcctacacagcagtctggtctgatggcaccaggaagtcctcacaggcaagatgaggtcattcgggcaggtcctgagccacacctcaagtccgaaagatgttccaatacacagctggcctcaaagggttccgccttccaggtgggccgttgacgttagccgtggtggcggagggctatgtcgccagctgctacaaaaacagccagtatcacctgtgatccatcctcctgtgagttacaatgacaccgctccccggatcctgttctgggcccaaaacttctctgtggccgtacaaggaccacgtggcgaggactgactcccctcactttggggtgcaggaactcaacctgactggctccttctggaaatgactcctttgccaggctctcactgaccctactaacgacctctttgtaccacactgacacttcaacatacactccctggccaaaccgcctctacccagctgtctgcccgcgcacttggctccaccactcgcgaccgcctcgaacctccacacgcacctggctccgtcgcctacttcagccgcttcccaccgtcaccccgccccaccactctactccttccgcctggcgaatcatgtccaccacccctgagcaacgaagggtcagtctacttcgcggccccgccgcgcccttctcccctggcagctcatgcttcagcgacctcacgacccaggcttc

SEQ ID NO: 495105 - DNA, 727 bp, Homo sapiens
tggaaatgatttcatttacgggggaaggccctttgtgatttaggccttatttctcttgtccttccgtacagggaggaattggaagtagatagaacccgaccgtggattacttccggtctgaactcagcatcacgttaggacttataatcgtgtgaacaaacgacacctttaatagcggctgcaccatcgggatgtcctgatccaacatcgaggtcgtaaaccctatgtgtgatatggactctaaaaatcaggtattggccctgtttatccctagggtaacctggtcccgtgggccacagttaatgggatccactcggagttatagtagtccgctttagactgggtgaagtcttagctattgtcctggctcgaaggtcggggtcctggcaccgaggttctgccccacaaccgacaatctttaacagtgcaggcttgggcatatctttaaggaccgtgagaggtctggttaaggtcacggtacagcactaaattaagacttaaagaggcctcccaataggaggtcttatcatcagatcttatgacatgctgctccactgccccgcccattttattcaaagagggcgacaggagtcaaacattttacaccgtggctttacaaaaccgttaaggacgacacaatggtgaacacccctatcttgtgagacgcacattaaatacatgggttcccattcatttaagggaacaaagggtcaacaaagtgcacacg

SEQ ID NO: 495106 - DNA, 201 bp, Homo sapiens
cgagctcttaaccggtgtttatctgatgcacctctcctgtgagaggtgtacctctggtgaatcaggactccgaaggagaggctctgacccagcaagtggagaatgtggaggcctctcagttaagaagactgaatataaagaaagatgatgagtttttccatattcgtcctacctgtgcttatgccatctggggccttgctt

SEQ ID NO: 495107 - DNA, 492 bp, Homo sapiens
ctctgtcctggcactgtctgtcctggacacgctgtgtccagatgatgagctggtcggttttgggttcagagctgggccatttctctttcctccgaggtatctggtgatgcagagactctttccccgcatccctcacatgaaagaccccatcggtgacagcttccaaaacgacaagctggtatgttgttttttctgccttgggacgggtctggaggcgtggtggccactttgggaggcccaggcggcgagaccacttgaggccaggaactggagaccagcctggccaacatggagaaactccgtgtctactaaaaatacaaaattagccgggtgtggtggcgggcgcatgtaatcccagctactcgggaggctgagggaggaggatcacttgaacccgggaggtggaggctgcagtgaactacgatcgagccactgcactccatctgggcgacaagagtgaaatggcctggactaggaggctggacacctgtc

SEQ ID NO: 495108 - DNA, 734 bp, Homo sapiens
  misc_feature (564)..(564): n is a, c, g, or t
aaaattactcgcaaaatggttcaacaattcccctttggttggcttacgcttataccggtacccccacaatttctcgccatgggaacatttagccttctactctaaagaactgccctccccggctgaaacttctcctggtccgcaaggctttagaaatgccagatatgtctgcaaaacccctggatgatcactcaaactggaggacgaggacaatatggctgggggtccagagcttgacgggggctgaaacacaagcaagtgaccgtagaggtcagtcaggtcagctcctgccacaagcaggcccaccacagtgacgaagggctcggggcgctccctaggcagcccccatacaccaccaggacctgagctcgtgagtgcgtctgggtcaggaagagacctctctgtgcgtctcaggctgagatgcagatttctgttttctaacaactggaagcgaccttgtacgatgtattgaaggtgtagtgtgccaaatgcttccgacggaggtgctggccttggatggtattctctctgcccacgctgatggtcactcaagtcctgggggantgctgtgtctgacccagcacgcacctcggggagagcagtcgcacgcctcacaagtcgggacgtggggcatgctgttctcactgcgactggactgaagcaacccagccagcctcgcgggccacgtacccaacccagacgactcattcagtaacattgccaggtacacaagc

SEQ ID NO: 495109 - DNA, 138 bp, Homo sapiens
cagcaccttgtgctctactgtccactcgtcagggaatggggtgaagttgtgcaggtcggccagcgacttctccacaccgtgcttatgccacagaagcatgcccagtgcctgctccatgttgtagccattgcactccgg

SEQ ID NO: 495110 - DNA, 159 bp, Homo sapiens
ctcggtctagcggttgaggatacagatgaggtcatcgatccctcgcttacatcaaaacaattgagcaccacatggtacttgaacctactgagtacacctgactacgtgtggactaatcttcaactcctacatacttcccccaatggtgagcggcgactt

SEQ ID NO: 495111 - DNA, 198 bp, Homo sapiens
tgattaacaaagtggttgtcaattccgtgaaactcatttcttaattcaaaacaaaagcttcagtgtgtgtccaaaataaactgttacgaattgacctacttgttttttttgagacggagttgcatttatgttgcccagactggagggcaataagcatggtctcggtttactgcaacctccgcttccaggggctcaatg

SEQ ID NO: 495112 - DNA, 262 bp, Homo sapiens
ccccccccccctttttttaaaaaccaaaaaaaaaaaaaacccccccaacccaaaccgggcccaagaaggggggaggggattttttccctttaaaaagctggggggtaaaatccccgccccggatggtcccccggttgggcccggcctgccccccgcctaggggcccggtttggtccctttggccagccccccctccccccggggggggcctcccaaaggttatttttttttttttggaaaaataaaaaatttcctttttgga

SEQ ID NO: 495113 - DNA, 351 bp, Homo sapiens
gggcctgaaggaccacgtgcttgtagcaggtggctgaaatgtgttcactaggttccgttatgtttgataatagtggtcttgaaaagtccctgtaatagatccaggagactgcattcctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcg

SEQ ID NO: 495114 - DNA, 408 bp, Homo sapiens
agaatcaggcagagggatagggatggggggtttaagggagagcattctctaatacccgtttgttcatgacgagattcagttgctctgagactatggggtacaagttagatcctccgaatctggagatgttgtagagctggaacgatgtgcagagtagtgaacgctttgatgcgcatgcacattttgggaagatgctgctcctcagtggacacaaaggccgagtggggtaaaaccacgaagggagggcatggtgaagtcagctctgtggatgcagccctcactgggctggaccaatggtactcttccttggagttggcctgtgttagcaaccacatgtcaccattgcatgtcatggcttggaattcttgggccaaccccaaaatgtgcttttgcttgactggatttatg

SEQ ID NO: 495115 - DNA, 101 bp, Homo sapiens
tggcgggaaatatcaggtgtccgggcttaacttctccgggagctaagttttacctggctggcagtagataccatggtggctatcagggcagaaggaaaaca

SEQ ID NO: 495116 - DNA, 546 bp, Homo sapiens
gcgtgaaactaggagaatctttattaaactcgggaccacccaaggaggaccgatggagcggagacagggactcccgctgcaggctgcgcggaggcacgaggcactgaaagacgtagagtcacaaggatgcaggcttcggcgatcagtgattgtcgatgctcacatgggctacgctgatgcccacggatgcctgcacctatttcaccaggaaggactactggcgctgcatgacatccaccatgggctggaaccaaatcttgatgcggaacaggaaggacttgcactgcaggcggatctaatgggactgctcctacagctaggcgcgcacattcgacacctgctacttcacctactgcaagcggacgcgggtgcgtgagaacatcatcttcatgcgcacgcgcagccgctcgacgcaggcctggaaccggttctgcagctattggccagacagtgagtccacagctgagaaccagacgcggaccaattccagcaggggctacaggcactagcggatggacttgaagccgcaatgggtgccctcactgg

SEQ ID NO: 495117 - DNA, 369 bp, Homo sapiens
attattgtacctcatggatttccagtgtgatgctgaataaaagtgatgagagagaacacatttgtcttcttcctgatcttagggataaagcattcattcattctcaccagaatggagtgaagacattgtaagaccaaggacaagaacacactgttacaaacaaaaagacacccttaaaatgtgacacgaacaggttttatccctgccaagaaatattttctgaattcctagattgattaaatggtccttctctgtgctctcataatatccttacttacatctgttttatcacttacaatattttattgaaattatctgttcatgtgcgtatttcctccagtagaccataaactccttaactccaggaaa

SEQ ID NO: 495118 - DNA, 304 bp, Homo sapiens
ccaccccatcaggcagtcagggaagcagtggttttcacatttatttccagccagacagcttgggggaggccaggcacacggtagatccgggccttccttcggcccctcactcagggatccaggaaaaccacttcgggcacctcatttagtctttatctatggttagaggtctcactcggtcacctaggcgggagtgcagttatggctcagggcagcctcaacctcccagcctcaagcaatcctccggccttagcctccggagtaacgggggccaggtactggtcaggcggggcaggggtaccga

SEQ ID NO: 495119 - DNA, 285 bp, Homo sapiens
agccaaatgttcaggtagtgctgggataaacaaattgtgcaaattgtggtgcacctatgcaatgaatactacttagtgaaatgtcaatgatggaaaagctcaggaaacttaaagaaaaatccccattgtgcacatttatgtgagaaatagacatgataaagaattaagctgacactcgggaggctaaggcaggagtattccttaagcccaggagtttgaggctgcagtgagctatgtgccactgcactccagcctgggtgacagagtgagaccctatctcaaaaa

SEQ ID NO: 495120 - DNA, 513 bp, Homo sapiens
tgatctagggagggagtgattataagactgggtcccaatgatttactcaaccgggctgggccctatgggagcaatgaacgattactgtagccctaaactcctggcctgaagtgatccttctgtctagcctttcccaaattgctgcgatctcaacactgatccaccatgcctggcctggatttacaaactaaacacatttccatctttaacgaataatgagtgctgatccacactaaaagcagataactcaaaggttgatattaactttcactgaccaaagttgtccaatctttacgacaactcatgaccaaaaggatctgcttgagacacaaacttgtaacagaaataacaaggctggaggaagagcctttatagatgcacataggaacatatctagtaccctgtcttgaaatgctaaccttattatgcttttttccaagaggaaagacctaaaggaaactgagtgactgtgctattgctggaataccaaattattacaaacttcatggctaa

SEQ ID NO: 495121 - DNA, 158 bp, Homo sapiens
cgattccattcaagctccgttcctctccagtccacggcgaaaccactccactctattccattccatcctttcaattccactcaattccactccacttcattccactaccctccgctcaattcaattccactcgaaaccattccattccactccactcc

SEQ ID NO: 495122 - DNA, 102 bp, Homo sapiens
ggtccggattctctgatacatcctgctcgcttcgctacccaagaccttcgacggactactggccgcagaccaagaagctggggaaatgtgcccggggaggtc

SEQ ID NO: 495123 - DNA, 1050 bp, Homo sapiens
ccttgtcggggtgccctcttgggcccttttggtggccgctgtgagttggtttgggccccccttataagggggctttgggggctttattaagtttctcgggtgccccccctgtttaggtgtgggcccagtataaaggtcgtggcccccccgaattttgggtgtgtacccctcttctttggctcttatggagttgcccggccccacctccccatccccgttgtgtccccaacaccccccttgttgtttgcccccctgagagcacccgagattgccacagggccccaaaaaaagtgggaaaaaacgggttttgggtagaaaaaatatagggtgtaaaaatatcccttaagaacccacatttcacactgcgcacgggaataccacggctcggaaagagacccccctggggccacacggccacagtgtctccaggaggggagattaagttggttctcgcctcttctaaaattttttgtgaaatttttaaaagtgttcgctgttgtagtcttgagagtgtacacacgtggggtggtctctttaagctataaagtataagaccacactgttgtccccacattctcccgggcccctctcggtgagatattgaaagaattgggtatcccctctatggaacaaaggtttaacacacccacgttttcccgctgggttgtaaataatatatttgagagagtgggtacccccttatgagaaaatagtttttcaacgccacgagtctcctgggttgagaataataaggttgaggggagggcgctatgtatattgaccacacatttttcacatgttatggagaacaccctgagaaatgtgacacaccacgctcaccacgcttctgagattgaaacacttgtccttggcttggttgccaccacgagaaaactcggagtatgttttacacacacacgggaaacacacttgtaggagcttccctttaccacacacactaacttttttaaatgttttggctatattgggtccactattttaatttagagcgttataagggtccaataaagccaacttttgatgcctcca

SEQ ID NO: 495124 - DNA, 182 bp, Homo sapiens
  misc_feature (3)..(3): n is a, c, g, or t
  misc_feature (125)..(125): n is a, c, g, or t
  misc_feature (155)..(155): n is a, c, g, or t
ggncccccagatatcgcccatgctggaggaaacttggatgaccttccctggctggtaatgactcgtgaatgtgaagggggcaggatgtggcaggagggaaagagtcattatagaaaaccagtggncttcccttttgagagcagggatacttggangaccctaaaggcaggagtctctcctgg

SEQ ID NO: 495125 - DNA, 307 bp, Homo sapiens
caatagtatgattacagattctgtgtatcacatttgaaatgctaatgttttggcttatgttgatagttgacaacccgtgttttagcttatgtagtgtggtttctgtttttggctatcttatgtagaaaggcatgtaaggtatggcatttcttattcttcattatttttactgggatagcttttccaagattttgaatagctaaatgtctacttttttcttactagtattttcatctcagcctcattgatgatcattcaagtcgtgatgaatccagtaatcagcccagtcctgcctttatactacgcc

SEQ ID NO: 495126 - DNA, 255 bp, Homo sapiens
  misc_feature (9)..(9): n is a, c, g, or t
  misc_feature (15)..(15): n is a, c, g, or t
  misc_feature (35)..(35): n is a, c, g, or t
  misc_feature (59)..(59): n is a, c, g, or t
  misc_feature (75)..(75): n is a, c, g, or t
  misc_feature (80)..(80): n is a, c, g, or t
  misc_feature (119)..(119): n is a, c, g, or t
  misc_feature (135)..(135): n is a, c, g, or t
  misc_feature (141)..(141): n is a, c, g, or t
  misc_feature (154)..(154): n is a, c, g, or t
  misc_feature (156)..(156): n is a, c, g, or t
  misc_feature (183)..(183): n is a, c, g, or t
  misc_feature (192)..(192): n is a, c, g, or t
  misc_feature (205)..(205): n is a, c, g, or t
  misc_feature (208)..(208): n is a, c, g, or t
cccaagccngccgcngggggaggtgatagccattncctcccgtgtaaattatgtaatgngaaatttttttaatcntcgcncgtaatacgtttttattttgttttattttgaatgatganccttcgtgcccccccntccccngtttttgtccccngncgtgagatgtatgaaggcttttggtcncccggggantgggtggaggcanccngggcttacctgtacactgacttgagacgggttgaataaaagtgcaca

SEQ ID NO: 495127 - DNA, 507 bp, Homo sapiens
  misc_feature (34)..(34): n is a, c, g, or t
  misc_feature (39)..(39): n is a, c, g, or t
  misc_feature (120)..(120): n is a, c, g, or t
  misc_feature (354)..(354): n is a, c, g, or t
  misc_feature (358)..(358): n is a, c, g, or t
cttagaggatccgacgctctctctgtgggggctntatanaccaggtgcctctctgcatcggtggctctgagggagccctctcgcccggcagcaggtgggatgcagatggggctggccagngctcctgtgcccacagcagcctctgggcagtgtcccctgggcttctgtgagcagccgcagcctgggtgtgaatcttggaggcccggtggtggcggagcatgctctccatctgggagaggctgagaccatggcagctcctggcgctgtcctccccgtgcccccttcctggctccccagcttccggcgcctctccagggccactcgggcagcccctgcccaccccacaggcccttntctnctcacaaggctttgatcccaggcggcacaattgggttttcaaagcattcacggcccttgtttgtgtccctgggcccccggctggaggctgaggtttcggcgttcctgggcctggcctttgaagcttcctcttattaatcttttaacatc

SEQ ID NO: 495128 - DNA, 801 bp, Homo sapiens
ctctaggtcctgggaagatggcgaaggtctcagagcttcacgatgtcacttggtaagaaatgagagatacaatgagaaaatggacgagaagaaaactcaagaaatagtgagcaaattgtgcgaagttggagaagaactaattaatgagtatgcttcgtaagctgggagatgatatttaggatctatatatgtaacaggtgatgattgccgcgactagactatggtctgggatgacttggcattgttttgtcttcaagagctgagaagacagttccctggcagtcacagagtcaagcgattaacaggcatgagatttgaagccatggaaagatctgatgatgctatacagctatttgataggatttcaccaacgaagatccaagtaacactgctgcaatgaaacgcgtaagattgccattcgaaacacgcccaggggaacaaagtgtggaggccattcgggagctgaatgagtatctggaacaatttgttgcagaccacgaagcctggggatgatacttgcagacacttgtagatcacactgaacatgactatgcaaaagcagccttttgttgagaggaactaactgatgactaattccagactaacacttattactgtcagcagtatgctagaagttaagtatacccgaaggtggacttgaaaacctcgaactttcaagaaacgtattttgcacaggccttgaaccgtgaacaacagaaatatgagagctttgtgtggacttgatatgtcgggaagtcatattggttctatccaaaagcagtgcaaaccgaaaaggcacct

SEQ ID NO: 495129 - DNA, 342 bp, Homo sapiens
  misc_feature (82)..(83): n is a, c, g, or t
ctcatggtgagaaccacaaatagaaggtataaaagtgatttcaagaagagatgaagccggctgggtgcagtggctcacggcnnttaatcccagcactttgggaggcagaggcaggtggatcacccaggagtttgagaccagccctgaccaagatggtgaaaccccccattctactaaaaatacaaaaattagccaggcatggtggcacgtgcctgtaatcccagctacttgggaggctgaagcaggagaattgcttgaatctgggaggcagaggttgcagtgagccgagatcgcgccactgcattccagcctgggcgacagagcaggactctgtgtcaaaaa

SEQ ID NO: 495130 - DNA, 539 bp, Homo sapiens
  misc_feature (393)..(393): n is a, c, g, or t
  misc_feature (405)..(405): n is a, c, g, or t
agcagtcaatgagagccctgctactcataatgaattcctccctcagtgggccaaaggatacccaatatgcatcgaggccaccaactctctaggcaatagatactcattaccataacatccaaagtctcgtcaatacacatgtattcatccactttattcccactgttaagccctatctgtacggctcggatcagtaccccatcgagcactaacacagtagatccttttttcattgggtcgacaaattcgggcagaaagtgttcgttctcaggtagggctggcaaggggtgcaaggggtgcaacggtgggatctcctcactctcctcagagctcacccgaacgtccacaggagcaggcgagcagatatggaccagttcactgcctcaatctcanagacccctgtgnacgtccgggtgagctctgaggagagtgaggcagtgaactggtccatatctgcacgctgctcctgaggagctcatcaatttcctcttgaatttcttgggctacataagtacttgtagaggtaatcctcggaacac

SEQ ID NO: 495131 - DNA, 150 bp, Homo sapiens
cgatctagaggatcccggtacgctcggaccacggcaacccagagctgacgcaggactaccttcgcattcagaaagacccggtgccttacatctgtgcctgagcccctcccttcgaatattctcgagtggcactatgtcgtccgagcggca

SEQ ID NO: 495132 - DNA, 85 bp, Homo sapiens
agaggaaaaggtgggggtaagggcagagagagcacttgagattgctggtgcaaagtgccaagctagctctgcaacagagcatcag

SEQ ID NO: 495133 - DNA, 570 bp, Homo sapiens
atcttgagtatccccatgctgcagccacgatgcacaatgacattctctatgactcagctgcctgagtagctgggattacaggcacgtgcagtcagatccagctgatttttgtattatttagtagagtcggagtttcaccacgctggccaggctggtctcaaactcctcacctcaggtgatccactggccttgtgctcctgaagtgcctttgttctcctttttgccctttgaagcatgtgatctctgtgacctactccctgttcttgcaacccctcccctttcaaaatccttaataacaacctgctggttttgcggctcaggcgggcatcagggtccccaccgatatgtgatgtcgccctgggaggcccagctgtaaaagtcctctctttgtaactctttctcttcatttctcagccaggcaacacttatggcacatagaaagaacctacattgaaatactgggggctggttcccccgatatctggggcgccaacgtggctatactttttcctgagtgcatgtggggacccgctcccctcttggagttgtgtagaaacgttcatcgggccg

SEQ ID NO: 495134 - DNA, 121 bp, Homo sapiens
gctgtctagaggatcccgtgagaatctgtcatcttctaaacagagcagcagcaggaattctcgcgggagcagcaggaatagcagcaggaattctcgcgggagcagcaggaattctcgcggg

SEQ ID NO: 495135 - DNA, 296 bp, Homo sapiens
tatatatagtatccgtcggggaggatgatgaaagagattataaccatagcatcatatagcaaggactatacccctataccttcatgcattcatgaatgttattagaattaactttgcaaggatagtccaagcttatacctctcgaatccagaccagctacctacagatactcgtcttagagcgcacacccgtctatgttgcacaatagctgggaagattctataggtagaggcgacgaaacctaccgagcctggtcttggcttgtctctgtctaggttgtctaagttcaactttaa

SEQ ID NO: 495136 - DNA, 203 bp, Homo sapiens
cactcactttatcctctaactctagaagagacacgtgtgtctcgtaatatggccaagaacattacactagtacgtgatgaactgattgaggattccaacgtggcagtctgttccagagccagtgccatgttgcttcctgtataaacccagggttcatactcgccggtctagagggggcatcctctcacatcgcactgcaggct

SEQ ID NO: 495137 - DNA, 431 bp, Homo sapiens
ggggctgatctacaaaaatacagttttgagaaaggtaccttgcacatgaaatgttgctgtgatcaccccattaatgttgaaaatcctgctgcttgccctggttcgttctgtacttccctagggacacaaagccagcaccaaatgatcagtacccaaggaagccgtagtctgcaccatgacagaacactatccaatgcttatctttaaaggtctaagtactgctgatgcgtacttttaacccaattgatagccgtgcgacactgactggtttaaacttgaacaactgccagtctggccaaatactgacggtacctatcatattcattttggcgcacattctcattagggcaaattttatcatatcaaatatactcatttcgatagtcagtttaaacagcatattactcttgatgaacaaggagtcctcgttt

SEQ ID NO: 495138 - DNA, 119 bp, Homo sapiens
gatgtagcagaaatcagtgatatgaagccgtcctatgatggcaatagtacagcgtcctattgatagtgacatagtggaagtgagctacaacgtaatacgtgtcgctacgtgtacggcca

SEQ ID NO: 495139 - DNA, 1232 bp, Homo sapiens
gcactgcactccggcctgggtgacagagtgagacgtctgtctttataaaaatgaaaaaagaggattcatgtccttagatatagatggtaagcccactgggcaggtactgtgtctaatgtttaggtgtggcacctgtcacattgttgagagctcaataaacgttcaacgaacaacaaaaaaaaaaaaaaaaagaaaaaagagagggggcgagcgcatacgacgacagaataccgccagcagggtgccaccagaattatagacgcgacgagacgcgcaagcgttatgctgtgtgaacgacaagggggcccacaataagagagagagcaagcgacgcattataaaagagacaaggacagcggcgccagaagatgataaaacagcgggttgtgagacagacaactggtgaaaaacaaaattgtgggtacaccctgtggagaacaacacaatattgtgcaaaaggcgacacaccatagaacatctgtgtgtgagaggtgaatcgaccatacaaaagctggtcgaaaaaaaacaaacaacccaaaaacgagacagaagtataaaaacagacctacatctataagcgcggaaacatatattagttcacacatcttctttcatatacgagatgtggtatcacataaaggccgcgtccaacaacccaccagcgcgaccgtgccaacaaacatgacgcacagtcgagccgcgcacagtcaacgaaacaaagatgcaagatgagccacaccaaccgagcggagccacagccacgacacctctaaaccaaaacgacgaaccactcactgaataaaccaccacgcggcgcggaccctcccacaagcagcacaaacacaaccacgcagccgacaccgcagccacgcacacgaccaccaaccaccaccacgaaccgccacgaacgacaacaacagagcgcacgaaaagcagagacgagaagagagagaaacaccaagcaaaagaagagacgagagcgacaacacaacgaaggacggagacgaacacaagacaccgagacagaccggaagaaaacgcacaacgaacaggagaggacaaggaatcggcaagacaaggagccacgagaaggagacacgagcagagcagcagacgacgaagaacagagagagagaaagcacaagaaaaaaggagcaagacacacaaaagaacgaccgacgcaaggcaaaggtagcgaaacaacaaaatacagaacaacagaacaccaacat

SEQ ID NO: 495140 - DNA, 1102 bp, Homo sapiens
  misc_feature (164)..(164): n is a, c, g, or t
gcaaaattaacccgctaataaaattaattaaccacgtcactcatcgatctccgccagcccgatccaagcatctccgcagtgatgacaacttcggctcacgtccgtggtggcgcctgcgctgagtcctcgcaagatcaccacaggagcatattccgtagccatgncactactcgaccagacgcactcaatcggcgttttcatcaatcgagcgcacgatcagcgtcgaggacggtaaactgtatggctggaatcatccggctacacttgcacgccaagtgggggcctcaatacttcgtttagtctgcctcttccgtagcacagtcgggcgaggccgtactattagcggtatcagttgtcgtcatacgtcaagaaaccgtgaagacatcggcgattatctcatcctgcattgcaatgtatgagcaatctagcccttgcataggcgtatggtccgtcgccgtgaggccgaaatagtctatatctggaggggccagcagtaacttacgaaagcttacgtatccgcgcatcccatacattggggacagacctagttcaatgaagtctgaggaggctacctcagtagacagtcccaacctcgacacgattctttacgcgtttgcacttcatctggcccttcagtgatcgcagccctagcagcactccacctcctattcttgcacgaaacgggatcaaacaatcccctaggaagtcacctgccattccgatgacagatcagcttccagccttactacacaatcgaagacgccctcggattactttctcgttcattgctctccttactgcctttacgctattctcaacaggagctcctaggcggacaggacaattataccctagtcaagccttaagacccttcccaaattgggccgaaggaaaatttcgtaattgggcttacgagtctccgcattcgggccttaaaactaggagggggcatggcctattgatatcagcgtaagtcctagtaaatatccacccgcccttttgcacacaaggtaatttggccgtagacgcatatgtggcacgggacccctctacgtgggggacacacgagcctcactcggcgagcacggagatcacaccatcc

SEQ ID NO: 495141 - DNA, 484 bp, Homo sapiens
ctggggcctggagtccagcccctttgcgaggctccaagaactggggttgtgccccggggttgtttggggcccccagggccatttggtgggcccctgtttcatcaccacaggcctggggtcaaggggggttctccaacacccagggcccttgggatttcccttctggaagggaggggggcttcccctttcccggggcagaagaatgggcctggttaaagacccagccctatttttggggggggtttttaaaatcccctttttccccccaaaatttttcccccccccctttttttgggggttgaggagggatatccccccagggggcccaaaagccctttcattttttccccggccccccggtttttttttttttttttcaaaaggttccccccccgacatgcctggggggagccccccggggcccttattcccccgggacccccctttaaaatttcccagggagccataaattccttttttggga

SEQ ID NO: 495142 - DNA, 396 bp, Homo sapiens
  misc_feature (29)..(29): n is a, c, g, or t
  misc_feature (52)..(52): n is a, c, g, or t
  misc_feature (131)..(131): n is a, c, g, or t
  misc_feature (153)..(153): n is a, c, g, or t
  misc_feature (172)..(172): n is a, c, g, or t
  misc_feature (208)..(208): n is a, c, g, or t
  misc_feature (280)..(280): n is a, c, g, or t
  misc_feature (325)..(325): n is a, c, g, or t
  misc_feature (329)..(329): n is a, c, g, or t
  misc_feature (337)..(337): n is a, c, g, or t
  misc_feature (345)..(345): n is a, c, g, or t
gtcaggtcactgccactgcctgggggctntagtcattcaagtggaagacgantgtaactgcgtggtgatgtgacaactgttcctcccagaccccagaggactggcttctaggttgggatcaatcctgaatntgttatgtgttaatttacttcnattaaaaaagtatagtatntataatacaaacaataacccttctggggtttcttgnggcggttggaaatagtcccacatgtggtcatcagaaaataagtcattcctcataccaatatagatcagctcnttgacctctgaggggcaggagtgcttcctggtgtgcgtattagantccnttcctganggtcaagntacttactcatcctttttccatatcagtataataaaggagtgatgtgcaat

SEQ ID NO: 495143 - DNA, 835 bp, Homo sapiens
gcacagagggaggagcgagctgatcagtgtgtctctattcagggcggtcgcggtcccgatggtccgcgtgcatttctcaggtccctccgaccgcctccctggtcgttcatagcgccttcgtatgatcccgcacgtgagtcgtgacgaacgttccagcgacgcaggccagtggcctctgttgactgagaagtgtggcatcatgacgtgaagcatcaagtgttgattcttacagcgaagtggattacaacttatgctgaagactaggctggcgaaggtctctctatgcccacaggaatcttcacttacgaacctttgcaatagattgatcgtgaagagaaccgagatcattacaactatctcgattgactctagagcttctagatcctagtctgacgtgaatctcccagtccctgatcccattcttctcatcgattagccatgtatggatctggatggtcccacttatcatatgcaagctgcaacgtgcttggcatgcagtgttgaatgagagctcttttccaagggacactccagaggtagtctgttgtatgctctcaattgcgtggatgcttgcatagatagtcaaatccagcaagtcatgatgtgagcattacttgacgaaacgtgaaaacctgagaatccggcttgtttgattgacgaaactgtaacacggtcaagaactgtgggttacaagctcctgatttcccaggatacgacacgatggaaaacaactttggggtgtccattcaggaggaaacagttgcagagctaagaactgttgagagtgaaagctgcattcttatctggaccagatttctacgattttatattaccg

SEQ ID NO: 495144 - DNA, 810 bp, Homo sapiens
gtggcgcccttccctccgcttctctgtgctccccgcgcccctcttggcgtctggccccggcctctcgctcacacttcatgcaaacttaccttagactcctcacattgtaacactcaacggcgacatggcgctactgcttcaaacaaggaatgccccacacagctgttaccatggcccaccaaacctgcgaacgagtctacacaaagtatacccagcaatgcatgatcaggcatcagattgtacaacaacacaagcttaacgcggcaagcattcttgcccaacgagaacttacagtgtgcgctacttgcagccacagtgcgaagccactctacaggagcaccgaggcagtagactctccgtgcacaatcgctgctgcaaggcagaacagtgactcagcacacagacagcaaatcgtacagccaccagcaggaaaagggtacctgggcttcaatctaatcagtcagtccagcccttgcctcacagcccagcagccaacgcaacgaccttcgctgaagcaaacacaaactggcgaaacgagacgccctgtagcctgccatgcgcaaacccccttagttacccccccttaacttcaaacactttcaacttgcagccaacttacactaaagcggatgcttacatacatcaaccaatcacaatctacacaagcgcgcaacccatactatgtgtgcacctaaccaataaacaacaccataagacataccatccaataaatattataaaaacacaataaccacaactatcaactcaaccacacactccataataaataaatcactatcatcacaccat

SEQ ID NO: 495145 - DNA, 320 bp, Homo sapiens
cgaggtactctaagatccctcttactgtgtgaggtatcaagtctcttcttctcttcttctggccatcttctctctcagttctggccactgcagtcccactgactgacatcaacactggatgatctctggcttcctgggggctactaagcctcacttcaggatccactgaggacaaagcattctttgatgatcctttgttcacatctgtccctgaggttccttcatcagcgggctcttgagaagatgaaggggttttagttggctgactcctctcctcttccttctgtaagactgtctgtttcgttacttctccagcactg

SEQ ID NO: 495146 - DNA, 511 bp, Homo sapiens
  misc_feature (507)..(507): n is a, c, g, or t
aacctttttaacagttttaagataaaattggctgcagccttggcaagatgtcgaatcaagcatgatgccctttcaatttaccacatccttccagaaacagttaggaaacaggaactaagggcctccactttaccactttatgcttggataaatacttgtaaaatcagccctgaagaagtttataataatttgaagagaagaggctataataaagtcaaatctgtattgcatattgatgataaagtctttgctgtggatcaacattgctatgatgtcttaatttttccatctcatcttaaaaatgatcttataaatatagatcttttcaaagattacaaacttatatttcaggtaaactaatatttactttcattgtgattctcaacaatccaacctagccaaagaacttctccacttaaaaataaaacctaacactgtttatatttttatagattatcagggaggtttataaggcctaattgtcaccttgaataaaattaatacctntaaa

SEQ ID NO: 495147 - DNA, 268 bp, Homo sapiens
tggtcccgcgccctaacttatctgctttgcaagggtaaatgaggctggaacaatatttttttggccacctgtagggtacgtcgtcaaaccaatcatagccccctggggacatgcagtggaagaactagatggtttgaaagtctctaagacccaaggcacctgatgtctgtttgctgtgcctccactatattgccgagtgggtgagtgtctgcacccacatcctcacacattgatctagatatgcctttatccactcgaattataaaca

SEQ ID NO: 495148 - DNA, 260 bp, Homo sapiens
aacctttttaacagttttaagataaaattggctgcagccttggcaagatgtcgaatcaagcatgatgccctttcaatttaccacatccttccagaaacagttaggaaacaggaactaagggcctccactttaccactttatgcttggataaatacttgtaaaatcagccctgaagaagtttataataatttgaagagaagaggctataataaagtcaaatctgtattgcatattgatgataaagtctttgctgtggatca

SEQ ID NO: 495149 - DNA, 1627 bp, Homo sapiens
  misc_feature (365)..(365): n is a, c, g, or t
  misc_feature (397)..(397): n is a, c, g, or t
  misc_feature (400)..(400): n is a, c, g, or t
  misc_feature (409)..(409): n is a, c, g, or t
  misc_feature (425)..(425): n is a, c, g, or t
  misc_feature (430)..(430): n is a, c, g, or t
  misc_feature (435)..(435): n is a, c, g, or t
  misc_feature (437)..(437): n is a, c, g, or t
  misc_feature (448)..(448): n is a, c, g, or t
  misc_feature (482)..(482): n is a, c, g, or t
  misc_feature (484)..(484): n is a, c, g, or t
  misc_feature (490)..(491): n is a, c, g, or t
  misc_feature (497)..(497): n is a, c, g, or t
  misc_feature (576)..(576): n is a, c, g, or t
  misc_feature (578)..(578): n is a, c, g, or t
  misc_feature (585)..(586): n is a, c, g, or t
cgccgtgtcggaggtaacagcaagatgattgcagtccgttgcgcgttgcttgcggccgtggtccgtgcccttcctcggtgggtcgggaatgggtctcgagaagatgcttggggtgcatctttcatggctgcaaggaagctgtccagtgaccatctatccacgcatcttcaacaggacgtgggactgcttgggatgtcgctctattcttgaagtagcgtattcttggagcgtgatacctcgtgatcgatcttgaagacaaggtgggcgtgtcttataacgatatggtgatggtattgcccgcgtacatgggctgaggaatgttcaagcagaagaaatggtagagttttcttcaggcttacagggtntgtccttgaacttggaacctgacaatgttggngtngtcgtgttnggcaatgataaactanttcanggaangnagatatagtgnacgaggacaggagccattgtggacgttccagttngntgaggnngctgtngggtcgtgtagttgatgcccttgtgtactgctattgactggacaagggtccaattggttccaacgacgcgtaggcgagntnggtctgnnaagcccccggtatcattcctcgacactcttcagactgcgaggacaccacactgcacgacctggggcaattacacggctagcatcgagactacgcctcggatcgcccacacattggcacagagggatcacggcgctgacacgcgaatcacacagggtagaccagacagacctggcgacaccaaacctcgacaccagctcactgacgaccaccacaccccaattacacccccaaggacacacgtcgcaaactggatgcgactcttgcactagacacaaagaaagacagctcgtaaccggcatcgcccggtacgcctacccgggcccacaaacgcaagacatccctacaagggagctcccaacactcgcggagaaaaacaagaacatgcacaacgacacagcaagccaagacgacagccaacgagtaccaacgcaagaaggagaggctgtcccgcgactcccgaaacctcaggcacatcattgcacaccgaacacaacaccaaaccactgaaacaacacgtacaacagccaagagaaaatgacaaccaccaagaaggaacaaaagtcactgtcagcaagaaacaacacagcacacaaacacacggcaccagaacccacccgaacagaacaaaaactacaaacaaacaaaaggcaagccagacgctaccaggaccccacaagatagcaagaaagaccccgaccgcaccaacccgtggaccagcgagaggcccaatacacgacaacaagcagaaacaaccaaaacacggcacggcgagaatgcaaagaacgaagaacacacagtaaacgcagaatataggaacgaaagaccgagacgagaatacaccagagaaaaaaaaaacaagagacgcaacaaagagaagggagcagtcacccacgggagcagcaacaaaggcagaagcaatcgcagacgcacgcagagccagagacaaagcaagacaagagaggatagacaacccggagaccgccaaaccaggaaagacgtagacaacaacagcgccacacagaagcccgaaccaagtaaga

SEQ ID NO: 495150 - DNA, 646 bp, Homo sapiens
gtctcacgcgcggagaccaagcgatagtggccccatgcatgcgtcgagctttggcttgtcgagatgggagtccagcacatccacggttctcctcctcccgtcgtgaaccactgttgacagctgatgtctggtgactaggatccgtagtaatgaggctctatcgtcatggactagttcggtcgcacatcgctccaaccgtggtgtcgcgagcgtcccgtcgagagcgaaccgggaatggagagcagcgagttgaaaaagccagaggcggagaggtgagggtgaccatatctcgtggactgtgagtaggaatgggcactctgggcgctgtcagcatggctaagaccatggtggtcgaggtgtctccaggtctgtgatctgtagagcctctcatgactccgctgactatttgaactcctatcgcgctgatgccctgcctgatcaagccatgtctgaacaggagggtcaagtcccagggggctcgggggctgccctccgtgacatgctggcagagcagtgtggagctgtggtggtcccagcagccgcggcgctcgtgcgctctgcgttcgtgcgtggccgtgggcctcgtgtgcaggctgtggcgcgggcggcgtggcactgctgtcaaccaccagcagccctcaggtga

SEQ ID NO: 495151 - DNA, 848 bp, Homo sapiens
ggagacgcacttgcactcttcaaggacctacagcttcaagatgttatgatgtgggtggtcagcggtctgagtcggaagtaagtggatccactgcttctgagggcgtcacaggccatcatcttctgcgtagcgcttgcatccgtcctatgacttgggtgctcagactgaggacgaggagatgaaccgctatgctagtgagagcgatgaagcttatccccgagtagtcgatcctgcaccatgctaatcctggttcgacaagtagcgacgatccgatcgagtccattcttccatctaatcaagcaagggacactgtgtatagagtgagacagatcactacactggtccccctgaccactctgcttcccttgagtacactgggtgccaactacatatgatgaggcatgctcgagctacgattccgggagtaggttttgaagtgaccatgcatactaacgcgcggaagacgaccgctggagatctacccgcacgtcacgtgcgccaccgagcaccacagcaactgtgcagtaacgtagtattggactgactcgctcaccgcactgtacatctagtctagaagaacgatctggagaggagtgccaggtctctctctgaaggggggccgctcggtgcacgggtgcgtgatgggcctgcgtggtacctttgtacctccgcgagaccccttgaggagcgtatgggtcgcccaggaatgactcgctcgtcccggacagttccgcgccgtccggctggttctccttgcttgaccgtctctttagtgcatcaggttcctcccgtgtacccactccgagtccaggacgtaacggatagggcgtttgcggacaggtccttcc

SEQ ID NO: 495152 - DNA, 173 bp, Homo sapiens
agctggcaacattctccaatgttatctagcatacagagtttaaatgccatgtgtagataaatccaattgagattgcatagtgcttgttatgcaacaggaactaaacatgaaatctactgcactgaggtcagggtatggtggtcccagagctcgaatctcgtaatacttggctc

SEQ ID NO: 495153 - DNA, 354 bp, Homo sapiens
  misc_feature (140)..(140): n is a, c, g, or t
  misc_feature (162)..(162): n is a, c, g, or t
atagtactcggagtaatagtgtttgtaagtgacgtatagctatctctaacagtagttaaatgtggagcaagatgaccagacaggattaaatttattgaattacagttacaagtggaaaaaatgactgacttactgcatgnagaagtattcatgtcacctgtnacaagctatggaactcaaatgtccatgtatataccaaattataaatgaccatgtaagggtaaaattaccggggatccatttacaaccaagaaattaaccaggtagttttccaggctgtttgattaatccagcagggtttactcttggaatccatagcatttctacaatttaattttggaccaagttctattc

SEQ ID NO: 495154 - DNA, 975 bp, Homo sapiens
tccgggttccattcgcatcgtgtccttagtgccggctcattaaaatcacaaatgaacatatagtggtgatgtcgatcagaggagcagaaattgttatcagtgaaagtgttgcccagtgggcaggtcggtaagaaattgtgagatgagggtagcaatatatcaatgggaccgtgatcgtcggagtgttgtcattatgtgatcgaaagataggttagattccttctttgtcataaagtatagcagccgatgatataactatgagcgatcaaatgtgggagttgaaggtacggattggtggctgtaataggggttgaatcgtcaaagaggttgataacttggaaagattatgatcgaaggggaggcattggtgagtaaaggaagcatggggccagaattatgggtagcatgtcatctcagacacaaacgtttacattgatgtatgatatactaattgagtgctatgctcgaaatatataaccaagaacatgggatgattcatgacttgtaaatgtgtacttcctttaattatatctctttgaagagattattcagatctgacatgctgggtggaattttgttggagtggtactgctttgtaactaagactggttgtggttaatgaaaatgttcagctggaatacactagaaaactcccaatcaagctaaactggtgtccccggtgacccctttttaagatatgacttgacttcggtggtaaggtgcaactttgtccccaagcatggtgggtggcctccctacaacttacgggctgcgcacagtgcgacttgcataccgtgccagggcctcttcacacggggggacgggccgaggtctcacccgaaaaaccccgggcgcggtggaggtcgccaggaggggggaacaaaggccgtgtcggggcccacaacccgaagcctaagacggggctaaaacacacatgcgccggactacaacatcacaattgcgatgaaaacaaag

SEQ ID NO: 495155 - DNA, 1338 bp, Homo sapiens
cggacgcgtgggctctacaaaccagcaaagacattggaacactatacctattattacggacgcatgagctggagtcctaggcacagctctaagcctccttagttcgagccgaggctgggccaggccaggcgaaccttctaggtaacgatcgcacatctacaagcgtatatcgtgcaacagccgcagtgcatttgtaagtgaatcttctgtcatagttaataccacagtcataagtcggaggctttggcaatctgactagttcccctaataatcggtgcccccgatatggcgtatccgcgcgcataaagacaacataagcttctgactcttagctccctctctcctactcctgtctcgcgatctgactatagtggatggccggagcaggaacaggttgaacagatctaccctcgccttagcagggaactacgtacccacgcctggagcctccgatagagctaaccatacttctccttacacctagcacggtgtctccctctatcttaggaggccagtcaattgttcatcacaacaatgtatcaagtatagagacgcccctgccattagcacaataccagagcgcccctcttcagactgatccgtcctaagtcacagacagtccgtacattctcctattctctcccagtcctaagctggctgggcgttcacttataggtaactaagcagaccagcaaacttatacacaactttcttcagaaccccgccgggaggaggatgacggccattcatatgcaagagctattctgcaatgaccgagtacaccactgaaagcttaaatatgcttcatgcctaacaaggctcgggaagtaatcacccatattggtcacctagaatacacggaacaaaagcaccaattgggtaccataggaatgcaccagcaacacaatgaaagacatacaaagcacaacagtgaaggccacacactattacggcaggactgaacgcaaaacagcgcgtttgtaccaccgcacacaaatacgagaaaccacgagggcaccagcaataacgaacgcacacaacgcgaacacacgacgcgcgcggtcgacccccgacacccctcgaggaaggagacattaccacgaagccccagaaccgagcgcaaacaaggagaatgagctcacaacgcacgaaacagatgaatggaccatagtctgcgacacaacaaacgaaggacgccaccaagaaagacaccgacaagaaaacacactcaccaaacacccgaccaacagcgcacaaggaagcaacagacaaaaacggcaaaccatacccgccacaagcgaacagcccataaaacaaagaaaacaagaggaacctaca

SEQ ID NO: 495156 - DNA, 1024 bp, Homo sapiens
  misc_feature (3)..(3): n is a, c, g, or t
  misc_feature (732)..(732): n is a, c, g, or t
  misc_feature (832)..(832): n is a, c, g, or t
  misc_feature (847)..(847): n is a, c, g, or t
  misc_feature (851)..(851): n is a, c, g, or t
gcncccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttcccccacccaggctcttaacttcgccttcaaaagataaatacaagcagatcttcctgggtggtgtggaccaagagaaccccagtttgtggcgctactttgtgcagggaaatctggcatcgggtggtgccgcagggggccacatcccctgtgtttggtgtaccctcttgattttgcccgtacccgtctagcagcttgatgtgggtaaagctggagctgaaagggaattccgaggcctcggtgactgcctggttaagatctacaaatctgatgggattaagggcctgtaccaagggctttaacgtgtctgtgcagggtataatcatctaccgagccgcctacttcggtatctatgaccactgcaaaggggaatgcttccggatcccaagaacactcacatcggtcatcagctggnatgatcgcacagactgtcacttgctgttgccgggttgacttcctatccatttgacacggttcggcggcgcatgatgatgccagtcaggcgcaaggactgnctccttaccaggccntttnatggctgcccggcaaggattgctccgtgatgaaaggcggcaaggctctttacaacgggtgcattggaccaatggttctcacaagcatgggcttggtccatatggccctggcctggctccacgcaacttcaggacctacactcagtaaatcctaaggctttccccccgtgcacg

SEQ ID NO: 495157 - DNA, 359 bp, Homo sapiens
atgtgtttcaacatgtactccgcggtcagaccccagatgtcagagctcgacggcagacaaggacaccatacctcagaatagttatatataaaagggacacggattgtgacacggttaccccatttgtgtttaaccccgctggccaggattagggtctgtggtgtgttctgtgttggttatggattctcccttgtgtgaggtctcttctggcccaactgggtggctgtggaagtctgtgaagtggcccaaccacaagcatacctattaagaggcccagagctttcaggccccacttcgctcttctctgtgcccacatatgcctccttattcgcgatatttcccacccccagagttttttt

SEQ ID NO: 495158 - DNA, 1081 bp, Homo sapiens
  misc_feature (3)..(3): n is a, c, g, or t
  misc_feature (789)..(789): n is a, c, g, or t
  misc_feature (889)..(889): n is a, c, g, or t
  misc_feature (904)..(904): n is a, c, g, or t
  misc_feature (908)..(908): n is a, c, g, or t
gcncccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaaagcttgcttgcttgagggttgacgttattgccacaggcaaggaatgatcactgcgagaataaaggcaattcaccaaacggctatttataagaaccgtgggggtggcccggttattccccaaaggggacgcaggggaagttctggcccatttcaggggggcgggaaaaccgtgggccaattggttcatcaagattattttccccaaccaaaggtttctataaatttcggctttcaaaagataaatacaagcagatcttcctgggtggtgtggaccaagagaaccccagtttgtggcgctactttgtgcagggaaatctggcatcgggtggtgccgcagggggccacatcccctgtgtttggtgtaccctcttgattttgcccgtacccgtctagcagcttgatgtgggtaaagctggagctgaaagggaattccgaggcctcggtgactgcctggttaagatctacaaatctgatgggattaagggcctgtaccaagggctttaacgtgtctgtgcagggtataatcatctaccgagccgcctacttcggtatctatgaccactgcaaaggggaatgcttccggatcccaagaacactcacatcggtcatcagctggnatgatcgcacagactgtcacttgctgttgccgggttgacttcctatccatttgacacggttcggcggcgcatgatgatgccagtcaggcgcaaggactgnctccttaccaggccntttnatggctgcccggcaaggattgctccgtgatgaaaggcggcaaggctctttacaacgggtgcattggaccaatggttctcacaagcatgggcttggtccatatggccctggcctggctccacgcaacttcaggacctacactcagtaaatcctaaggctttccccccgtgcacg

SEQ ID NO: 495159 - DNA, 170 bp, Homo sapiens
cgtgatcctcctgttcaacaaccggagggtgaaccctcgtcccctcgaacagcttgtttaaagagcacctgtgggtcaggcacagtggtgcataccctgtattcccagcaccttgtggaggccaaggctgggcatgattgcctagaagtcagtgagttcagagaaccagc

SEQ ID NO: 495160 - DNA, 130 bp, Homo sapiens
agattgacgagtctcaccgattggagtcctaattttaccacttacttttatttctttatttttttacttttatgctttgataaagagtctcaactctgtcgcccaggctgaagtgcagtgacgtgatctc

SEQ ID NO: 495161 - DNA, 1009 bp, Homo sapiens
ttacagatcgtctcctgttcaaatcctagtcataaatatttataatgcacacggtcattttgggatttgtttgtgagactcattgctgtcaccccgggggagtgcagggcttgatcttggctccctgcaacttctgcctcctgggtgcaggcgattcgattaacaatggagacgagtcgtgcagaggaaagaagtaacttagaatctaatctttagttaacctgggatatcacagaaagatactggggcctgccacttgtatttctttgtcctcaatactgaacactagacacatttgaaaccttcctcagaaggaaacaaaggcaactggttatgcctgggtggtggcatggaagatgcccattgttgcccaagttggcttaataagtattttgaaattagaaatgaaacatgaggtccaaggcctgtcgcagtgtccgctaccgcaacccattcctcctcccggggaaaacgagaaacccgtatcatcttccaaatttcggattcatcactgcacttaagaaatgaaccgttgggaattttaaaatgtgaataactcaagtatctggcttttgagatgcccggctgagcactaagttcaggcatagctgaatgccggggaagaaaccagagggggtatgctggctcctgatctttgacaggtggacagcacagctattcgaaatacactaagtgtgaggagaaacagcgtctgaggaaccagaagactatggagggccaggggaagcgtgaaaatcgcaaccaaatactgggtgagggcgaggtacgaagggcaaccgttgacacacaagctggcagggcatagaggacccggagaagcagaacccgacagaggaaaggccccagaatgtacaggacaaaagatcgaggggagggagggaaaggtgcacaaaagagcacagaagcagacgacaatagagaaacaaagagaagaaaggatagagcagagaccacagcagagcacactagccaacacagcacctctcat

SEQ ID NO: 495162 - DNA, 316 bp, Homo sapiens
ctgatagaccacaaatcgatatgtgatcatcacgagacaaccagagtgacatgcacatgtaacgccgacacgccggaggagatgcaccacatgagataaccctgctgaagagagtccaaaggggacaccagcgtgagagggccaggaattcatcgtgagaggctggttgcacacagaggtgaagaacagtccaaagatgtcttcactgacactgaagaaacggtggtttgtactcacccacaattccctggattactacaagagttcagagaagaacgcgctcaaactggggaccctggtcctcaacagcctctgc

SEQ ID NO: 495163 - DNA, 401 bp, Homo sapiens
  misc_feature (7)..(7): n is a, c, g, or t
  misc_feature (125)..(125): n is a, c, g, or t
  misc_feature (229)..(229): n is a, c, g, or t
  misc_feature (343)..(343): n is a, c, g, or t
  misc_feature (375)..(375): n is a, c, g, or t
  misc_feature (393)..(393): n is a, c, g, or t
gaatttntctttctgcatcgttctgtcataaaaaggggtactactatagaatagaatgcaggcttaggacccccgtaagctcactgttcaacccagcccagcaaactggtcagttataaattttnctgcaggtccctgaaacaacaacaaaaaactggatgaggtttccctcccatcttgttttatgtccttgggagcttgaccttataaccatacggcggtacttttncttggtctctgccatccagggaaccagaatttggggggttatgtcatagttagctctaaaaattatcttgagcagttaaaagcctttgcaagcttaaaattgactgctgtaggntccttctggggaaggagcaatgggaaaccttnccaaagcttatagctcanccagctga

SEQ ID NO: 495164 - DNA, 109 bp, Homo sapiens
tgatgtcattccccttggtgaagagggggatgtaaaggagacgagaagaacctatgtgaggtttaatttattaatggcaacaggaactaaaaaaaaccaacaggtccta

SEQ ID NO: 495165 - DNA, 203 bp, Homo sapiens
tgacggtgttctggttgcgcaggatatagaagtcgggctggggaagggagtggtaagggaggaacaggcctccaggtgtcattcgagtgagtgtgccccacagcaccagtttcagcaacatatggtcccggcaccgcaaggaacaagtgaaggctcttgctcctcagggagctccgcaaatgtttcatttattacacatggaa

SEQ ID NO: 495166 - DNA, 132 bp, Homo sapiens
  misc_feature (13)..(13): n is a, c, g, or t
  misc_feature (58)..(58): n is a, c, g, or t
  misc_feature (132)..(132): n is a, c, g, or t
atggcacatgcancgcaagttaggtctacaagacgcgacttcccctatcatagaagancttatcacctttcatgatcacgcccacataatcatttttccttatctgcttcctagtcctgtgcccatttcctn

SEQ ID NO: 495167 - DNA, 197 bp, Homo sapiens
agctcggaccccaatgctgtcaaatcgcaatggaattcctacatgcttacgaacgacaaattctaggctatatacaactacgcaaaggacccaacgtagtaggcccctacgggctactacaacccttcgctgacgcagtaaaggtctctcccaaatcctcctgtccatagctttgttggtgcctcctaaaaccagca

SEQ ID NO: 495168 - DNA, 159 bp, Homo sapiens
ctagaaagatattttagagaacttaaattggcattttacgaaaaatttgcatctcctaccagtctgtaagatgtacacaccagttttgtctgccgttgttactccaaatacaagtatgaccaacctgtctgaatatttatagctaattatttctagagc

SEQ ID NO: 495169 - DNA, 617 bp, Homo sapiens
  misc_feature (100)..(100): n is a, c, g, or t
  misc_feature (150)..(150): n is a, c, g, or t
  misc_feature (184)..(184): n is a, c, g, or t
  misc_feature (265)..(265): n is a, c, g, or t
  misc_feature (423)..(423): n is a, c, g, or t
ggagttgagagcagacctgactcttataacacacatgtcccttgccccagtcctatgacgcagcttcaggagtggatcctattgatgccgatgcttatgnttttgtgtttggctcgggagttaatgaggatgtagagagtccagagctgncaacatctcggccccttccaaagatactgttggntagtggtgctccaaaagtggaaaccccggcgctgaatattcagaacaagattcctggtcaggcaaagtcccctgaagaaantgataaagagaaagttcccctttttggctcagaaaggaaaatgggccccgccgaagaggatacaaatgggtattttgagaaaccctccgaccgtttgttttaacggacagaagtcctagcaactgtccttggtgggggaggtattggctttttccttngcaattttttttatcccgcgggtgggggatcgcatgaaaaaaaaggatgaaggaagctttgcccttggggaaccccaaccctcccgggctgcttttccgaaggccccctctaaggggttttttgggtaaaacccccccttagggtctctttttatgggatccctgaacttttccaaataaagcttttgcctaga

SEQ ID NO: 495170 - DNA, 170 bp, Homo sapiens
ctggatttaaatattgtaaaaaaaaaataagttataactgttataaagcagaacttttggtgcattttttaaactgttgaagtccctgggtaagtttgtttgggcaaagtttccgcaggatttattaaaacaaacttttttttttcttcaaataaaaaagtgcccctgga

SEQ ID NO: 495171 - DNA, 567 bp, Homo sapiens
  misc_feature (423)..(423): n is a, c, g, or t
aagggcttcctgtctcttgcctggtcctgttggtgaaaatgaagggctcttgttccaggcctgtcaccttggcaccctttaattaacagtgaactcacttcattctgtgattttaaaagctgatgcatttcacccaaatgaacgtaaccccacctatttgtcgttgaagtagagctttcctggaggaccacatcttctcgacaggtcgcaggtctggccttgcccggcgctggtgagccccagctggcttagaccgtgtagctcgtctgttaaagtctgaccagaagtggccgggcgcagtggctcatgcccgtaatcccagcaccttgggaggctgaggcgggtggatcacgaggtcaggagttcaagaccagcctggccaagatggtgagacccgaaccagacgatgccacatggctaatngaagtaggaggacacttaagcagcgtggtgggaggcaggagcctgtgaatctgccgctgactgctgtagggctgaggggaagaagattgcctgaacccaggaggtggacattcgcagtgaactgagatgacgccatgaactcca

SEQ ID NO: 495172 - DNA, 282 bp, Homo sapiens
tgatattcgtacatcgaatgacaatatgctcaaagaaaaatacgatatcatatcaagttgtccgtatttattttctgaagactttactgtaaatccttctcatatagcatgcggactgacagagaagcctaaatcaaatgagagcaaagtcatatgagaaaacactcatgcaatacacgtgtggagtgtccagcagctgctcactgctctgcccaatgctttagggatacagaaaacataggctctggccctaagaaacttcagatgccacattcttctagg

SEQ ID NO: 495173 - DNA, 143 bp, Homo sapiens
  misc_feature (134)..(134): n is a, c, g, or t
cttccccacaggcagctgtatgggttgacgcaggtacgagtggcatcacaacaaacccagtaagtccagccggcacagcggctccttgtgttctgttgtcttccctgctgctgccacatcctttaccctcctgntgcctctgg

SEQ ID NO: 495174 - DNA, 217 bp, Homo sapiens
tagcaatatggtaggtgatacgaagagtgaaagtgtacgtgacttaatgtactgattatatctttgtatagcactgtgatattattcagaaagcagagccactatgcaatcgcagttgaataagagctttgttccctgctatatggtaatgttaaagaaacaaatggcaatggtttaaatgacgttataacaatctcccacctagcaaaagaatcta

SEQ ID NO: 495175 - DNA, 110 bp, Homo sapiens
ctctcatccctcccattctccatttcccttccgttccctccctgtcaggcgtaattgagtcaaaggcaggatcaggttcccggcttccagtgcaaaattccgccaggaga

SEQ ID NO: 495176 - DNA, 465 bp, Homo sapiens
aagaagtagctactgataagagagcctgcgcccttggcttataattacatacatacagattgagccaatattttgcggggagtactgaggagtacactacttcttggaacctagagtactaactgatgcagtgctatagatgtgaagcaaggtgagcagtatatgatagagtctagatttcagcccagagtgggtactacgatgccccatctcatcatgtggggcaccttgtgcgagaccttgaggatagacgatgtccacgactacacacataatcagtgagagtggcctgggctcaaacaaagcttctgttaggatgtacagatcagtgctatgatataagcctgcataattgctcatgatatcacacacggaggtaaacatttaggtgagtttgacaattgccgcatgctgcatggtattcgcttgctaccctcaagcggatgcaagtgctgacatcgatac

SEQ ID NO: 495177 - DNA, 246 bp, Homo sapiens
  misc_feature (14)..(14): n is a, c, g, or t
  misc_feature (18)..(18): n is a, c, g, or t
  misc_feature (25)..(25): n is a, c, g, or t
accggggccgaatnctanttacgcntgtacctcactacttttaactctggcaaagccacaaacacattaaaggagccatttagagctcggcagtcgggtcagacccggaccttcctgggaaaagggtgtagaaggtctgtagacatagcggacgctgagaagtaaaaggcacgggacttaatcacaccaccgtgctctttgggctcaacttaatccaaaaagagaacggaagctccgtccttcctc

SEQ ID NO: 495178 - DNA, 3777 bp, Homo sapiens
tctcctgcgtagccatggcggtcccattccccaaccctctttccagtggtgacccaagcctccggggttcagggtgaccacaatgtctcccccactctgcatcccaggcccatatggcctggctctagagctccccactccatccagagtccctgtttccccaaagagaagggcccaccccggctcccgctcactcctcctcctgcctctgcatcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctcttcagctgctgcaggtggaattcttgcgtctgagcactcacgaggaccctcagctgctggaggccaccctggcccagctgcctcagagcctgtcctgcctccgctccctggtcctcaaagggtcgatctgggacctcggaccctggctctgagggccacatccgcctccccccttcccaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcgaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaataaaaaaaaaaaaaaaaaaaaaaaaaaagagagagggggcgcgcgcgcctctcacaagatgtattctccccccgggggggcgccccagttttacgcgcgctctccccccccatcgtttttttttgtgtccagagggggcgccccctagagagagggggcgctcggtttatatataaacgccgagagcgcgcgcgggcgcgcgcgctgtttaaaacaccgcgcctctggcggcggcgggaacaccagcgcggcccgactagcgcggggggcacctcttggggcggaaggagcacccccctactgcgcggggggggcggcgcggcgccatatatgtgtggggcacacacacctatcccctacgacggagagattattaagcaccggctccaagggggagaaactattctaaacactctttcaagcgccgtcgctacacgaggggggtacaccacaacacgcgcgcgcgaattatgtagcttcgcgcctggtcagaagacaacgttgttggcgtaccaacagaggagtactttagtcttcctgacgacactttttttttaccccggggcagccttatgctactaatcg

SEQ ID NO: 495179 - DNA, 272 bp, Homo sapiens
  misc_feature (162)..(162): n is a, c, g, or t
aagcggatggtgtgcttgtcactgtccagctcagagacgtagcacatcccggacagcccccgaggtgtgtgcaccgggcatcaatcacgccccgggcaccgttcagctgcacggcataaggacgctggctggttcaccttgagccccgtctcctcgaggctngtgacagtgagacggcgagcgtcataccgagagggagagccacaacaccacataggggtctgtccggtatgtgctcatcattgaacttgatagagacctcatagtcacct

SEQ ID NO: 495180 - DNA, 110 bp, Homo sapiens
gtggagaccaggccagccaggagatggaccttccagaggtggcagctgttggtggtgcctcttgagaggagcaggagttcaacgtgccattttcagcacgaggggcttgc

SEQ ID NO: 495181 - DNA, 3604 bp, Homo sapiens
ggccggcgggattccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctcttcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcgaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaataaaaaaaaaaaaaaaaaaaaaaaaaaagagagagggggcgcgcgcgcctctcacaagatgtattctccccccgggggggcgccccagttttacgcgcgctctccccccccatcgtttttttttgtgtccagagggggcgccccctagagagagggggcgctcggtttatatataaacgccgagagcgcgcgcgggcgcgcgcgctgtttaaaacaccgcgcctctggcggcggcgggaacaccagcgcggcccgactagcgcggggggcacctcttggggcggaaggagcacccccctactgcgcggggggggcggcgcggcgccatatatgtgtggggcacacacacctatcccctacgacggagagattattaagcaccggctccaagggggagaaactattctaaacactctttcaagcgccgtcgctacacgaggggggtacaccacaacacgcgcgcgcgaattatgtagcttcgcgcctggtcagaagacaacgttgttggcgtaccaacagaggagtactttagtcttcctgacgacactttttttttaccccggggcagccttatgctactaatcg

SEQ ID NO: 495182 - DNA, 783 bp, Homo sapiens
cttcccaagttcaatgaataactcgtgtgagcaaatcttagccagtatggtaatatagtaaagaagaactacaaagcagtgaactccttgctaccccgcacagactacaaagacctgtcagctgtctttctacgaaggcacgcacttctatcaggcttctaacacactaccgacaccaactactgttaacctgagctacaccccaacttcagcacactttaactacgggtaacaccttctaaacacggatctgccccgtgaactcacttacacggcgtccaagacttactaacggggaacacagccccaagcatcacaatctactaactttcgagccaaaaccatccactttaacacggactatataactaatgcgtgctacttctactggctaacctataacacagtttacagcttggagaaggtataacccacattagcacgacacaaacccattccgttgagctctcacccaccttactttagttacgttaagaatgttcacacggaccatcacgcttaaccacgttggttacacgtgaatactaaggaggtgtcgtcaagcttagacaaagagaagacaaattgggactacaccaatattacacatcaacgtcaaaaaaaaaagaatctcctacacaaattaacccaaacattaaatatcatcatagggctatctaaaaccatgcataaacttaaagtagcattcctaagaaccacacaatatggaacatcacccctagggcgccttaaacatcccacataagaaaccgcacatttccg

SEQ ID NO: 495183 - DNA, 687 bp, Homo sapiens
ggctgcaggaatccggaccgggttttgacagataacatttgccatgctatcaatcaggattcttatgtaataaactatatccgatggcctaccacaatccgggtgctgagctgcatcgcatgacgcgctcttcatcgacagtcatatagcagatcgtatctaagcctatatgatcgctaagtatggctggattgtaaccagccaagagatgctcagctgaatccgagagagcatcatcagcgtcacatgcgacgactctaggcttgcctaggaattgaatgtcagcagacgaaagctaacgttccgaatggtcgcgctgatcgatactagctggaacccaccagtggtgtactaggatgattagtcttctccatacactcgttaccatgagccgtgaggatccctaacgctttgaatgcagacctctcgagatactctatggtagactacgctggatgcgatatccagaaatgcctgctcatgaatcattcagcattttagactgaggcttcatcagatacattgacaacgttgaataggctcattttgttccatctgcactatagaccaggccagtaccataggtgccgtataccatattgtagtgactacaaggtgactcttgactctggtaattgaatgcagatgctctgagtatgaaggactcttttactacgagatgcctgg

SEQ ID NO: 495184 - DNA, 3553 bp, Homo sapiens
ggccggcgggattccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctcttcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcgaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaataaaaaaaaaaaaaaaaaaaaaaaaaaagagagagggggcgcgcgcgcctctcacaagatgtattctccccccgggggggcgccccagttttacgcgcgctctccccccccatcgtttttttttgtgtccagagggggcgccccctagagagagggggcgctcggtttatatataaacgccgagagcgcgcgcgggcgcgcgcgctgtttaaaacaccgcgcctctggcggcggcgggaacaccagcgcggcccgactagcgcggggggcacctcttggggcggaaggagcacccccctactgcgcggggggggcggcgcggcgccatatatgtgtggggcacacacacctatcccctacgacggagagattattaagcaccggctccaagggggagaaactattctaaacactctttcaagcgccgtcgctacacgaggggggtacaccacaacacgcgcgcgcgaattatgtagcttcgcgcctggtcagaagacaacgttgttggcgtaccaacagaggagtactttagtcttcctgacgacactttttttttaccccggggcagccttatgctactaatcg

SEQ ID NO: 495185 - DNA, 3888 bp, Homo sapiens
  misc_feature (952)..(952): n is a, c, g, or t
ggccggcgggattccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctcttcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggggtgagtagcccctgcgccccgacacactggccccacgggagggtccctgaagcctgcctgtcttctgcaggggcctctgcacccacaggcttggtccanagctgcctcttgggttgtccctccacctccctggcctttgagactccctcagtggcttcgtcagagttctctgagcccagctgtggaggagagtctgaaacagctgctctgggaggcggcagcaggagtgtcccagcgccgtgggctgggctggtgccaagcctaagccagcacctgcccgcagcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcgaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaataaaaaaaaaaaaaaaaaaaaaaaaaaagagagagggggcgcgcgcgcctctcacaagatgtattctccccccgggggggcgccccagttttacgcgcgctctccccccccatcgtttttttttgtgtccagagggggcgccccctagagagagggggcgctcggtttatatataaacgccgagagcgcgcgcgggcgcgcgcgctgtttaaaacaccgcgcctctggcggcggcgggaacaccagcgcggcccgactagcgcggggggcacctcttggggcggaaggagcacccccctactgcgcggggggggcggcgcggcgccatatatgtgtggggcacacacacctatcccctacgacggagagattattaagcaccggctccaagggggagaaactattctaaacactctttcaagcgccgtcgctacacgaggggggtacaccacaacacgcgcgcgcgaattatgtagcttcgcgcctggtcagaagacaacgttgttggcgtaccaacagaggagtactttagtcttcctgacgacactttttttttaccccggggcagccttatgctactaatcg

SEQ ID NO: 495186 - DNA, 851 bp, Homo sapiens
ttcccatttaggagaataacacagaaaacaaaagaaagaaatcaggatggtcaaatacttaatgttaaaaatgtgattgaaacaatatatatcacaagagataagatgacggatacaaaagtaagcgtgattgataaattctatgataggctaacacttcctggcaataagcaaaatatttcgtataggtagattataagcatagaagccacagaatcagtgctatgtatagacggagttctgaaaacttcaaactgtgaaagttggaagtaaggttcaattcaggctaggaaagcattagatcaatctctctttgtctgacacacacacagcatgacgccccattataggtgatcaaaggttcagtctgcactgaagtttaggatctaattgtaagtatctttatatttaccaaaatccctgtgttaactggaagcacagactgtaaacacatttagtggtatgcagactgttcaattaaatcagatcttaggccaccgacagatcaagtgcacaaggaaatacagtgtgataaaactggagaagccctaaataatcataattaacaaagctagaacacatatgcaagagcgttatagagaatataccttcttgttagatgtcccagggaacatcagacgatgttacagaatctagagcatattagcagagtcccacaatcaccggacgtaaaattaacttgcgatcgcacccaggaaggagcaacttgttgcacaccttgaaacggcaaatttccccggaactaaagcttggggggggggcacgggaaccaccggggggaatcggggtttcaacgggggagcaaggggccaaacggtcaagggagctca

SEQ ID NO: 495187 - DNA, 3948 bp, Homo sapiens
  misc_feature (1012)..(1012): n is a, c, g, or t
ggccggcgggattccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctcttcagctgctgcaggtggaattcttgcgtctgagcactcacgaggaccctcagctgctggaggccaccctggcccagctgcctcagagcctgtcctgcctccgctccctggtcctcaaagggtcgatctgggacctcggaccctggctctgagggccacatccgcctccccccttcccaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggggtgagtagcccctgcgccccgacacactggccccacgggagggtccctgaagcctgcctgtcttctgcaggggcctctgcacccacaggcttggtccanagctgcctcttgggttgtccctccacctccctggcctttgagactccctcagtggcttcgtcagagttctctgagcccagctgtggaggagagtctgaaacagctgctctgggaggcggcagcaggagtgtcccagcgccgtgggctgggctggtgccaagcctaagccagcacctgcccgcagcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcgaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaataaaaaaaaaaaaaaaaaaaaaaaaaaagagagagggggcgcgcgcgcctctcacaagatgtattctccccccgggggggcgccccagttttacgcgcgctctccccccccatcgtttttttttgtgtccagagggggcgccccctagagagagggggcgctcggtttatatataaacgccgagagcgcgcgcgggcgcgcgcgctgtttaaaacaccgcgcctctggcggcggcgggaacaccagcgcggcccgactagcgcggggggcacctcttggggcggaaggagcacccccctactgcgcggggggggcggcgcggcgccatatatgtgtggggcacacacacctatcccctacgacggagagattattaagcaccggctccaagggggagaaactattctaaacactctttcaagcgccgtcgctacacgaggggggtacaccacaacacgcgcgcgcgaattatgtagcttcgcgcctggtcagaagacaacgttgttggcgtaccaacagaggagtactttagtcttcctgacgacactttttttttaccccggggcagccttatgctactaatcg

SEQ ID NO: 495188 - DNA, 909 bp, Homo sapiens
tgcccctccatttagataaatattatactagcattaaccatctacacttctaggaatactagtatatcgctcacaccctcatatcctccctactatgcctagaaggaatagtactatcgctgtgcacttatagctactctcataaccctcaagacccactccctcttagccacatatatgtgcctatatgccatacatagtctttgccgcatgcgaagcagcggtgggactagccctagtagtctcaatctccaacaaaatatggctagactacgtaacgataacctaaacctactccaatgctaaaactaatcgtcccaaaattttattattactagcagctgacatgcattttccagtaaaacacataattgtgaatcaaagcaagcacgccacagcctaattgattagagtcatcgcctctacgtatttttgacccaaatcaacgacacaacctaattgacggctgtgccccaagctttggctcggcaacgcttaataacacccttctaaatataactaacctggtccctaccctcacaaatcagtggggaaggcaaatggcacttatcgaggaacagttatcagaaaagaactgctacgcttcattgactaagcctcctacagaatgtcttcttatagtgtatcacaattccgcaggccaagaagtcagtactcaattagtatcttccttgagcacaagttattcccacctgggttaaaaccgagaggccacagccgaagcaggaagcggcatctacattgtaccctaaaggtcctcccgctaatgcaaataagaaaccagtcatagatcagacatacgcgaataactgcacaatatcgagacagtaacgaccacgcaatgcctgcggaccgtcatgcaacacggttataaacgagccgttgtac

SEQ ID NO: 495189 - DNA, 3868 bp, Homo sapiens
  misc_feature (952)..(952): n is a, c, g, or t
ggccggcgggattccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctcttcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggggtgagtagcccctgcgccccgacacactggccccacgggagggtccctgaagcctgcctgtcttctgcaggggcctctgcacccacaggcttggtccanagctgcctcttgggttgtccctccacctccctggcctttgagactccctcagtggcttcgtcagagttctctgagcccagctgtggaggagagtctgaaacagctgctctgggaggcggcagcaggagtgtcccagcgccgtgggctgggctggtgccaagcctaagccagcacctgcccgcagcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaataaaaaaaaaaaaaaaaaaaaaaaaaaagagagagggggcgcgcgcgcctctcacaagatgtattctccccccgggggggcgccccagttttacgcgcgctctccccccccatcgtttttttttgtgtccagagggggcgccccctagagagagggggcgctcggtttatatataaacgccgagagcgcgcgcgggcgcgcgcgctgtttaaaacaccgcgcctctggcggcggcgggaacaccagcgcggcccgactagcgcggggggcacctcttggggcggaaggagcacccccctactgcgcggggggggcggcgcggcgccatatatgtgtggggcacacacacctatcccctacgacggagagattattaagcaccggctccaagggggagaaactattctaaacactctttcaagcgccgtcgctacacgaggggggtacaccacaacacgcgcgcgcgaattatgtagcttcgcgcctggtcagaagacaacgttgttggcgtaccaacagaggagtactttagtcttcctgacgacactttttttttaccccggggcagccttatgctactaatcg

SEQ ID NO: 495190 - DNA, 3717 bp, Homo sapiens
  misc_feature (952)..(952): n is a, c, g, or t
ggccggcgggattccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctcttcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggggtgagtagcccctgcgccccgacacactggccccacgggagggtccctgaagcctgcctgtcttctgcaggggcctctgcacccacaggcttggtccanagctgcctcttgggttgtccctccacctccctggcctttgagactccctcagtggcttcgtcagagttctctgagcccagctgtggaggagagtctgaaacagctgctctgggaggcggcagcaggagtgtcccagcgccgtgggctgggctggtgccaagcctaagccagcacctgcccgcagcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcgaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaataaaaaaaaaaaaaaaaaaaaaaaaaaagagagagggggcgcgcgcgcctctcacaagatgtattctccccccgggggggcgccccagttttacgcgcgctctccccccccatcgtttttttttgtgtccagagggggcgccccctagagagagggggcgctcggtttatatataaacgccgagagcgcgcgcgggcgcgcgcgctgtttaaaacaccgcgcctctggcggcggcgggaacaccagcgcggcccgactagcgcggggggcacctcttggggcggaaggagcacccccctactgcgcggggggggcggcgcggcgccatatatgtgtggggcacacacacctatcccctacgacggagagattattaagcaccggctccaagggggagaaactattctaaacactctttcaagcgccgtcgctacacgaggggggtacaccacaacacgcgcgcgcgaattatgtagcttcgcgcctggtcagaagacaacgttgttggcgtaccaacagaggagtactttagtcttcctgacgacactttttttttaccccggggcagccttatgctactaatcg

SEQ ID NO: 495191 - DNA, 238 bp, Homo sapiens
ataaggatagcagtgctcgcagtgctgaataggggagcacaacgtgcattgtgcttctttcttagggaatattagaatctatatctcaatgctcataacggatcagaaatacagattatgatagcaaagcgacgttagtcgtgagctcttgtgaggaacgtcattggctttatcctctaggggagttagcactgtagagggtgaggtataaacagatggggtctagtaaaatctattc

SEQ ID NO: 495192 - DNA, 3833 bp, Homo sapiens
  misc_feature (952)..(952): n is a, c, g, or t
ggccggcgggattccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctcttcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggggtgagtagcccctgcgccccgacacactggccccacgggagggtccctgaagcctgcctgtcttctgcaggggcctctgcacccacaggcttggtccanagctgcctcttgggttgtccctccacctccctggcctttgagactccctcagtggcttcgtcagagttctctgagcccagctgtggaggagagtctgaaacagctgctctgggaggcggcagcaggagtgtcccagcgccgtgggctgggctggtgccaagcctaagccagcacctgcccgcagcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcgaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccggtgggactgagggacagcagaggggcggggcaggaccgaggcccaggggtgaccagggtgacatggtggagttgggggtggagcccagggcttaatgcactttttccttccaacagagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaataaaaaaaaaaaaaaaaaaaaaaaaaaagagagagggggcgcgcgcgcctctcacaagatgtattctccccccgggggggcgccccagttttacgcgcgctctccccccccatcgtttttttttgtgtccagagggggcgccccctagagagagggggcgctcggtttatatataaacgccgagagcgcgcgcgggcgcgcgcgctgtttaaaacaccgcgcctctggcggcggcgggaacaccagcgcggcccgactagcgcggggggcacctcttggggcggaaggagcacccccctactgcgcggggggggcggcgcggcgccatatatgtgtggggcacacacacctatcccctacgacggagagattattaagcaccggctccaagggggagaaactattctaaacactctttcaagcgccgtcgctacacgaggggggtacaccacaacacgcgcgcgcgaattatgtagcttcgcgcctggtcagaagacaacgttgttggcgtaccaacagaggagtactttagtcttcctgacgacactttttttttaccccggggcagccttatgctactaatcg

SEQ ID NO: 495193 - DNA, 243 bp, Homo sapiens
tgatatttaactttctggtgaaaacagataggataggcatcgtaaatgtttctatgacagcattcctgataaaattcactattttcattcatttaccccaaaatatttattataaaccttctatagctgtatactttgccatagtagttgagaatttaaagtcaattcccaactactatggcattttgtccatttactgtacactacttaattttatgttattttccagaaggagtctcgctc

SEQ ID NO: 495194 - DNA, 139 bp, Homo sapiens
ttattgacattcaagcaggtagagtagtagttggcctgttacataagttagtgagtagaaaatctgggaattagttattgttagttttggtgcttgacctagagaaaatctctcaggtggggacgaagtagaagagact

SEQ ID NO: 495195 - DNA, 1885 bp, Homo sapiens
  misc_feature (952)..(952): n is a, c, g, or t
  misc_feature (1722)..(1722): n is a, c, g, or t
  misc_feature (1731)..(1731): n is a, c, g, or t
ggccggcgggattccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctcttcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggggtgagtagcccctgcgccccgacacactggccccacgggagggtccctgaagcctgcctgtcttctgcaggggcctctgcacccacaggcttggtccanagctgcctcttgggttgtccctccacctccctggcctttgagactccctcagtggcttcgtcagagttctctgagcccagctgtggaggagagtctgaaacagctgctctgggaggcggcagcaggagtgtcccagcgccgtgggctgggctggtgccaagcctaagccagcacctgcccgcagcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcgaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggagggaagagnacccaaggntctggtcatggcagtgccattttctggtctgggttccgcgggcaagctggcgggcccgggggacgcggccccgggtcgggaacattcccgggcagaagacacgagtacacgggccgggacaaaggcggaaaaggggccgggtgtagccccagag

SEQ ID NO: 495196 - DNA, 1048 bp, Homo sapiens
gggcatgatacggggtgacgctatgtgtgtgggttggtgtcgtttccgtgctgatgaacaccgcaggtgactcgaggctctgtgtgtccccgcgtcgtagagaattggagaagcgatggatcgtgtcacgcgaaacagtgcgtaggaatcagggtcgttttgtgcatgccggtccggtagagggagcaggacacttgcgacagtagtgctggggaagcggaaagaggcaggatggtgagaatggacccatggagccggaagcagcgttagggtggcgagtccaatgctaggtggccgcaacagtcttagagctcggttggagatcttgtgaccaccatggctgtgcaggatatgccgttgaccgtgaccaatgtctcggagagacccgaagagtggaattctgttgtgccttggtgttatgcgggatgaggtgtccctggcggtggctctcgaatgcgcccctttgagaggaagggtcttgtatctcggtctgagcacatgtccccagcggcatcgtgggggaaagcctgttgccactgtggttggctagttcctggggggggcttgcaccgtgggttcgtagtgaaggagggtaggctcggtggacttcgcacggtgggaggtcttctcttgtcttggcggatgtttttggcgcgaactgcctccgaggggtgtttatgcaggctggatcgatacgcaggcaccaggttatacaaactaccaagttacgtggtgcctgtgcgattcgcgcttagatggcgttggcgtctcgcaataacaaccgcgggcgcaccatgggtttctgggaccctccacagggtcgtagggctatcaggggtactgcggggcagtcgtaggtaaaactattccgctcgtaggggcccggttagtactcatgccacaattatggcggggggcgcatatcatataagccagcgtgcaagccacaaggtacaataaggcggaaggaaagactactacgcgcactttggatgtaaccgctctggtattgaaccagacaacgatcgagcgctcttcgatctaagag

SEQ ID NO: 495197 - DNA, 203 bp, Homo sapiens
ccaaggcaggagaaatgcttgagcccaggagctcaagaccagcctggaccacaaattgagaccccatctctcaagaaaatgttaacaattagccaggttaatggtttgcctttagtcccagtacttccaagctagcaagaggtcttagcccaagattggagctcagtaccatgatatccacctgcactccagcttacaacaag

SEQ ID NO: 495198 - DNA, 1053 bp, Homo sapiens
gcagagtgtggtggggggtcctgggcaggtggacaggaccctctgtcgcccatcctctgcctgcagggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcaaaaaaaaaaaaaaaaaaaaataaaaaaaaaaaaaaaaaaaaaaaaaaagagagagggggcgcgcgcgcctctcacaagatgtattctccccccgggggggcgccccagttttacgcgcgctctccccccccatcgtttttttttgtgtccagagggggcgccccctagagagagggggcgctcggtttatatataaacgccgagagcgcgcgcgggcgcgcgcgctgtttaaaacaccgcgcctctggcggcggcgggaacaccagcgcggcccgactagcgcggggggcacctcttggggcggaaggagcacccccctactgcgcggggggggcggcgcggcgccatatatgtgtggggcacacacacctatcccctacgacggagagattattaagcaccggctccaagggggagaaactattctaaacactctttcaagcgccgtcgctacacgaggggggtacaccacaacacgcgcgcgcgaattatgtagcttcgcgcctggtcagaagacaacgttgttggcgtaccaacagaggagtactttagtcttcctgacgacactttttttttaccccggggcagccttatgctactaatcg

SEQ ID NO: 495199 - DNA, 1194 bp, Homo sapiens
gtgagcggccgccgagcgggtgcgggtgcggggctgcatctggccatcacctgcgctggcctgcgcagcggacaccgtgctgtaccggcctgctgtgcgccctggccacctggggcggaccgcggaacccgaggctatgtcccatgaaaagagtttttggtgtctggggacaactatcctccccccaaccctgggatatcctggtggtgtgtgccccaatgccagacaacaatgcacacacccataattggcatgcgagccatccgacatacacgacatatggagagcaccacagtaaagcgagaaagggagaacacacagataagagaagaatgcaaagggaaaccagaggcaagcaagaggatgagcgagagcagagcgagcagagacagcagaagaggcagacaagagcgggagaagagaaaacaggagaagacgaccagaggggaaaaggaagtgagagagacgagaagaagaaggcagaggaagagaggcagagagaaggcggagggacagggggaagacggaggaagcgaaaggcgagaggaaaagaaggagaggagagagaaggcaaacaagacacagaaggagcgggccacaggagaagaaagcgagaaggagaggaagaagacagaagccgcgcgcgccagcgagcggagaagccgaacagaagaggcaagcacgaagaacggagagaagacaagagacagagggagaggacgagaagaggagagagggcgagaagacaagaggagcagacagcacaacaagaacggtagcaaagcgaaagggagacggggaaggcaaaggcgacgcagcccggaggagacgagagggcggggagaaaggccggggcacaggaaagagggagacagcgcggcgcgagaggggaggggaggaacgcgggagaggcagacgaggaggggcagagggaacagagccaaagaagggaggcagggggaaaaaaggaggaaggagagaacggagaaacgcagaaagacggagagaagaagccaagggggagcacagacgaaaagaaaaaaaaagagaaagcaagaacacagagcaaggggacacacacacgagagaaacaccaacaaggacggggagacgggacataagagaagaaggacagaacgagagagaagaaacgagagaggcaagagagaagacaccgcagaggagacgaaacga

SEQ ID NO: 495200 - DNA, 658 bp, Homo sapiens
tcaagaatgctttctgtatttatttaaaaaaaaaaaattcccaaaaggggtaaaaaacaatcatcaaggatgtaggtgccaaacagagggcaaaaggtactaaaaaagttatgcctaagggaagtaaaaggtctagcctcatccctacctgtgtttaaataagctggtcacctaaattataaatagctaaagttccccaataggttctaaaattcctctggcccctatctaacaaactatgggcacgagccagtttgatttgcaagggcctcagtatgagggacccctatgtactaatacaggccagtacgagcgagtactaaggctaaactaagaaaggatctctatcccccattatgtgggtctcatttcaagtctatgtggatgactacctctacatggctggtgtgcaaaagtgggtttcacccctttgaaaaatatgggtcctttcagcattaaaattagcttaaactctgttagtaatggagtcaagtacatcctacctccttttacattgcggctgaaaaagtgaccgggctagggacattagaacattgggcgaccttaaataccggtagaaatcagctgccatttaagtgactcactagcgtaggggtcactaagcttcacaaacttacggaacttttttatggaatcg

SEQ ID NO: 495201 - DNA, 611 bp, Homo sapiens
  misc_feature (203)..(203): n is a, c, g, or t
  misc_feature (220)..(220): n is a, c, g, or t
  misc_feature (266)..(266): n is a, c, g, or t
  misc_feature (310)..(310): n is a, c, g, or t
  misc_feature (398)..(398): n is a, c, g, or t
  misc_feature (439)..(439): n is a, c, g, or t
acagaggccccaggcttggtctggcgggagggtgggtccagccctgatcctgctggtggactgttccggtgctcaccaggcgtgggctcctctccagccaccgcaacctgagtggggagaggtaccccctaagagacacccaatcagttaggcccggaaaggcggggagacaggcaggtgggactagctgtgcaaccttggtntcaggtctgagtagaanggattttctattcatcgtccgaggctttaaagcagggcaggagcgngcttggcaactctcaggtgctgtgcacttaagtgacacacctgngaggaatgtggagaagagacaagttcaggagcccacaggctgaggagccccccaagtcctcaagtctaacaccagaaatggtcactgnggttgccacctagccagagcgccacctctgagatgaggctnctcaggaaaaccttctccaccccactaacttctaaaggccatccaacctcagtctccactcctgcctgtcaccagaccagcctctgagccaccctccctgttctgccctgctctgttcccttttggcgggcgccagggtttagagccgggccgcaaaaggcttgctgccttg

SEQ ID NO: 495202 - DNA, 864 bp, Homo sapiens
  misc_feature (260)..(260): n is a, c, g, or t
  misc_feature (601)..(602): n is a, c, g, or t
tgatcctagcatcagcactatggctacgagtaagcgatgactctcaagcaatcattggtcctgaagatgtaggctctaactcctacgtggctgtgggcatgtgatagctcgtagggtgccatcaccgatgatcctggagtcttcctgtggatgctgcggatgactataagaaggaaagtcggctgacttgtcttactggtaggtaaaacataagtgcttgctgtctgatactcatgctacctgacagcgctggcgacagngttatacctctatggagctggtattattcaactagttctcatagtctgtaatcgcgtattgttgagatgcaacagctcatctattgaagaaacagcaaagcatttgtgtagtcgcacaacaggggcggaaatatgtgaagaaacacgagagtgtccagagataggccgagtaagtgtgttgttgtgcaacgacaagaggtttgaaagtgcgtgcgtttgtatggctcaaagtgggagcctgcctggattggtggtgaaactaaggagtgtgttcagacagcgtaatccttgatgagttagtgttggcctgtcctaagaatatagtccggagaggacacatnngccaaagactaatagatgggaaagagcaagctggttaccaaagtacgactctgtgatcgcatttccataacgacgacgttctagggaaaaagagagttcgcatgagtgagttatcggcaatactcaattctggcacctggcagtgtatgcgagcataactgggatttggcgtgtttacctattgcgtcctgtaattgggcacggaatcgcggaaaccacactgaagttctggtgggttgcaatcaaccctatcgttcggcca

SEQ ID NO: 495203 - DNA, 416 bp, Homo sapiens
  misc_feature (88)..(88): n is a, c, g, or t
  misc_feature (291)..(291): n is a, c, g, or t
  misc_feature (330)..(330): n is a, c, g, or t
  misc_feature (413)..(413): n is a, c, g, or t
acttgaggtcaggagttcaagcccagcctcgccaacatgatgaaaccccacctttactaaaaatacaaaaattagccgggcattgtgnaggcacctgtaatcccagatactccagaagctaaggcaggagaattgcttgaacccgggaggtggacgttgcagtgagccgagattgcaccactgcactccagcctgggtgacagagcaagactccatctcaaaaaacaaacaaaccaaaaaaatttccccctgtctctactaaaagtacaaaaaattagctgggcatggtgnacacagctgtggtccagctgctcaggaggctgaggtggncgatcacctgggcccgggaggttgaggcttcagtgaggctgtgatccagtcactatactccagcctcggcgatgggaccagancct

SEQ ID NO: 495204 - DNA, 428 bp, Homo sapiens
gaacttatatgtaagtttaaattttcggtagccacatttaaaaagtaaaaagcaggtaaaattaatttaggtgatatattttatttaatccaaatatccaaactatttcaacatataaccaatataaaattactaggccagactaggtagctcatgcctgtaatcccagcactttgggaggccaaggcaggtggatcacttgaggtcaggagttcgagaccagtctgaccaacacggtaaaaccctgtctctgctaaaaatgcaaaaaaaatattagccagtcatggttttgcgtgcctgttgtcccagctactcctcagtctgggaggctgaggcattaaaattgcctgaacccaggaggtagaggttgcagtgagccaagattgtgccactgcactccagcctgggcaacagcgagactccacctc

SEQ ID NO: 495205 - DNA, 306 bp, Homo sapiens
ccaattcctatacaatgcgatgagagatagacatgccacaaatctcacagacctcatacatcaaacaccagcccccatactctgagactccagacacaacggtatatccctacctgaagacccatccaagacaacccgcacattaagtagccttaggacctctcctatagacacacagggccatcctatgtaaggaatggtgacctgtaacaatatagtgtgccatactcttatggaaacagtgctatataaacagacaggatgtctaaagaaaactgggatgactctacccccagtaagagtccc

SEQ ID NO: 495206 - DNA, 696 bp, Homo sapiens
gggggtccccatcctattaggcggccgggatggaaattcctattcatcgggtgtgtttcccgatgtagccccccaacgtctgtcattttacccctcacacttggcaagtcgggtgaatggcaaggtgaattccttctcacaaagaaacggcttatgacccgagggcctcaaagctagaactcatccctgtctagagtggccaggagcggctgctcaaagtggtgccgtcgattataggtcttgtgagtccgccagcttgcaggttttatatcccacctccataggttaaacccagagtgcagaatgtgttattgaagattgtcacttgttcatagagcaagagatacttcaccgtggggatgctggtccgtttaactggttcagtggaagttaaaccattaaatgatggctcacgagtagtcacaacctttggagaacatatgatcattattcgccatgaatggatatattctgtgtggtcaagagttgtgtatacttccttgtccctgtactctgcttccgtcagtacccttaggatacgctttacaacacgtcaaggtctgatgttaaggccacgaactgctggaacaaacctaaatgggccccatgtgatttcacaaaagtgattgaactgtgggcccacaccaagtaggttggtgttatgtgaaccattggctcaaaataaagtacacactg

SEQ ID NO: 495207 - DNA, 387 bp, Homo sapiens
atcttacgtctaactcattgtattactagcattggggaatagctcaactttttaaacacattattggatttcctcccgcttcaaagattcacagaaaacttcatataaaaattcaggcccttcttgggcgatttttaaaatttgtatctttactagaacatgagaatcttttacccttggaagcttgaattataaatgtggtgtttggactgcctcagcagcaccagttgactggtcgtgttgcagcggtgtggggaggacggggcaggacgctgtagatctctccagacctgttgggatcctcagtgcctgcagggctctcgctgcctgtagggctgtctggggggtgggcatttagggatcgtgcggacggggtccaccccaaga

SEQ ID NO: 495208 - DNA, 813 bp, Homo sapiens
  misc_feature (39)..(39): n is a, c, g, or t
  misc_feature (84)..(84): n is a, c, g, or t
  misc_feature (223)..(223): n is a, c, g, or t
atgaataatgactgaaatgggaagacgtgacacacaacncatagggtgcacaagagatgggatgtgacaagaagaatgtctagntttcgactggtgcactctatatttcacagatagtgatacgactgggtgattggttggaaagcaatgctcccaaatcttctaaaagttctgcgttcatctgccaagagcaactgtcttgtcttggcttgatatgtcgagnttgttagaaagggtcataatcatgttctaaatttattcggtaatctttaggagggggccagcaacctagtagaggacaaatcaggcaggtctcagtcccaccaggtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggacagatttccccaatgttctacatcatttcatgttgtattacaatgtatgtacgaaatagtaacctgtgaactatgcttctccataacttttaaacaatatatata

SEQ ID NO: 495209 - DNA, 294 bp, Homo sapiens
  misc_feature (199)..(199): n is a, c, g, or t
cctaacaggattctacaggtagtgattggactgttctgttggcgagtgagactggtgtctcaacccggtatggtggtcactttgtccagtcaacgttacacggaagtaaatctgtcgaaatgcaccatgatgtttgagtgaagctcttcctgtggacactgtgggcttcaatgtcaagaatgtgtctgtcaaggatgtncgtcgtggcaacgttgctggtgacagcaaaaatgacccagcaatggaagcagctggtttcactcaaagcttcatggtgcatatcgacagatttta

SEQ ID NO: 495210 - DNA, 104 bp, Homo sapiens
tggggcttttcaccccgtttatttgcttttttgggaaaatcaaaaaccttgggggcctttttacccccccaaacccaagggggttttttcaagggcggcccctt

SEQ ID NO: 495211 - DNA, 248 bp, Homo sapiens
gagtgtggatgctcccacagcagcaggccggggccgtggtcgtggccgaccccactgagaggcaccctcacccatcacatggctggactggctggctgggtgcacttaccctaccttggcttggttactctcatttttacaaggcaaggtggtacgtacttgggcccactctcttcttactggaggctatttaaatccacaatgtaagacttcgaaacaaagcaaaaagagactaacacaaacagatg

SEQ ID NO: 495212 - DNA, 368 bp, Homo sapiens
actctagtaattcaataatacagtaaacccttgaacaacgcaggtatgaaatgcatagggtacgcttatatataggagtctcttcacctggctgggcaccgtgactcacatactgtaatcctggcactttggcacgcggagagcagagtggatcagttgcggccaggagttcgagaccagtctggacaacatggtgaaaccctgtctctactaaaaattcaccaaattaaccgggcattgtggacggagcactgataatccacacccacttggcagcgctagacgcaggccacgtcctctatgaagcctgggcgacagacgtatgcacagagccgcggttgagcccctgtcctccagccagggcgaaa

SEQ ID NO: 495213 - DNA, 254 bp, Homo sapiens
  misc_feature (32)..(32): n is a, c, g, or t
  misc_feature (46)..(46): n is a, c, g, or t
  misc_feature (81)..(81): n is a, c, g, or t
  misc_feature (88)..(88): n is a, c, g, or t
  misc_feature (109)..(109): n is a, c, g, or t
  misc_feature (222)..(222): n is a, c, g, or t
  misc_feature (237)..(237): n is a, c, g, or t
  misc_feature (247)..(247): n is a, c, g, or t
tccaaatcagtgaccctcaaattttagagtgnccataagaattacntcagacccttattgaaaatacagacccctgggtcnctcttcntccctagtgagttcaaatctncagaattctgacttaggtccatcttcgaaccacactttccagaaagttgtctgttgcccgcattcccactatcatgtccaattctgttccttcatattccttacataatctantttgtccttaattantggaatctcngaagttt

SEQ ID NO: 495214 - DNA, 372 bp, Homo sapiens
cagatctgggttcacatacccggcccttgtgctcggggagtaggtgtctctgtgcaccccacccagaggcactttgcgcctgcttggatgtgagcagacccggggttgttccaaacccctgccccattctgtgggcatggcttgctctgaggcgacgtgcagtctggggagaatgtggggcacgggggctggcctgtggctacctcctctcccctcatcccacagaccccagataaaagccgtctcccttctctgctctgtatgctcaaatacatttgagggtttattacaggaaagggacatgtgtccacaaaacggaatgagaaccacagctggagggtgagtgagagacagtggctgcgcagggggccg

SEQ ID NO: 495215 - DNA, 741 bp, Homo sapiens
cgctgtgtggctggcgtgctgcgtcgttcgcagttgcgccatctgtcaggagcggagccggcgaggaggggggctgccgctgggcgaggaggaggggtcgccgggagccgaaggccttcgagaccctgtcctgcctgcccgggctggcgagagtagaggcagaggttgttgtgcagatgcggctgcgtcctctcccgcccctgggcgcgccggcgccttcctcccagcgcacctgatggacctgcccggggtgcacagaaatgccagacgcccggctgcctgaaaccgtcccgggagtgcgggcccagccccggctgccctatgtgaggggatttccggggcggcccgggtgccctggaggaacaccccggtgggtgctgggaccccttttgaagtagcttccgtcgggaaatgggccccaagcggggtttccctgggggcccatgccgtgggtggaccccctcacgggaatacacaggccatcagaggcggagccccgcgaagcgaatatgggcgcggggcactcacgggcccccattgttgacgttggggcttcccgggaaggccctccaaggcggcccggtgccaagctatcttgtcaggagcgacaggcaatgatttgcttgcgttcctacaacctgtttggaccacaacgggaacccatgttccttgcgctctgtgtggggaagaccgcaacaatttgtgggtggtctttcttaccgcgttggcgcgaatcggtag

SEQ ID NO: 495216 - DNA, 104 bp, Homo sapiens
ccagtttgatctttgtaccgaggggccagtacttgaaacagctttgggatcaaatccttctctatgagccggcccaatgagccacaccacgagcccacaacgag

SEQ ID NO: 495217 - DNA, 175 bp, Homo sapiens
tccctgttccccactaaaatcagaacgaaacaaaaaaagaatttacagatataggacaatatccaacaatataacgaaagtaaaattctagaatatcatgatagccaaacagttaccatggcacgcagaagaatcagagaaaacaacccaggcataagcaaaagaggatgatcaa

SEQ ID NO: 495218 - DNA, 931 bp, Homo sapiens
gagacctcggctccggaatcacatgcagcccccctcgccctgagccagagcaccccgggtcccgacagccccgtcacactcccagcaaaatgggcaaggagaagaaccacatcaacatcgtggtcatcggacacgtggactccggaaagtccaccaccacgggccagctcatctacaaatgcggaggtattgacacaacaggaccatagagaagttcgcgccggaggcggctgagactggggaacgggactccttcaacgatctgcctgggatgctggacaaagctgaacggacggacgcgtgagcgcggactcacccactcgaccatctccctctggaagttcgagacccacacctggctaaccatagcgaaaccaccgtcctccacctaaaaatacaaaaacataaccacaggcagtaggtcaggacgcgcgccaggtaaacccagactacctcaagagagagactacaggaaggacgaaaccgcagaatccgggcaggcggacagctgcaccgcagccgagatcggcaccactgtacacctggcgtgcacagagagaggactctgactcaaacaaacacaaacacgcacaaaccagcagaccgcaccacaaaagagaccaaacgcacagaaaaccgacaaaccaaagacaacgaagaggaccgacgacgaaagcaacccagaccgcccacaacgcagcaaacacccagaaccacacgcacacacaaacaaccaccacacaagcacgagcacctcgcagcagccgaagcacgagcacacaacaaacccaagagacaacgcaacggcgcgacaccacaggcgcacaagcgcagagcaacagagaccacgtacaccaacaccaccacagacacacacacgggcaccccgaccaaacaccccacacacaaaacacccacccgacacccgcac

SEQ ID NO: 495219 - DNA, 180 bp, Homo sapiens
tggaggtatatagtggaaatgatagttcttcggcattactgcattataatagagggcttctactatgatccagacatggtctgtgaccggatgaatacaaacagagaattctcaggaccttcttaattgtaatcttatagtggactacaggctcacctgtctggaagcaggaataaccct

SEQ ID NO: 495220 - DNA, 179 bp, Homo sapiens
gccctggctgggtcaatggctgttatcacctggtccatggttatctgccgaggttgtgcttctgacgccttaatgtctcagagccagagaggcagagcaaggagaaaccggtgccttactcctttctcctttcattcccccatttcctggagtccttggtgcacccctcacgctctgtt

SEQ ID NO: 495221 - DNA, 379 bp, Homo sapiens
  misc_feature (103)..(103): n is a, c, g, or t
tcaccgtatatgtaaccaaatactcctgttcccaaaaactattgataaaataataataataataataataataataataattttaaaaaaagaaaaaaacagngcgggcgcggtggcacacacctgtaatcccagcactttgggaggccaaggcgggcagatcatgaggtcaggagatcgagaccatcctggctaacatgctgaaaccccatctctactaaaaatttcaaaaattagctgggcgtggtggcgggcgcctgtagtctcagctactcgggaggctgaggcaggagaatggtgtgaacccgggaggcggagccttgcagtgagctgagaatcgcgccattgcactccagcctgggcaacagagtgagactcc

SEQ ID NO: 495222 - DNA, 449 bp, Homo sapiens
tctgggcttgtcttacgttaggtgtagatcactagcaggtctacagatatgagtgaccttcactccgaatctgagagtgtttgccgacatagatgctttgtgtacatacaggtgccagactgtcatcactatgacaccggactccacagcgtgtaatccttggcacaacactgatcctcagtgcagtgcagcttcatgaacacaggcatcgcatacagatcggccatctggtcgataatccccatctgaagcgtccggatcgcagacaatggtagcattgacatgtacccgcagttcatgagagttcatggagatactcagaccttagcaagacgaggggcatagcctacatcaccgcaaatagacatggagcaattctagagggggcctaggtagaccaatatgctattaagatgctgtgtagtaaggtactgtctcagctcatagag

SEQ ID NO: 495223 - DNA, 127 bp, Homo sapiens
caagcggttttccgagagggtttcaaggtcgggctacccggttttcgccagctccccgctttttcctatgcaagcctaccccacttcgggggggcaggtttcaaccagtttgggataggtaaaaggg

SEQ ID NO: 495224 - DNA, 80 bp, Homo sapiens
  misc_feature (15)..(15): n is a, c, g, or t
  misc_feature (17)..(17): n is a, c, g, or t
gtgctggcaaagagnanatcagtaaaggctcgctctgtggagatgccttggtagtctcgtctttgttctgtgggttgatc

SEQ ID NO: 495225 - DNA, 1023 bp, Homo sapiens
gcgcagatggatccagcaggcgcctgtttccagctgccgcagtcatgacaggtagtgctcaatagtctctcgtttgtcacagttgcgttcgtgcacttgtgtcccatgtcgtccttctcgcaacggcagcatgcactctttcacacactgcactaggccttgtttacgcccatacaggcattggttgtgtaggaactacgcccagagtttcactcaaagtgcagggacacggagctctggccgtgccagagtctggcgatgctggcagacagttctgatgctggctgacccgagtggcccatgcaaaccttgtactggacgaacttacttcacgggtcgacacggccataccgtacgatcctgcaagaccagtagtcagctgatggaaacggacaatgctgcagctatgagcctcctactactgtgactgggcacactgaagtagcaagccacggagtgaagatgccgggggcagtgcctggacactcttgagcccgtgacaagctgaggactagacgtaccctagaatacggccaggagccagtgcagagcaccccgcgagggatccaatgggctatcagaagtcaggtccgacccttccgtcagtgcgtgacttccacagtcttggacccttagaaggtcacagagcacacagggcaggctgctggccatccaggcatctcagagctaacgttgggttacctcaaatcgaagggtgaggtggatgcatgagacactcttccaaggtcacaagggacggacgatgaggatccgatgcccaaccgcaggataccttgatgatccatggagaacgaagccgttcaagcaagtggcgaacgtgccctacagtcctgggagcctggggacagacaatccatcccaaccgaggtggcgcgctggaatcccaagcaatgccgaatcagagtaatgaaacgaactgaatagggccaacaacaagagttgctcacacacgggggcattcccgagggaccatacggacgccgagaagagtaggcccggggc

SEQ ID NO: 495226 - DNA, 150 bp, Homo sapiens
  misc_feature (108)..(108): n is a, c, g, or t
ggcgagtgcatgctattacaggcgcgatccctactgatcagcacggagttttgactgctccgtttcgactaggcggtcaccctccttagcaactggtggtccccgctnccgtgagtcacatattgatgccgaacttagtgcgggacaccg

SEQ ID NO: 495227 - DNA, 441 bp, Homo sapiens
  misc_feature (26)..(26): n is a, c, g, or t
  misc_feature (353)..(353): n is a, c, g, or t
tgtgctcgctttgagatagtgatggnttgttcagcaaggcacttgtgaaattgttggattggcaccatttttatagaacatcatttatccttgaaagaacaactggcaaactatggttattcagacttgagtccttggcagatactgtcgtgaatgaatgaagtgacagtatttgttgccactgataaaatttatgcttttaagattggaattttggccaggcgcggtggcccactcctgtaatcccaacactttgggaggccaaggcgggtggatcgcctgaggtcaggagttcaagaccagcatggccaacatggtgaaaccccatctctactaaaaatacaaaaattagncagacatgatggtgggcacctgtaatcccagctacttgggagactgaggcaggagaattgcttgaacctgggaggcacagattgcagt

SEQ ID NO: 495228 - DNA, 434 bp, Homo sapiens
atacggattttatgtaccgtaccggctgggttaacagatacttacagatggctattagcggtgcactatgccgtgagccgcctgcacgggcgttgaaagtagggacggacgcacggggggtagaacggagaactaaaattgggctagcgaggaaaaagtcggcaatggaaaaggggggatgcttagagccaagcaaatgccgggagagagcctttgaaacggccacaacgggacatgggtttagcgctggacgcggaagaccatgtatggaagggcaagtggggccgaaaaggaagctatactataggtgaggctgtgcaggtgggcacgcgtggagcattggtgttatatgcgggtgcgggacacccgtaaccgaggaaagtgcgaacggtggaagcggaaaaatagggagtgaatggaggttgggggggggg

SEQ ID NO: 495229 - DNA, 155 bp, Homo sapiens
ggggaatgtctgccccgtttagaggatccctctctgctccagatttgagcaattctctgctcagcctcccaagtagctgggattacaggtgtgagccaccgtacctggcagaaaatgtactttctttctcagaaatacttttaaaaaaaattgaa

SEQ ID NO: 495230 - DNA, 124 bp, Homo sapiens
ctgtatgcttgcaattctagcatagctcagctcatccatgcctcagaagtgtatctggatgagaacaggttactaagcatgaaagatgaaagagcagttggacttttcaaaaatacagcaaagt

SEQ ID NO: 495231 - DNA, 922 bp, Homo sapiens
gactctttctggtgttagatcgagctaccctctaaaagcagtttagagtggtaaaaaaaaaaaaaaacacaccaaaggctcgggcccaaaggggatgaaattcttcttggacttcctcctgctttctccggtaatggatcgtctggctccctagagtccttcggtgaagctttttattcctaagaggagaaaactcagtcaccggcgaaatcgtgctgatacaggcgagcggggcatgcgaatgggggagactggatggcctatgaatttggctaactttaacaaggcaagctgggtcctctggggatataattaagcttggacggggaggacaccagttgccaattgccagggactggggtgccacggtccaatacccttgggggtagactggcagcaacccgagacgatactttaacagcctctgccaaaggaagggctgcaccgggccgaacttgggaaggatggtaacgctactttcagctcaacatacatgcctggtgtacgtctaataacatcagaatggttgggcaacacaaagcatccctcagattggacagagacctctgacggttaagtgtaacgttgacacctttctctgggcactaacaaaggctattttcttcctgcatggcgaagaaataatcatgggccttattgcccatggtgtgcttccggcgctgactgccccggtccctttcttatgcctacggtcaacgcactgttggctgcggtttcttaaccttgaccgatgtacggcttgcttcacaattctgggttgacactggtgggtctattcgtcaccggtctcaaacccttcgtgtggccccttgtgcctggacggtcagcgtccggttcttcgcggagtccctttgtacatgggacggtgcgccgcaaatagttctcttgtatgtcaccctcg

SEQ ID NO: 495232 - DNA, 567 bp, Homo sapiens
tggttatacggacgatcatgcttagtgacgtgtctccaacagcagcgagagagtatccccgacctactgtgtacgatgcctgtctgaagctgcaatcccgttttgcagaaaaaccccagtcttagctcctccaggctcccaaggccggctggatcttcattcacagctctatgtgtgctgtctggggtggcttctccactgccttcttggcaaagaaggttggtccagaaagctacttctttgtccttcagcttctgggccgcctgagtgttggcaccaatctgcagatacccttccttctggttgtactctggccagtgtggcagcccttccccattggggttccattgcgagcaaagttggcccagaattttcatcaccatcttgctaagtctgatctcctcttctgaggcaccctcttttaaaaatggggccccaaagacggagaagagctcatccccgtggtctcctatcaccgtcttgggtttcatgtctgatgagaagcttggacggtactgaaactcatacatgtaggtgggtgctcaggatctctgtggtccgggccac

SEQ ID NO: 495233 - DNA, 433 bp, Homo sapiens
  misc_feature (13)..(13): n is a, c, g, or t
  misc_feature (155)..(155): n is a, c, g, or t
ttccaaacaaatncattcgtatatctccacagctctcaaatctctgagatctctagaagctcaatgagagagtggtcctctctctcggcaaggcatctctgtaatctcagagctaaggagaatcctctctgcaagtggtaacccaatccaacttntcttgtgtctctttctcctctgccctggtctggtgtagccagggcttttattgaactccgaggggaggaaatgcattcttaattgtcccatggttaccattggcaagcgggagaagcaccagaggtcccaccactcccattctgcccgactggcagcttgccccccaccttcaggcccaccctggtccaaaggtggggccttactggggacccaccctcttctgcccaggaatcagtctgcctcctgatgccatttgtgatccccagctcaccccagc

SEQ ID NO: 495234 - DNA, 177 bp, Homo sapiens
actgcgtcgctggaaggtcatagcacccactcacttagatgctaaaggtgattctagtacaatctagggattagggtcaggaacatgatcgcaagacacatggaaagctctctttatactcaaaagagctatccattgaaacgggatgtctaacgggatttaaacagctcccgtgga

SEQ ID NO: 495235 - DNA, 153 bp, Homo sapiens
aacgtagcacctcctttactggggataggatcccggtgagcgtatcactaacgcttcctttaatccttgttgccactggacccggcagtccggaggccgcaccagtctgccgccgccgccgccatcttttctcccctcagcccgccagccccc

SEQ ID NO: 495236 - DNA, 708 bp, Homo sapiens
  misc_feature (265)..(265): n is a, c, g, or t
  misc_feature (310)..(310): n is a, c, g, or t
ctctgtactttctacagtgaaagttgctacaggatctccctttgtcaagagatacatctgcggtggagtggaagcctgtggcaccattttctattgaagaggtagaagtggtcccacgcacacgagatgaaagtgttgggtgagaaacacttggacctcttgtatcccaccatactgcgccatgtaggggctggaatcgctgagagtattggagaaggagtaagcacagtgaaaccagctgacaaagttatcacactctttctgncacagtgtggagaatgtagctcttgcctgaattctgagggcaatntttgtatacaattcaaacagtcagaaacccaactgatgtctgatggtcccagcctgtttacctgcaagagaacatcaatatatcactttggtaataccagcaccttctgtgaatacacagtgataacaggaaatctcacttgccatgattgatgcagtcgctcctctagagaaacatgcctcattagctgggctttctcacttgcttggtgctgcatcaatactgccagggtgcctcagagttacctgtgctgtctttgcccggggggagacgcttgcatgtgcatggttggaaagcagaggagccccacgaccatgagtggagtaacaggagtttgaagcccggattggtgctatggtgcccacctcaggactaggaaccattacggtttttgttcg

SEQ ID NO: 495237 - DNA, 1462 bp, Homo sapiens
  misc_feature (112)..(112): n is a, c, g, or t
  misc_feature (265)..(265): n is a, c, g, or t
  misc_feature (343)..(343): n is a, c, g, or t
  misc_feature (1376)..(1376): n is a, c, g, or t
ggtctgagcgccaatgatgcagccctgtacgcatgaggcgtcctggcacgtggacagtgcactacagcacgcagtgcggggatctgcttacttgcgcattctagtgtttgtncgacaagcttgcttgcagttgcgccagaagtagaggtggatgcgagtgacgcagtcattgctagacagtcttggggaggcgcagcctcactgaacacgacaggccctgatgagctgcccgattcgaaacacccatagtgtagtccataacatncgtggctggcaacgagtgcacgacctaggtgtgagcgtgcattcctagcactgtcactgggcgcacgcgatgtagacngcaactcgtcgttacgatgtgtcgcagctggaggggaccctacgtggagaaagagctatccatggggatccaacccatgcatctaaatgaacgatagggcacgcgtggccgcccttgtggtgcccacggagaacgagcagggcaagcacacgggggtggccctccgaattggacacggaagggcaagccctgcccgtggcaaggccttcgccattggagagcgaaagccattgacgcacgaaacggaattggcaaccgcaagggaatgtcaatgggtgtgtggaaaggaccctttttccgattaataccgcgcgcggcgcccccatagggtcaggcggatggaagcccaaatccaacaaggagacgcagatcgactttgggttgcgccatccccttaagggttcgcataacctaggcgcgccaggccaaacccattaatcgggcttacctctttgccacagagtgggacacggtaatcgtggagcgagagacagaaccgccgggggcctacccaacctagggaaacgttttgccaagaactcatatcctcttaggaagaggaggggcttaaggtaggcctgatggccaccgccacagagggccacatataatccaggggaacacgttccccgaagaactctggccaggttcgcggatctggaaggctatacctttgggcacttctggcaaattttaagacttccaattttgtgcacggacttctctccacatacttgaatgaggaagggaagacggcttcaagggagggataggcaaaggcaaagaggaacagagaggtcgctgggagagcgggggagcacccattattctcggtgggccgcgacgggaaccaagttgcccagaggagcaagtacaaagcctttattgtgcctctcacctatacatcgtacccctgtggagcgcagcgatttgcgagaaaagcacccgcgaagaagagttgcggcacaaaaccctgagccctgtcggagtaccatctctgggtctatccatggtggagcagcagcacagtacncgcatcacgaatgtcggagtcagcagaattggccgcgcggagaagatcacggccatatgggggcaaatagaggccagagaccctac

SEQ ID NO: 495238 - DNA, 371 bp, Homo sapiens
agcacttgtggaggtcgggccacgtaccatcccagacatcaagaggccccaatgcgcttcacttgtttctcgcagacaggagaggcagccatgaaaactccaagcgccccttggcataagaaggagatgccccaaactactccacgtccagaaaactgatgggatctggctcatggggcggggcagcgcggcagtgataggacttcagagtgagcccaaggggctgggggaacagacccagctactgagcaccctgcggcatgagactccttgagaggtggggagcacggggccttcaggactccgctgccttcttgttggtcttgttccagagtttcttgagggtggaagacatgaagtaaggcctctcg

SEQ ID NO: 495239 - DNA, 210 bp, Homo sapiens
taagagcggctcatagtgcgggatattagattccagttataagtgatatcatatggtattgtctttatctttctggctcatttcactcagtatgagattctctagttccatccatgttgctgcaaatggcattatatcatccttttttatggctgagtagtattccattgtgtgtctataccacatcttcctaatcagaccgctcttacc

SEQ ID NO: 495240 - DNA, 658 bp, Homo sapiens
  misc_feature (149)..(149): n is a, c, g, or t
tgttattacccatcttctgaagcctacttctgtcaattcgtcaatatcattttctgtccagatttatgcccttgctggagaggagttgcgatcatttgggggaaaataggcattctattttttggaattttcagcggttttgtgctggnttttcctcatttttggggatttatctgccttcgatgttagaggctaatgacttttatatggagtttttgtgggggagatatttttggtgatgttgaagccgttgctttctgtgggttacgccttcttctaacaagctggcccctattcgcaagtctgctgcagccttctggagggccactccagaccctgttcaccctgggatcacccagggaggcttgcgaaacaacaaaagattgcttcctactcccttcctgggaaagtccggcccaaagcggaaccagcctgatgccacctggcgccctcctcgctggaggggcttgtcgcccccccgtggaggcgtctcccacccaagaaggacacacgtcacggtccccctttagggggcaacctctcctttatcaagccttacaaccttcgcctgggcaaatctcttagataaactcttttcaacctcggccccagttttccttcccggaccttcgcccccagctgcccacctccccttgcg

SEQ ID NO: 495241 - DNA, 416 bp, Homo sapiens
caagagtaccgaactgtcgagcgtcggtaccccaagcttctcaacggattgtattttttaatctcaatttagagtttggggtcgagtctcaaaaaagttaaatgaatggccttaagtcaaaacccactaacccaaatagcacagaatcaaactgcacgtttagataccagttctggttgactccggtatagtataacgggagccagtggccgacatggcgttgagaagcttaagcttctcaacgggagcgctgccaccttcatccccaggcctttcccacaacggcgagcatcttctaggcacccacttagagcccctcaacagacatgtgtccattcggtcctcgaccctaacaacctagtgttcaccccacactgtacagatgagcgaacagggaatggacgttgtgttaaatg

SEQ ID NO: 495242 - DNA, 100 bp, Homo sapiens
cgattctgccacctgaaacacagacactgcttactgccacacaggaaagaggaaacagaagagcagcaattaaagtcccagttactgagcggcacatagt

SEQ ID NO: 495243 - DNA, 133 bp, Homo sapiens
  misc_feature (13)..(13): n is a, c, g, or t
  misc_feature (45)..(45): n is a, c, g, or t
cagagcctgccanagggtggtggtcatggtgggggccggcatcancacacccagtggcattccagacttcagatcgccggggagtggcctgtacagcaacctccagcaccacaaccctactactatctcgcac

SEQ ID NO: 495244 - DNA, 904 bp, Homo sapiens
gcttgcccagtgaaacaccctcggctgggaagtcagttcgtgtcctgcgtcctctcctctcttctcgttgtgaacatggtgcgtactaacagcagacagtgttccaggcgcttacagaaaagtggtggtgctcgagctccagaaaggtgcttggctactatccagcatctgccattaattcgagatcagtttcatcgaggaaagttgaaaatcaatatgcaggaggggacccgcgaggcgttgcgcccaaattcccaagctggcaaacatcggacttggaagaattcttaaggcagcttgtgtgccctaaaagcattctgataaaagagaactcagatgcctgaagaggcacgacgcagcggtttcaggaaaacgccaagagaaaagcatgtcctttgcaaacctgatcagccaatgcatgacccagaatacgaactttctcatccatctgtgaataacgtctccgttgtgaccctggctatactagagtgtaccattacataaatgtgtgagtccaatcagcctttgtgaacaggcatgaagcttcaacaatccaggtcgaacatctccgatgtcaacagctagggtgtgaaattcgcagaatcacgtacactacattatggtaactagctcagctatcccagatactgcatcgcggcctactcacccacatcacgtgtcgagttcctgccaacatcaacgtccctgcatgggtccacacacagcatgggcaaccagacggcacatgggggacagcggccatcacggcgcgccacggaaagggcccagggcagcccacatggaaaaagaggtgctggcctaacagcgcacacacagaacaacaccatctggcgccgaacaaacagggcccacaagtcaccacaccgaggaaacgggcgaacat

SEQ ID NO: 495245 - DNA, 958 bp, Homo sapiens
ctggatggatgcggatcattgctatgatgaggatggatagtaatagggcaaggacgcctcctagttcgttagggacagatcggagaatagtgtaggcgaataggaaatatcatacgggcttgatgtgcggagggggtgttaaggcggtcgtgctagggctataattgtctgggtcgcctaggagagtctggtgagaatagtgtttgatgtcaattagaggagagaaggaagagaagtaagccgagggcgtctttgacttgtgtagtaagggtggaaggtgattttactcggaatgggaggtgattcctagggggtggttcgatccctgtttcgtgcaggaactaggaggtggagtgctgcgtagggctgcgataatgaagggcaagatgaagtgagatggtcaggaatcgtgtgagggtgggactgtctactgagtagagctcctcagattcattgaactaggtctgtcccaatgtatgggatggcggatagtaagtttgtaagttactgtgggccctcaggaatgatatttggctcacgggaggacttagcctatgaagggggtttgctacagtttggaagcaggaggattagtgcgatgattcaggttctgacttagaattgatacagattataagccacgcctgtgtgtactgaacattgcaagtccaggatttttgcgtgcccgtgggggtgaaaggttaccgatgaacaggcggatggaagttcgaaggcgacgggcagtctaaagcgcgagtgtgagccggaagaatccggtgttgaaagccgcgggagacttgccggacagggggccccgaaagagaccatctgcgtgggaggcggtagaagagctccttaacaatagtgggcccaggtggctacaagagggttaacccggagggggtgagggccccccaagcggggaggattgtgcgaaccctcagagaaagccgcgggg

SEQ ID NO: 495246 - DNA, 903 bp, Homo sapiens
gcgcttggcgtcggatgtgtatctgggctgcggatgacgcttgcttgcgggtacgatgggtgctctttgtgcggctgctgtgtctcgccctgtgctctggcccctgggccccgtcgcaatcctggtgggtcccgtcagggtcgcgctatcatctggtgctgcggcgaggatgctctggggtccgcatctgggtcctgatctatgttctgtgcagaaaggttattggttctacagtaggaagtactgtcacacaactgcaaacgactggtaccaaaggaatatctgtgatgcattcattctgtcgatcacaacataacgtagatgttgtcctggatatgataaaggttcctgtggtgcctgacagggcctgtcacattacatgaatctacaaaatgctcaacatgtattaagcatagatccttgtgcaagctcgggttgtatacgcaccgaccaactcatactagtacaggggccgacacttgaaagagctaaggccgtgagaatggaggggcccggctagtttcaactatcttcgcccctagcaacgaggctgggtctccttgccagctgaagtgctggactcctggatcagcaatgtcaacattgagctgtcaatgccctccgctaagcatatgggttgggacaggcgagatccatgtaatgaatgagcttgcaaaacaacggtatgagcctcaagctacttatgtaccccagaaattccaaacattccagaatccaccacgtaaacataatggcttgtaacttgtgaacttgtggccggtgtgtgaaagccgacgaccatgcaccaaagggtggtgcacctcatcgaaaaggtcaacatcccaacaccacaaaatcgccacatgaatcaagcacatgaacacctcgagtgataatcgaaaa

SEQ ID NO: 495247 - DNA, 544 bp, Homo sapiens
  misc_feature (452)..(452): n is a, c, g, or t
ggacccatgcctattttctttttttggagggaccccattgctttttagggaacggtttctgatcctaaacccctttatccacctgaattggtgaatctcactataacactaaaaacacaatttaacttaaataaatttcaaaatatcttaattataacattattcaacactattactggattaccccctcattccccctaccccctaatttacaccagaaaccttataccacgttaaacgggctttacacatgctaacccctcaatcagtccatgcccttataaaaccatttacacgtttcgttcaatcaaccattgccccacctttacaatataatctccgaaaataacactttctattcaatttaacgcactaggaccgcgttctctcgacccattaggcttttcttctcataaatgcacccgtttaaactaatccacctttttaaccanaaaaaccccaacccctgaccttatggattgggaaacttcaaaaccttaatcttttccaaattgggagcccgaaaggcggccaaataatataa

SEQ ID NO: 495248 - DNA, 352 bp, Homo sapiens
tgcttgcagaggaggaagaattccatctggagtcaagttctgtgcagagaaggactggggacagagaaccggtctccaaccaatttcagctggtctggtcttattaagtttggggttaacctgggggtgatgaagaaggtggagtctccccctggatggtgaaccggacttctgggcaaaacttggcatttgcattttggactcattgacgatgatgattgcccatggcgcaccagaacccagcgcagataagcccgccaacctggaggctgtgccagtcatagtagaaaggactgtttttatcttctaggtcattggcgtccaggacaggaaagtctgcaaggaacccacg

SEQ ID NO: 495249 - DNA, 151 bp, Homo sapiens
ggacgcatccccggattgcgcgggactttcaggacattcaggatgactgccattcactgcgcctggtaacttcacgtgggttctgggtttctacatttgtagcttgctgtgtcctttcttgtgacattcaactacgagtgacgggtcctgc

SEQ ID NO: 495250 - DNA, 305 bp, Homo sapiens
ggttggaggtacagaacttgatacactcctcaatgaacaggttgagatagcgctgactgatgaccgtggggactttgcccccagactcttttgggataatgggttactttaaactctatagggagggcaaaagctgccatgggtgagggcctacacaaggcctacaccggggaacgcatacgctaggaagccgtgcccatggctggaggcaagattgaggcgcgctgggacacatcagactgtctgcaatacggacagacacgccaaggcaagacaggatcactcagagaaactgacggcagccg

SEQ ID NO: 495251 - DNA, 1819 bp, Homo sapiens
  misc_feature (575)..(575): n is a, c, g, or t
  misc_feature (1073)..(1073): n is a, c, g, or t
  misc_feature (1528)..(1528): n is a, c, g, or t
tgcgggtgaggtctattcacagatgcgggtggtgctgagtctgtaagccattaggaggaagctgctggctaacggtcgatcattgttactgtgtggagtcacgatgtgctcttggcagctatctgggcgtggacacagtgtaacgcaagcaagaactgactcgccgaagatccgagtcagactctcgcagtcttacatggggaagggctccctggagaactctggctgtacacgacatggtcacgattgctgcgcaggatcacttctatctgcatacaggtactgcggccgtggcgtggggccggagactgcgtctctggtgacacccaaagggggacgtaatgaccccttttggttgtcagtataactaccagaatggatggcggcccaatgtacctcggtggtacacgggctggatggcccttggtgacggacggacactcgcgggacgggcgatagtctcgaagctgcgggcgacacggaccccccttgggaacgcacatatcaaaccacttgcgagctagaggacgaacgagcctaacacggctcgtgaactcagaggaaccaccacatgnggggggagctagcagagggcaaggaaagccaacggaggaaatcatagccccacgtattatcgacaggggcatcaggtaccgagcacttagcccggggggtgcccagttcgatcgctcagacctccggggtcgccaaggtatgcccgccacaggcgcgccgggatcccccgttgggtgtacataaccagaatacctcggggggaatctacacacggatcccaccatatatgtgtgtacgcaagggaccagattgtttcaaaaacaaagccgttagaagccgggttaaccccgtagctttccaaaagagacgttacatttttggacgcccaggtgttcgtcaaccacacagacagtaggtttcaaacaccaaacgctattgacgatcaagggccccaacacgtaagttccacacgggattcaagacagtgaagcccagcgttagaacggccttggcgcaggggcacatattccacaaaggacacgagcgcacgcactttngtaaccagacacaggaaattccacaatggttcaccacaacataagttacgggaatagagcccgttggcaacagacaagaccccggcactcatgggaaggcacgagaattccggcactggcagaggaccggccaacacaacatggggccacactccccaggaactgggggccaccgcaaacgcacacacgggcgtgcacttggtcacacgggttgtgggctcgcacacacatttggaacgagagtgacgagcacgcggagaagtgcacataaggaatggcaacacaaagatagacagcaaatcgacacagcgtagaacagaataagccaccgagaagcactcagtgtagaacaagagcacaccgcagcacaccaatgcacgacctccaaggaagaacagcaacaaaatattgacaagacaggaccatgccacaggggtaggaaacaacgcaggcanccaagaagaaagaggaaaatagacagagcgacactgaacaccacagcagggcagacacagtgcaaaaagaacgacacacagaacgcagtatggacgagggaaacaagcaaccgccgcagcaatggccacacaacgagacgaggacgcacactagacatgacacacagacgcgtcacaaccgaacaaacacaggaacaacggccaaaccacacaccacaacgaagagagaccacgcaacccagcacaacgagacaagcaacacaagaagaagagaaacaatcactcacaaca

SEQ ID NO: 495252 - DNA, 155 bp, Homo sapiens
ggggggggccccaaaaaaccccaattttgggggggctttttttcccccccccccaaaggggggggggtttttttcctttggggggggggggggggggggggttttttttttttccccccccccccccccttaaattttttttttttttttcccca

SEQ ID NO: 495253 - DNA, 279 bp, Homo sapiens
  misc_feature (34)..(34): n is a, c, g, or t
  misc_feature (41)..(41): n is a, c, g, or t
ccatgctctaatgccttgttggatcacggacaancctcttngccaagctacagcatcagcgatgttatcttgcagcaaagcactgcaggataaatgacaggcattaactgctcctggggtttagccatcattacaccagtagcggctattgatctgttaatatcccataatgcactgcttcgtgtctccagccattgtagtttgatagctcagtgtgttgtaaccacatctcccatttgtgccaaacacatccagttatggccatgcgagtaaatggca

SEQ ID NO: 495254 - DNA, 414 bp, Homo sapiens
gtgacaggatgtgtgagtattccgttcacttgaacactttaggggtcactgtggggttattgatggcctaatttcaacattattgtgtctcagagaatagggaggcccaaggaaagggagacagactggggaatggctggctggtggaactgtgagaatacatgtttattgattaaattcaccatcttatatgggcacagttcatggctccccaaaacaattacaatagtaatgtaaacaattactgatcacagatcaccataacagatataataataatgatgaaaaagtttcaaatattgtgagagttaccaaaaggtgacacaaagacatcaagtgagcccatgctattggaaaaatggtgctggtagacttgctttgacacaagatccctacaaaccttcaatttgttat

SEQ ID NO: 495255 - DNA, 744 bp, Homo sapiens
acgaaggtttgtcgtcaaaattcttgctgggacccccccccttctggcacgttgtgtccaactgtggggccgtgacgtggaccacccgaagtgcaggttttccaagaaattcttgggggacttagggcaccacctttctgggtggtgcactcccccgccacaccagggggtgcgcacatattgtagcgcgccctccttcgtcctccggggacatatggtaacgcccttcttcgagatatctccgccgcaccacatggtgtgtcctcgcatttagatttgttctcacctcacccacaagagaggaccaggaggcaacctgtgcggtgtctccaccaccgctgattccccccaccacccttgtgtgtaggccccctgagtttgtgcgactcagtgcctactccaccttaatatagcactatgcggggctattactgagagacaccaccctcgtggctctccacacagctgtggtgtagataccacactcgggtgtgtgtctgtctctgttcacaatacccacaacagatgcgggcagcaggataggagttgcacaacagccccacgacgccccccacctcactcaatgagaggacgacgagggcacgcggagaaatccaccaccaggaaccccgcggcagcccacagagagtgtaccacctcgaggccagcagaagagccaccacccgccccacccccccctgggagaccccagacgaagaagagcctccaccttccaacataacc

SEQ ID NO: 495256 - DNA, 711 bp, Homo sapiens
tattcatacagggatgggtgtcgtttatgtataggcagtggtggacaatatagatgcacagcaagctccacagctcatgggaccctgggtcacctaccctgggacctggggataagtttggctgtggacagtgctccaggtccgggggttccctggggtggatgaggaggcaggccctgcacagtaggtcctgtgtttagtcagctcaggcccagtctgacaggggctgtcacagaggctgcactggatagggaccatgggacccctgcaccccagctcatctctgacacaacccaggccattgagctgacactctgcgcggctgtaggatatgacagtagcctggagttggtaggagcactatatggcacccaatagagactgcggaaggtgctaggtagatgctggcagctcagagccggcggtccgtgcccttgcttgcgggccatctacctaccactggatgcagaagcccttctactctgacgaaagatgtgctactttggacgtggcctatgcctatggcaaactcagcttacaccagacccaggtgtcccagggcctggccaccgagctagctatacctacatgcccagactgacttctggtgaggtggcccactgtgcaagtccttcgcttatcaagtggtcagctgccctggttgaggctttgccagaacgtctgacagagcgcagaatcacctgccactgg

SEQ ID NO: 495257 - DNA, 964 bp, Homo sapiens
tctcattcaaaagtagtctgctattgtcgccgtgggcttgagctcgcccgtgccggccctctccgtggtgccgcgctgtgacgcacgcgggtggacgaggggaccgatcccgggtgcccatggccggtggcctgcatggtcgagcggggccgcgtgcctccccccgcacccgcgcccagcacggaggggctgccggcgccttcctgcagagcctgcgcaccctgttcgactatcctgtgactgaccaggcggcgcggttgctgtgcacctgccgcggagatcgagtcccgctggcagggcaccgacgcgcgggagctgccccgcgggtgtgctggggggcttgcgccaggtgtccccggccattggctacctgaccttcgagcgcttcgtggccggcctgcgcaccttccctgctgagcgccgacggctgccccccggtgacccctacgcggcgcccccggcccggcccgtggattagccgccgcgccgtcgcagccgcctgttgttcgctcgggctcgagcgaggccgcggacggctctgggagaggaatgcccctgccctgggcggtgccgcgccccctctggacggttcccagcgccgccggccagcatcacgagatgcagctgtgtcgccggttgacgcggcgccctcgcccgcgcatcccggagcgggtcccagaccgcggccctgacaccctactttcaggcccgttgcagcgttagccgggacgcttacgggccctgagggcgactacagggaattcccggtggcccccgtgtcccaggggccgtcgcagtcaccctcccagccgctcattctccgttaccaccaattgacgactatcataaggcgctccgtgaccatgtacatctgttttctcacctcacgtaagacacccctctgtgcacgttcgctgaacccccgagacaaacatccggccatctccgcactcaccccttcata

SEQ ID NO: 495258 - DNA, 305 bp, Homo sapiens
gaacagatcaatacgacagtgaccatcatcatttgtagaccaactgtttataccatcaactaaactactattcttgcgtaatcataacgaaaaagaggttgttgctgtagacccatgctgtctatcaagcaatgctcagcttgaagaatattcctgttttggcgactgcctataagttaatcttgggcgaaatgacttgtgccctaaaacaacctcctggacagtctgcaacttcctgaggcctgtactgaaataaaacatgaggcttttacgaatcatgtgttcaatgtacaccaagggaaaca

SEQ ID NO: 495259 - DNA, 549 bp, Homo sapiens
tatggggtgggtttgaaaccagcttgggggggttcgattccttcctttttggtctaaattaatgtatacgggttctcgaatgtgtggtaggggggggggccatccatatagtcactccgagggttctagggagggttcttctactattaggatgttttcgcttcgaaagcgaaaggcttctcaaactcgatgaaaattattaatattactggcctggttagcagcaaagtgaagtgaccctacagagtgataggagtgtccagtgctgggtgtatgcatcggggatagtccgagataccgtcggtggacatccccggaaataaggcgcggcaagaaaagtctgtcggggggaaacagaacatgtgacgaattagcccgcgcgcatgaccatttagttaggtcaccaacgggcccacgggccgacaaggtcagagctcaaaagcggcgccccccgccaaccagcggcgacactcgagcgaccagcaccccccacaatgatgcgacaacacaaagcccacgacgaacgcacaataacgcaacagcgacacc

SEQ ID NO: 495260 - DNA, 317 bp, Homo sapiens
  misc_feature (41)..(41): n is a, c, g, or t
ccccaggaatttgctttggagggaaatgtttatttttttcncgggaatattttaaagattggggcatggtggctcctcccgccagttgcaaacctgccccttccgcctgatttccgatccccctgggtgggccgcatttttggtcccctgcctgggtccatcgagggggctggctgtggcctgttttcctttgaccccccccagggtcatttcgggtcttggggggcccctggtgggagcttgtggagtcggttcccgtacctgtgcagaaaccgcctttgtgggtgctttttaaattaaacccgcccccgcagcca

SEQ ID NO: 495261 - DNA, 1283 bp, Homo sapiens
ttttttctggggtggggtttttcccaggggttttggtttggtttattccaaatactgaaaaagtccttggggctctggtggggttccccacgccctcagggctctccttttctctcccacactctcacgtgcccttttttcccaacagcaaatctcttattttacaaggacagaactttttaaaatgtgatttaagtggtggagttttctcaacatagcctctctgtgcaaaacttagagaggaagacgtgtttgtgccttctgtgttcgtggtggggaattgggagttttctttttattcttgcacccccgaggtctctctccaacccacccgtgaaacacagaggcgctttatttcttacaagagagcctcaaatataaaaacccccttttctcatattgggctatctctccaaattctctctttccccttctattactctataccccaatattcggtgacgcgtgggtgtgtggacttctcttgtgggagtataaattctcctaacgcgtggggggttataagaaaaattctcctatagcggtgtggacaacaccctgggtgtgtgtggtgtaccaacattcaaggcggttgtgaaaacccgtgtgttccgcgggaattaaggtgcagatattttctacaagaaagatgggggcttttataatagcgcgaggtaatacatagtgcgcctaacgggggtttaataaagatgtttcgggggctcttttaactcttaaaaaaataataaaaaaaaacagggggggggggccgttttcaaagaaaatttccccctcgcgagggggggccccaaaatgtatatagggtggttaccccccacggttttctctttgtgttcccaaaggggggggcccccatatagtaggggaagacccccagaaataatattaaagactaatacgacaatgattgcccgcacggattttattaacacaaaggctgcgctgtacatgcgggtggacaaagagtggtgcggttaaacgatgaggaaaatctctgttgtgtgggagaggggaaccccttatacttctgggtgggggggggagacgacaatatcatggggtgggcgcaaaattttccctataaagaggaggattttataagggccctaagagggagaaatatatacatttttagacgggggtatctttggttggtttaacaaaacgcgggatatttgctgttcgcgtttaaaaatttttgcgcacaaggaggatattaatttttgatatttcagtgggagagtatacgataattaaaatgc

SEQ ID NO: 495262 - DNA, 417 bp, Homo sapiens
cagaagcggcgctcgcgccaagggacgtggacctgcgctcgcgaggtcatggaggcgctgacggtgctagccgcgacaactactgaccacgggcgccaccgaaggctgcttctgctgccgctactgatgatcctgctgccgagtggagctgcgcagggctgctagacataggacaggccacggactcgagaagaggagtgccacttctacgcggctggacaagtgcacacgagagaggcatccaagagatcgatcgacgaccacttcctgcacctaagcaatgcgaagatttccaagacagagccctactgggaaggaacagctgagagcgctggataactgaatgagctgaagttaactgcatctcgagggtacttagtgtcctctgatacccacttgaggtcacagttgcgtgtg

SEQ ID NO: 495263 - DNA, 401 bp, Homo sapiens
gacgctctctctgtggggatactctcccatgtgggagagggctctcccttttgggccacctcacgctgcttcggaggacttggggatgctccctccttctcgtgagtcgttctactgatgtgggaaccatccacctactgctgatattctctagaggtctgcagtgagatgaagaagtgcctctggaatctgcatgggcttaccgcctccaaatgggcacatcagaggcaatgagatggggagcacatccttggtgaggggcagatggcagtacgggctgaggatccctgcacaccatgggcaaccagtgtcggaaaactggagttcaatgcttgcttgcccagctcctgcagacttgcttttgctctgtgccagagtaactcccccacagcagagagcgt

SEQ ID NO: 495264 - DNA, 829 bp, Homo sapiens
  misc_feature (11)..(11): n is a, c, g, or t
  misc_feature (19)..(19): n is a, c, g, or t
  misc_feature (24)..(24): n is a, c, g, or t
  misc_feature (45)..(46): n is a, c, g, or t
  misc_feature (49)..(49): n is a, c, g, or t
  misc_feature (53)..(53): n is a, c, g, or t
  misc_feature (58)..(58): n is a, c, g, or t
  misc_feature (73)..(73): n is a, c, g, or t
  misc_feature (81)..(82): n is a, c, g, or t
  misc_feature (88)..(88): n is a, c, g, or t
  misc_feature (100)..(100): n is a, c, g, or t
  misc_feature (115)..(115): n is a, c, g, or t
  misc_feature (120)..(120): n is a, c, g, or t
  misc_feature (137)..(137): n is a, c, g, or t
  misc_feature (144)..(144): n is a, c, g, or t
  misc_feature (170)..(170): n is a, c, g, or t
  misc_feature (173)..(173): n is a, c, g, or t
  misc_feature (186)..(186): n is a, c, g, or t
  misc_feature (208)..(208): n is a, c, g, or t
  misc_feature (229)..(229): n is a, c, g, or t
  misc_feature (246)..(246): n is a, c, g, or t
  misc_feature (248)..(248): n is a, c, g, or t
  misc_feature (255)..(255): n is a, c, g, or t
  misc_feature (258)..(258): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (298)..(298): n is a, c, g, or t
  misc_feature (305)..(305): n is a, c, g, or t
  misc_feature (330)..(330): n is a, c, g, or t
  misc_feature (332)..(332): n is a, c, g, or t
  misc_feature (345)..(345): n is a, c, g, or t
  misc_feature (377)..(377): n is a, c, g, or t
  misc_feature (380)..(380): n is a, c, g, or t
  misc_feature (392)..(392): n is a, c, g, or t
  misc_feature (430)..(430): n is a, c, g, or t
  misc_feature (435)..(435): n is a, c, g, or t
  misc_feature (437)..(437): n is a, c, g, or t
  misc_feature (454)..(454): n is a, c, g, or t
  misc_feature (460)..(460): n is a, c, g, or t
  misc_feature (472)..(472): n is a, c, g, or t
  misc_feature (475)..(475): n is a, c, g, or t
  misc_feature (478)..(478): n is a, c, g, or t
  misc_feature (480)..(480): n is a, c, g, or t
  misc_feature (485)..(485): n is a, c, g, or t
  misc_feature (503)..(503): n is a, c, g, or t
  misc_feature (514)..(514): n is a, c, g, or t
  misc_feature (521)..(521): n is a, c, g, or t
  misc_feature (540)..(540): n is a, c, g, or t
  misc_feature (545)..(545): n is a, c, g, or t
  misc_feature (556)..(556): n is a, c, g, or t
  misc_feature (575)..(575): n is a, c, g, or t
  misc_feature (578)..(578): n is a, c, g, or t
  misc_feature (589)..(589): n is a, c, g, or t
  misc_feature (596)..(596): n is a, c, g, or t
  misc_feature (601)..(601): n is a, c, g, or t
  misc_feature (605)..(605): n is a, c, g, or t
  misc_feature (611)..(611): n is a, c, g, or t
  misc_feature (614)..(614): n is a, c, g, or t
  misc_feature (621)..(621): n is a, c, g, or t
  misc_feature (625)..(625): n is a, c, g, or t
  misc_feature (627)..(627): n is a, c, g, or t
  misc_feature (629)..(629): n is a, c, g, or t
  misc_feature (636)..(636): n is a, c, g, or t
  misc_feature (660)..(660): n is a, c, g, or t
  misc_feature (663)..(663): n is a, c, g, or t
  misc_feature (672)..(672): n is a, c, g, or t
  misc_feature (680)..(680): n is a, c, g, or t
  misc_feature (687)..(687): n is a, c, g, or t
  misc_feature (689)..(689): n is a, c, g, or t
  misc_feature (691)..(691): n is a, c, g, or t
  misc_feature (709)..(709): n is a, c, g, or t
  misc_feature (715)..(715): n is a, c, g, or t
  misc_feature (741)..(741): n is a, c, g, or t
  misc_feature (743)..(743): n is a, c, g, or t
  misc_feature (748)..(748): n is a, c, g, or t
  misc_feature (754)..(754): n is a, c, g, or t
  misc_feature (787)..(787): n is a, c, g, or t
tgactggctanaaattttnaaaanttgcgaggcagtaagtgcccnnganagcnggcanagtgccgggaacacnaggccccnncggganaaaccagggccntaaggaaaggggctncggcnttggcttgagggaaggnacaaaantgggacaggccccggccgggagtatncanaagccaagggggnagcgggggaccacaccaccccnccccaccaaggccaaggagangcctttgaagtagcggnanagccctngcngccaggggncanacngcagggcggccaggcccccccgganccgagcngcagccccgaaacaccagggggcananagcattttcccangccgggccgggggggggcccccacccaggganctngaggcccccganagagaccaccaccatggcaaaaaggtcgaaggccccgnctgcnanccgccgcagcggaaacngtccantgacaaaccccntcntgngngtaancagcctggcccccaccanagtggcaaacngccccanagcccgtcctgccagcccnccacnccgacccaacnccggggggacaagtccgcnganactcaggccgntgcccanccctncccnccgccncanctgtttncctncntntcctagnaggaggccagccttcccaaagggnttntttagagcnctgccaancccaaanancncctttcctttgtccaaanagcccngcagagccacaaacagccgaagaatntnatttntccccncaaagatccggaagaagcgaagatctcggagcncacgctctactccaggttccttcatgaagcccatacccccca

SEQ ID NO: 495265 - DNA, 889 bp, Homo sapiens
cgagcacctcctctactcagtctctagctcgcctgggttctcccgattataggcaactcagccctgctcagcttgcctggataccgcgccaccactcgcagttctgctcgtcgttcccaggccgggtgtccagtggggcccctccaggaaggaacgagcttctacatgggcacgttgccaggatgagcctgagcagctggatgacgtggaaccgcatgcagagctgcagcagcgcaatcgagtgtgccccccaatctgaagacctgctatcccctggagtccaggccttccctgagcctgggcaccatcacagatgaggagatgaaaagctggagacccccaagagaccctgcgccgagcgcagtcatgcagccaatccagatagccgaggagcacgggcatcaacacccggtagcagcgcaaacgggtctccctagagcccacaaggccatggaactcgtgagtctaagaaggcaccagctgtttgccacgcccatgactccccgaagacgacattgaagggcgcaaacaggagcactactgaggcccagaagaaagcaggctccagctttctactaaacgggcctgaccgggcgccagatcgagggcctgcagcattcctcaacagcacaccaagaaagctagggaacaagcacttctggcggcggggacagccttcaaacgaaggcctggtccaaggtttccccaaaactcgcaggtggacccgccgtcttccgcggctagcaaccacacagacagggcgccatggtggcgccatggtgcaaccctcgagccagggacaggcaccaactaagggcgggccagagtgccaccgggtcccgaagtggcgacatgggccggcagggcttcgagcttcatatccgggaaa

SEQ ID NO: 495266 - DNA, 216 bp, Homo sapiens
atgcctcattattatgactgtggttcaacagtattgcgttgtcagactaggaaagccaacgagcaatatggttttagtttgctgaagactggccttattaatggacagcgttcctaacaagggattattaacttttatcaggtgttaacatctgtgtcaggaacatggcagtatgttacatgtcagaagatatgtttaattctatggtatttctaa
